United States Patent 7,745,391 (HUMAN THROMBOSPONDIN POLYPEPTIDE) - sequence listing, part 9

SEQ ID NO: 20998 - DNA, 541 bp, Homo sapiens
aaaacatttgaggcccactgaagggcttcccccacacacaggtgtctctgcagctggcctccggagccttcctgctcaacgaagccttctgtgaggccacgcacatccccatggagaagctcaagtggacgtcccccttcacctgccatcgagtgtccctcaccacccgcccgtctgagtccaagaccccgagtccccagctgtgcaccagctccccgcctaggcacccgtcctgtgacagcttctccctggagcctctggccaagggcaagctgggcctggagccgagggcagtggtggagcacactgggaagctgtgggccacggtggtggggctggcatggctggagcacagttcggcctcctacttcactgagtgggagttggtggctgccaaggccaactcatggctggagcagcaggaagtacccgagggccgcacgcagggcacactcaaggccgctgcccgccagctgtttgtgcttctgcggcactgggatgagaatctcgagttcaatatgctctgctataacccgaatta

SEQ ID NO: 20999 - DNA, 495 bp, Homo sapiens
cagacaccattttcctgagccctcgcagattcaagtcagctgcctgcatggctccaaagatggaggctcttcctattccccaacagggctttctgtcaacccactgaggaaattcctccctcctgtatgtgaagcatatttacaatgtagggctcattgacaaacctgaaccaatacatgatcaaatcctactcattttcccaggtttccttctgccttatcacttgggcccagtcattgggctaggagctcaaacctaaatcctgggcttcatgcttcagtctttcaggttccatatcccatcttacccataataccctgcaatacctagcaagacctgccctctgccaacctctctagccttctttccttctgctccacatcctatactctggcaacactgaactcctttcccctcattgtggttcttctcacactctgcgctgtttagtgtttccatgccttcgttctgctgagatttcatgtaattccacc

SEQ ID NO: 21000 - DNA, 418 bp, Homo sapiens
aatgaaaagtaaatcacatagatacttgagtgtttgttttatattaagactaagttattagcactgatacaatgggagtggttgttcacaatacttagcattcatgaggctgaaattaagcagtattaacaaagagaagcagaagcctgtcatatgtaggaatgaatgtgtcataggagaaagtaagcgtttgtgtgcttttttttcagaatattgcctgttttatgatcagtgccaatttaacaccaatgttttaaataaatgacttttagaactctgtatgagtctttactgaactcattgtctatattctgtatgttttatacaattaaagttttggttattttagttcaaggcttaagtgaatcccttatccttttaaataatgaaaacaagttagtattagctggagggggtt

SEQ ID NO: 21001 - DNA, 352 bp, Homo sapiens
ccttatacttctttcttttctctgttcatttttgttttccttattgtgaattttttaagttgatgtgtttcattttttattttcttataactgacaaaaccacacacacacacacacgttgtacactgtaaatatatataattttgagacggagtctcactttgttgcccaggttggagtgcagtggtgtaatcttggctcgctgcaacccccatctcctgggttcaagcaattctcttttctcagtctccctagtagctgggattataggtgtgccccaccatgcccagctaattttttttcttttctttgtattttcagtagagacggggtttcaccatgttggccagac

SEQ ID NO: 21002 - DNA, 551 bp, Homo sapiens
gggccagtcgggcctcttcacgcagtacaatatccagaagaaggccatgacagtgggcgagtaccgccgcctggccaacagcgagaagtactgtaccccgcggcaccaggactttgacgaccttgaacgcaaatactggaagaacctcacctttgtctccccgatctacggggctgacatcagcggctctttgtatgatgacgacgtggcccagtggaacatcgggagcctccggaccatcctggacatggtggagcgcgagtgcggcaccatcatcgagggcgtgaacacgccctacctgtacttcggcatgtggaagaccaccttcgcctggcacaccgaggacatggacctgtacagcatcaactacctgcctcctggtgaggctactccaggcggcccccgcagcacagagttcgtgcaccccagctcccaggcccagccagacgtgctatttgcataatggttaattgattgtggctcaggctaattggtcaacagagtggattgccaataaaccggcaccacgttccaggagtgagaatgggaaa

SEQ ID NO: 21003 - DNA, 480 bp, Homo sapiens
ggtgccctgggttccaggtggctgagggtgggctgcgtagcacccaggcctcaccctgagctggttttggggtgtttgttcaccaggtactgtaccccgcggcaccaggactttgacgaccttgaacgcaaatactggaagaacctcacctttgtctccccgatctacggggctgacatcagcggctctttgtatgatgacgtaagtatgaggctccggggaagaacagggaccagcttcctggtgggtggtggtgggagggccctgaacgggactctgccttggcagatgaagcttccaggcaggcaaggttaaccccctcgcccaggctctggatgcgggcctcgccctgtggtgacgaaagaggaagccaggctttctctgatttttgcagggcccctcctgcctcaccctgcagcccccaccctgagctcaccctggccccacctctggcctcagcagccggcccacagcgtgtta

SEQ ID NO: 21004 - DNA, 432 bp, Homo sapiens
actcttgaaataacagtttcaaaagtttaaaaacattatatagctatacaaaaatattttatgtgcttattctataaacttctattttaaaaatttttaatttttcttttttactttttaaacttttctgttaaaaatgaagacacaagctgcacacggtggctcatgtttgtaatcccagcacttgaggaggcctaggcagacgcatcacctgaggtcaggagttcaagaccagcctggtcaacatggtgaaacccttcctctaataaaaaataggaaaattagccaggcctagtggcatgtgcctgtggtcccagctgctcgggaggctgaagcaggagaatcacttgaaccaggaggtggaggttgcagtgagccgagatcgtgccacagcactccagcctgggcgacagagccagactctgtctcaaa

SEQ ID NO: 21005 - DNA, 437 bp, Homo sapiens
ccagctttgagcaggaacatgtaccttcaaacagatcaatcccgaaaccaattaaaaagaatccagaatacagttttaaagagtttattcaagcaaaaagctgggagtagccatccggaaaagagactccacataaacgggtcagcgcttcaaagttaaaagttaagatcttgcttatataggaagaaaacaaagaaatgtaatcagattacattttctgtgagttacaaccgtgtaattagttgcagtttgttttcttttccatacagctttttagttcctttccaatttaaaagagtgggccaggcacagtggttcatatctgtaatcccggcactttgggaggctgaggcgggtggatcacctgagctcaggagttcgagaccagcctgaccaacatggtgaaaccccgactctaccaaaaatacaaaaaaaaa

SEQ ID NO: 21006 - DNA, 297 bp, Homo sapiens
ccaatacatggcaaaaccccgtctctactaaaagaatacaaaaaaaatagctgggattacaggcacctgccactgcgcctggctaattttttgtatttttagggagatggaggtttcaccatgttggccatgctggtcttgaactcttggccttaagtgatctgcctgccttccaagtgctgggattacagatgtgagccactgtgcctggcctaaaaaaaatttatttcgattaaaagcattttttagactagtcacatatgcagtagtggaaagaggggaaagagtagaacaagg

SEQ ID NO: 21007 - DNA, 420 bp, Homo sapiens
gtcaggagtttgagaccagcctggccaacatggtgaaaccccgtctctactaaaaatacaaaagttagccaggcgtggtggcacgcagctgtaatcccagctagtctactcgggaggttgaggcaggagaattgctggaacctgggagggagaggctgcagtgagctgagattgcaccactgcactccaacctcggtgacagagcaagactccacctcaaaaaaaaaaaaaaaacaaaacaaaaaacaaaaaccccgcctggacaacaaaatgagaccccatctctataaataattagccagttgtggtggcatacacctgtagtccccagccacttgggaggctgaggcaggaggactgcatgaacccaggagttggaggttgcagtgagccacgactgcactactgcgctccagccgg

SEQ ID NO: 21008 - DNA, 271 bp, Homo sapiens
ctaggagtccagtcctcttagaatcatgttagggaggctagcgctttgatggcatttgtattttatttctgaagtgttccactatcgttctgaagctggaaattaggattattgggaaataccttcaaaactgatggtgccacatgactttcacataagactcgagacaaactttcttaagagtcttcattggctaatttcttgtgggttttttttttttccttccgagatggaatcttgctctctcgcccaggctggaatgcagtggcac

SEQ ID NO: 21009 - DNA, 432 bp, Homo sapiens
tccctcactgcagcactttctgttgtaccctctatactccaggcagtaatctgtccccatctcaccccgacccccaccttagcagcccacgtcacatgacaattatgaggtgtgatgagaagagctagagcaggagactgcagtggtgtcttctccccatgtttggatatatttgtggaagtatcatctgacaatctcattttcttcctgtgggttcttgacatcttgtggtaaacatctctttctgtgaacacctggaaaagctacagaagggcctgagtgattcatacatcttcacctgagcttaccacttaggttcattcatgtctgtgccaaagtcacgcactggtaggtgaataacaaaattactacatcttatagacaaaatgaggtaaagatgaaggatacgagcactgctattccaaaagttct

SEQ ID NO: 21010 - DNA, 942 bp, Homo sapiens
cgcatcgcccggctccgcggcgccagccatggcgtccgtgcgtggccccgccagggatggggcgacgcggtcagagccgcacgcgaccgaaatccgcactctggagccgcagagcgcgcggtcttgctgtttagcggctccctggcaagtgacgtggggaagaaacgcagggcgcaggagagacagctggaaagcgggctagccaggccccgttttcttcagcttctcccttgacttgatccctgaagatggctctgcctctggcgcccttgaaatatgtcgactaggtcatgatcaccgtgcattctgctcagcgtagtctccccgcctgaagtgttattaatgcagtctaaaatgactacggttctgcggtctaccgaactgcccacggaggtaggggtttcagacttttggcatctcaagagacttgagattaccgagaccacgatacccccagagacgtgacgagatgggatcaaggccacgggggaccagaatgctgacccaggcaacctgtccctgcctcgctgccctttgtaatactccttatcatatcatgaggagctattttccgttctccacaaacttggtggtggatggaagaggatatcaagctcaccttgagtgggattgaggtaggaggcggggctcagacaccagaccagattgaggacaaactaaagcaaggtcagggccaaagcagctttccaacagataggaccaccagggtgccacgtcagtttaccgttgccatgtcaataccagggagttaccgcccctttccgtggcagtaacccaataattaccaccccttccctagaaatttctgcataaaccgccccttaatctgtatgcaattaaaagtgtgtgtgtgtgagtgtgtgtgtgtgtgtgtgtgtgtgtatgtgtgtgtgtgtgtgtatatatatatatatatatata

SEQ ID NO: 21011 - DNA, 400 bp, Homo sapiens
tgtagagacaaggtctcactatgttgctcaggctggtcttgagctcctatgctcaagtgatcctcctggctcagcctcccaaagtggtgggattacaggtgtgagccaccacacttggccaaaatcctctcttgatcacacacaaccctctccagctaccaccttgtttgtctgcttctctttggcgcaaaactccttaaaagttatctgtacttgctgtttccaattcttttccttccatttctctgaaatccctttaaatcaggcttttatctgcctgactcccagaaactgctcttgtcagggtcccccatgacttccacattttaaactaaatgatcaattctcagttctcatcttatgtgcaccttattggcacaggcgtcacctcctccttctt

SEQ ID NO: 21012 - DNA, 793 bp, Homo sapiens
agcctcaggaggagcagctctgcccacatctagatgctggatccccagctgagagagtaccttcctgtcatttaagcacccccagcttgtggtgctttgttatggctgccccaggaagtaaataggagaattgtgtctgagggccagccccagcccctcgtttctgttctgggggaacacataatgatgcaagaacacgcactgcctcatagcagaggcagcctggccattgtctcggccacgacacttgttgtcatgccaggagtctgtgacacattcctgcgcctctgaccctggcacctggatgggggtttctgggctgctgggactgccaggatccccgtagggcagaggtcggtcaccctatgggtgtctgggcacaggtgagagggagaaaacaaatggtaaaatgcaggtctgagacagtcttctgagtaagatttctttggatggagaagttttatgggggagagacagggttgcaaacaactgattcaagccacgtcctttctttcccaggtgaggtcacctgtagaggtcatgctgcggagtcccgagtccctgattatattcaagacgtggagctctctttttcccgtcctgctttctttccagaagtgcctcagatgcatcctccccttctcttttctccacatgaagacgtcactgaccatcttctctggtttgctttccaacaccgagcaccaagtgcttcaaaggtcatggtgccctggggccgagagctacttatgtgggcatttataaccaaataaatattgaaatggcccacaaa

SEQ ID NO: 21013 - DNA, 618 bp, Homo sapiens
aagtagtcgagctgaaacccctgaaaacaatcgtaggacgatgacaaggttttggcagctgcaatcttaaagaccaggaagtgagggtaacagaagcaaatcatcagtgcctgtctttgaacttgatgaaactgtctcagcctcatgacctgtggtactagacagagaccacaacaccttgtctatccagagtgtgggagcactgtgtgcagttagctcctggaggcttgtcctcagtaggcttagggcatgaggagccctggaaagcccaggaccccatggagggccctggagaaacagcacctgtggctgaggggttcacaggcccagcgagatccactcaggtgaggtcacctgtagaggtcatgctgcggagtcccgagtccctgattatattcaagacgtggagctctctttttcccgtcctgctttctttccagaagtgcctcagatgcatcctccccttctcttttctccacatgaagacgtcactgaccatcttctctggtttgctttccaacaccgagcaccaagtgcttcaaaggtcatggtgccctggggccgagagctacttatgtgggcatttataaccaaataaatattgaaatggcccacaaa

SEQ ID NO: 21014 - DNA, 449 bp, Homo sapiens
tgttttcaaggaacaacagagagatggtatttccagacaagggaataaattcccggaagcaactggccaaggaatgaaaatcctggagaacagagtggaagaaacgcgtattccacatttcctgttgattttctttcctccctaaacactgacctcccgcagtcttcactagcaggtgaggtcacctgtagaggtcatgctgcggagtcccgagtccctgattatattcaagacgtggagctctctttttcccgtcctgctttctttccagaagtgcctcagatgcatcctccccttctcttttctccacatgaagacgtcactgaccatcttctctggtttgctttccaacaccgagcaccaagtgcttcaaaggtcatggtgccctggggccgagagctacttatgtgggcatttataaccaaataaatattgaaatggcccacaaa

SEQ ID NO: 21015 - DNA, 333 bp, Homo sapiens
aaaagataggcctcagctttgagcacggtcaagcaagcccttgtattcttatgtaatcacaccagaaagggctgagtctgtgtatttccccagtgggaagggtgaggtaggctttgagtttccctaggaagttgttgcgcatgttgttttggggccctggggagaagcttgaataggctttgtgatccagagagtcatcaggggagtagatggaaggaacttgtctccttgggtacgttaattgaaggaaggataagctgtaactgagatggacgcttttattttaatccccccaaatgggcactaataaccataaataaaaacaggaaaccc

SEQ ID NO: 21016 - DNA, 398 bp, Homo sapiens
tgaccaaagcaccagaggaacaaatgtatttagagtggttctgtgtgcacatggtggggggtgtatggcaagtggggagttgtcaactggcagtctttagcagtggctatatggaggcttctcatgatttccacttcagtcagaacaaaagccatagtagttccagtggactgaccttacagcactacaggatctccctgacctgacctcctaccaccttctccctcacttactcccctgcagccacaccagcctcccggctgttcctcacacatgctagcaacagtgctaccacagggcctttgcacttcatttcccctgtctagaccgctttccccagatagctgcatgaccatcccttacttccttaataccgttgcttaatgtcaccttctctc

SEQ ID NO: 21017 - DNA, 764 bp, Homo sapiens
ccaagaggcagctagctggtcaggctctcggagcaagggcagcaggtcagcccttgggctctcagccccagccacccttagaatcaccggaaagcatgtgaaatgcagatgctcaggtcccaccccagaccaagtccatcagaatcttgggagacagtgatttagcagccagatctgctctgagctacatgaggcacttgtttgttggcatcaggctgagctaggagacactcccattgctgtggggtacacccctccccaagcatctgaccttagagatctttctctaacgttatccagattccccaaataatcctcaaatgtgctacttcgaatgcatacacctagtgacgctggaggggacgagggtttccggaggccaggatagcgttcacttaatgccctgatttttttgtcccgtatctaatgggataaaatgaaaggaaagaaagtaataaagatataaaatcaaaaaattatctgggactcatggacacaagtctctccataaaaagggccagaagagaagtggaaaatagaccatactgggcacattattgtaaaacttcacaacaccagggttgagaaaatcctcaaaccatggtgcgtagagtgcggagaaaaggaatcagaatgatgttgacattctcaacagcaagtccaaaaactagaaggtcatgaagcgatgtctcagcatcctgaaggaaaactattttagtaccaatgcagtccagggggagggcagagtgagacattttccaatt

SEQ ID NO: 21018 - DNA, 763 bp, Homo sapiens
  misc_feature (508)..(508): n is a, c, g, or t
acgttggccctcttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacaataaacaaggtttccccttgaaacagggtgtcttgacccatggccgtgtccacttgctactgagtaaggggcattcctattacagaccaaggagaactggagaaaggaaacggacgaaatctcagtccgggggttgcgctttggtggcgtatcgcaatattctagacgctgtctctcaatctgtggtctactgtgttcaaccaaacacaggcagagaagggcatattcctgggaacgtgacgtggatactacagtggcctacgccgctctgggggccccaaaatgacgctnaagcagaatccgtaaacttttcagtctctctaaagaaaatgatgtctgccagtatgttgtaaaaaagcccttaaacaaagaaggtaagaaacctaggaccaaagcacccaagattcagcgccttgtcactccacatgtcctgcagcacaaacagcggcgtattgctctgaagcagccgcatattaagaaaaataaagaagaggctgcagaatatgctaaacttttggccaagagaatgaaggaggctaagaagca

SEQ ID NO: 21019 - DNA, 717 bp, Homo sapiens
acgttggccctcttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaatggaagggttatgtggtccgaatcagtggtgggaacaataaacaaggtttccccttgaaacagggtgtcttgacccatggccgtgtccacttgctactgagtaaggggcattcctattacagaccaaggagaactggagaaagaaagagaagatcagttcatggttgcatcgtggatgccaatctgagtgttctcaacttggttattgtaaaaaaaaggagagaagggtattcctggactgactgagactatgatgcctcgtcacctggggcccagtacagctagcagaatccgtaaacttttcagtctctctaaagaaaatgatgtctgccagtatgttgtaaaaaagcccttaaacaaagaaggtaagaaacctaggaccaaagcacccaagattcagcgccttgtcactccacatgtcctgcagcacaaacagcggcgtattgctctgaagcagccgcatattaagaaaaataaagaagaggctgcagaatatgctaaacttttggccaagagaatgaaggaggctaagaagca

SEQ ID NO: 21020 - DNA, 467 bp, Homo sapiens
gcaccatccaatccattgagggtttgagtagaacaacgaggccaaggaagaagtagttactttctctgccagcctgggacattggtcttctccagcccttggactagagctgataccattggtattcctgattatcaggactttgcactccaaccagaacgacgccaccagctttctggggtctccagcttgcagatggtgggacttctccacctccataattgtgtgagtcaatttcttataatctctctctgtgtgtccatatatagatatgggtattgatataaatatggaatatagataggtatatttcctatgggttctgtttctctggagaaccccaactcatacagaaggagatgacctttgtgattccagtgtagggaaagatttcttaacaagacacaagatgtacagacaatgaaaagtttcataaagtcctttctattgaaatttaaaacctgtga

SEQ ID NO: 21021 - DNA, 606 bp, Homo sapiens
agtgtgaaaggatgaatgaaaagtccggagccggagcgcgccggggccagagccgcggcagaggcagaggagggagctaggaggtgagacccgctccaccctgctcgcctaggctcggcggaggctaagagcagggcagcctcctctgcccggcgcccgctgagccccggcatctggaactcagggccctggcgctccaggggcgggaactggccgggaggaccgcgcgggagagcacggatgggcaccctgggctcgataccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21022 - DNA, 641 bp, Homo sapiens
gggctgaggcttcagaaagaaagaggcaggggtaggaggcaaggctgtgggaacggaagcggagggtgagggaggccgccatcttaggtaactggcgcctgtaagatggctgcctgaccaggtgtgcactgaaagcctaccctggttggtggacatggaacagactgaggccataagaaggacttcctggctgaccagaaatactgttgaatcttcctgttaatggaattaggaagagaggatggagagagaaggaaggagggagagaccatgaatggcggcccccagaagagataccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21023 - DNA, 646 bp, Homo sapiens
ctgcgcagaggggcccggggaaagccggcctcacgggcgggagggagaggcttgagcgaggggctagagccgcgaggactgaccagcaccagaggatacaagaggaggagagagacctcactggttcgggcgacatttcacccccccagcaccccagtcggcacagccttcatctcctcgtcctccaggcagcacaagccattgtggaatctccaccaggtgtacagaacggtgcctctgcgtcctgccactcaggacctctcaagtccccgatgtgatggctcctcagcatgatcaggaaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21024 - DNA, 770 bp, Homo sapiens
ggctgttattttggtggtggtggtggtggtagtgtctccagagaggggcagcaccccctttttgctgcctttccagggagagcagcaagagaaagaaagagagaggcaagcgaaattcctgaatggatagacagatgctacgtcatcggagctgcatcctccactccacaagaggctaggagctggggggagagaggcagtccagccgcaggggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21025 - DNA, 553 bp, Homo sapiens
ggactttcggaattcggctttagagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21026 - DNA, 1225 bp, Homo sapiens
  misc_feature (826)..(826): n is a, c, g, or t
  misc_feature (834)..(834): n is a, c, g, or t
  misc_feature (838)..(838): n is a, c, g, or t
ggctgttattttggtggtggtggtggtggtagtgtctccagagaggggcagcaccccctttttgctgcctttccagggagagcagcaagagaaagaaagagagaggcaagcgaaattcctgaatggatagacagatgctacgtcatcggagctgcatcctccactccacaagaggctaggagctggggggagagaggcagtccagccgcaggggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcacaaaaaacaacaaaaacaaaaaaaaaaaaaaaaaagaaaaaaaaaaaaaaaaaaaaanaaaaaaanaaanaaaaaaaaaaaaaaaaaaaagagagggggggcggggcgcaaaaaaaaaaccccccggggggggccccaaaggcacgcccccccatttttgaaaaagggggccccccaatggggggggcttaataaaaacaccgaggcagcgggggggggcggatctttaataacaaacaggtgtgtgagcgggagaaaaacttgtgtcgtgggggagacattgggtggagaaagaccacccaaccttggggggggggagacaataattggggaacaaactccacctatagaggtattagacccgcctcgggaaaataatacattgcaggtatgttagggtggacaaccgctattatttgcggggaaaaaatttgctagggtatatagtgaaacttcc

SEQ ID NO: 21027 - DNA, 864 bp, Homo sapiens
ctgcgcagaggggcccggggaaagccggcctcacgggcgggagggagaggcttgagcgaggggctagagccgcgaggactgaccagcaccagaggatacaagaggaggagagagacctcactggttcgggcgacatttcacccccccagcaccccagtcggcacagcttctcacctggggcgggtgggttctgcaccaccctcccaccctccttcctccgtgtggacgatagagccacatccagcaccacggacagctcccgggcgccttcatctcctcgtcctccaggcagcacaagccattgtggaatctccaccaggtgtacagaacggtgcctctgcgtcctgccactcaggacctctcaagtccccgatgtgatggctcctcagcatgatcaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21028 - DNA, 1572 bp, Homo sapiens
ggacccggtctatagactctgaccttagccctcagaatccctcattcagagcttagggatcgccaggccagaaggtggctgggaaggcaccagggagaagacagcctcccgcccccagttgagggaggtggtgaagagaggggagactgaaagcagtgggggagggtgagagaggggagccagcagagactcaagtggcctccagacttccaagtgctggccttcatctccccgcaagatgcgccccctccaactctcagccttcatcttcctactgtcactgtctccttcacaaggagagcagcaagagaaagaaagagagaggcaagcgaaattcctgaatggatagacagatgctacgtcatcggagctgcatcctccactccacaagaggctaggagctggggggagagaggcagtccagccgcaggggccacccgaacagtctctcctcctcacagaagcctggagctgggcatccaagaagaagcagcctcatttgttttctggtgtcatcgtaggtggccacctatggcttttgggctttcggcccctgattttggtctactccaattgtagaaagacctacatagtcaatgataggccaccctgcttccagttctgtgatagagaggaaaggcattggggatacagggaactctttccccttctccaatgggctcctgagggcaaagttggaggccaattgaccttgggggagatgattggttggagaagggaacagagatacttgtacctgggtgacagaggtgagaaagaagaggagcatggggtatggtaaatggggacccaaggagcttaaataactgtgagtgggtatgtatgccagggtatacaactgcaagcactgggaggtggtactgctgggagtatcagtggatttgtcattgcattggtctgagttgataagtttgagtatgtgtgcatgtgtgtgtgtgtgcgcacgcgtgtatgtgtgtgcgtgtgtgtatgtgtatgtgtgtgcatgtgtgtgtgtgcgtgtgtgtgtgtgtgatgcgcagcacccttgcatactcatgcttatgccccttaaggaggccatttgctgatggttgagggtcttgtagaaaggactcagtctggacgaaccagccaaccctctaccatctctgccaccttgttcttacctcccagacacataaggttctcaggcaagtgagcaatgtgtgggctcaagaatagaactgggagcaggcaaggaaggcagtacttacacaagcccaaggaattctcaagctggcccctcaataggaggaacataccactctctcgtggggaagaagtgtgacatccttagggacgatatcctccagattatttctccatacctcctaccttttctgcccacatgaatagatattttgtatatatatatttttttcacacagcctcagtattttttattgctaattcttgcttttatttgtgactatcccatagacaatgcagatttctatagcaaaaaatgtatgatattgttcataatgatgcacttataagacaaataaatatctgaatccaccctttccc

SEQ ID NO: 21029 - DNA, 790 bp, Homo sapiens
agtgtgaaaggatgaatgaaaagtccggagccggagcgcgccggggccagagccgcggcagaggcagaggagggagctaggaggtgagacccgctccaccctgctcgcctaggctcggcggaggctaagagcagggcagcctcctctgcccggcgcccgctgagccccggcatctggaactcagggccctggcgctccaggggcgggaactggccgggaggaccgcgcgggagagcacggatgggcaccctgggctcgatcttctcacctggggcgggtgggttctgcaccaccctcccaccctccttcctccgtgtggacgatagagccacatccagcaccacggacagctcccgggcgcactggaagctgagggtttgacagcggcaggccacataggcaaggaagctggtgcatgcagtgtctctgggcaaggttatgcaaaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21030 - DNA, 652 bp, Homo sapiens
ggataatgggtgtactatgctatgtggctactgaggaacagcctcggctcatgcccctaaagtttgaatacacacaaattaacacccccgtacgccgaggaacaagctgtgtgctcgtaggccatgatcaatcatgcccgttgcatgaatctctactctattgtgattgcatcaagccacggtggtcctgacatgaaggctgctaatcctctctattacagccactggaagctgagggtttgacagcggcaggccacataggcaaggaagctggtgcatgcagtgtctctgggcaaggttatgcaaaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21031 - DNA, 393 bp, Homo sapiens
  misc_feature (47)..(47): n is a, c, g, or t
atcgaaccgaagagtgaaagtacatccccccgtttcaggacaacagnaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21032 - DNA, 1222 bp, Homo sapiens
taagaattttcagttctattctttagatactgctacatctactatttttactggaaaccaaattgtaagctggtttctttattcatttctctcctcagcccctcattttaataccctcctattgaattctaggtccagaaagccaaaggcaattttctctcaaatatttgacccaagtgttgcattatcagccacaccctcactcttggacaaattctcctcccacccaattccaggcatggaaagggttttgttgataagttcttacagtcacaggaatcatcctagtcagcaagccgtgggagagacagaaatagaaacagcaaatttgaccaaaccaaggtccatgtttgggtgttttcatttatcaagcacacaaatctctgagcctcaattcagatatttgtataatcaggataagaaacccttaggattattgtgtgcagaaaatgaagaattctatataaaagatcgtatactatgttatgacactcatggttaaacggtaattcttagattgcagaaaggttaaaggctacagtttggaaagactgatagcatatgatttgtttcagaatgtaaaaagggcagctctctggcatgttcctgactgaggatctcataacatttaacttgaggaacttcctccttttccagctttgggagtcaaggtgagactcctggggacctaggtaggaagtatctgaagacttgggagaggaggcacagtccttgggaagcctgataaagggaagaggttggagtccgcgtggcagaatggccgttgttttctttctccttaatggatattaagacttattggtaacagcacttaggatgggtaaactgacttacatagataaatacagaatgtgtaaatgataatttcaagtttatgccattaagctcctggattctaagtaactaaaaacacagtttattaaattaaaggacaagttaggtagtggctataattaacaaatcctatagagacctgcctatcagcatgtagacttgtcttcataattgagtgactttaagaagggatgtcttctctcccttcgcctcacaaaccaacatccccccagtccccagtgcgattcctaaggttggtaacccaccagagtcacacaggcccctatgtctgaaagtctttcttgaagtctgcatgttcaaggtttgaaagttggaatctggttatttattttttcaccttccttca

SEQ ID NO: 21033 - DNA, 1088 bp, Homo sapiens
gggctgaggcttcagaaagaaagaggcaggggtaggaggcaaggctgtgggaacggaagcggagggtgagggaggccgccatcttaggtaactggcgcctgtaagatggctgcctgaccaggtgtgcactgaaagcctaccctggttggtggacatggaacagactgaggccataagaaggacttcctggctgaccagaaatactgttgaatcttcctgttaatggaattaggaagagaggatggagagagaaggaaggagggagagaccatgaatggcggcccccagaagagatgtaaggttgagcacaggagcaggggtggtagagaggcctcagcactgggcttagttcccagactacttagaggactgtgggtaataagaaaagtactggaggaatcagaatgggggaatatcagcatgaggagagagagagtaagatgtggccaggcagtatcatctgctagtttgagggtctctctggggcctgtgaaaggtgactgtgtacttgaggtgatgctccaccttctctcctcagcccagcactctggtgaaactgcatcctctcagaggccactcacagccccctcaacaaagaccactggcccttcccaagcccagtcctccttgacctgtatggaaaatgttatgccattttctcagtcttttcctttggccttctgttcttctgttacatccatgatcatctgttcttggttccattcattcagtcctccggatggaccagttccttaactagaagtggtccccaggttctgctggtagcttgttttctcttccttctcactcttctcactccacttttatcactttaaccatcacctgaagttataaattctcctgtgtttcatttttcttttcttttctcttctctttctttctctctctctctctttcttctttcttttttttttttttttttttttgagagtcttgctctctcacccaggctggagtgcagtggcgcaatctcagctcactgcaacctctgccgcccgggttcaagcaattcttctgcctcagcctcctgagtagctgggactacaggcacccgccaccacgcccag

SEQ ID NO: 21034 - DNA, 1031 bp, Homo sapiens
ggcctcaggctttaaccaggtctgggcaggaaggagagagaagctgaaaccaggccggggtctcacagtgaggccgttcatggtctggtccagctgtccccaggatgggctcctctccatcatccaaccagagacccagggccccagcaccaaggccctgacctgcccctgccttctccccatgtcttcccagctataactcctgatcctgccaggcctctccagccttccatcccctgctcatacatgctgtctcctgacactcttggaactgaccctgctcttgggactgaccctgcttgagcttctctcatcttcccagcatggggtctccttccatctcctgcacagtgctcctgctccagggagggctgtgttgagagggtagagacacaagattgaccagaactaaaaaggagtcccaaggccaccccagtctccacacccactcttgccttccccaggagaggctcctctcctggcctggcctcagtgtcacttactgctaatcatcgatgtgtagagacctttctcccatctccccaccaccaagcccttgttgagcacactgcacactggctttttatttttattttttggagacggagtcttgctctgtcacccaggctggagtgcagtggcgcgatctcagctcactgcaacctctgcctcccaggttcaagagattctcctgcctcagcctccagagtagctgggattacaggtgcctgccaccatgcccggctaatttttgtgattttagtagagacagggttttgccatgttggccaggctggtctcgaactcctgacctcaagtgatctgcccaccttggcctcccaaagtgctgggattacaggtgtgagccactgtgcgtggactgcgctggcccttctagtgaatgtttgggttcagggtacacgaagcagcagaatgctggcggacaccacctcagcttgcaggctgctctgggtttgatagtcagtggggctttgtccacaggaaggacaggaaaagaaggagcttttggt

SEQ ID NO: 21035 - DNA, 770 bp, Homo sapiens
ctgcgcagaggggcccggggaaagccggcctcacgggcgggagggagaggcttgagcgaggggctagagccgcgaggactgaccagcaccagaggatacaagaggaggagagagacctcactggttcgggcgacatttcacccccccagcaccccagtcggcacaggtaggagtcacagtcccatttcacttcagccaggtgccatatttttcccccagcagagttgagggggagcaaggaagcctcattgtggtgccctctggtggtccccgctcaggatggggccttttctggcagtctgggtcactgcttgggaagctgatctaagggagaaatcagttgaaatctagctgcagggttattccgcctcccggcccaggcctctccctccagcgggagctggtgaacactttcccacaggctgtccacagctatggctgggtgggggagtttggaggaagtcacctgagaacactggtctttgcttaagtcggctccttaaagccatgtagggctatccagcttggttggaagatgagggtgtctacgtgaaaataggaaatagaattgaaggtgccaagggtgggagggttgctcaaaaatgtaaacagggtggcagaagaaccttttgcccagtctgggttctggggcagtggagtgcagggcaatctcggttccatttccattcacattcctccttccgacccaggacctgaggccaatctctttaaaagatccttatgctgctttgtcattactgaccagaggg

SEQ ID NO: 21036 - DNA, 779 bp, Homo sapiens
atgttggccagtatggtcttgatctcttgatctcttgatctgcccgcctcggcctcccaaaatgctgggtttacaggcatgagccaccctggccggcctaacccaacccagtgctttttctactgaacttgcctgtgggaacaactggagagacagtgaaacagggagggtaagatggggttgagctgagaaaggaaggcatggggcacgggagggggagggtgcaccaagagaaaagccctgcctgtgagcaggggctgggagctgggatgagagaagaagcaccaagaaagataggattcctttaaaaacaaaaaaacaacaataacgaaagcctttcatgtagcttgttggaaatgtgtatttgggatccactgaggctcattcacatgagacttagaacctgtatcagtaaccacaatgggtttacattattattgttgtctcctattagtgcatttgacctacctcaggatatccaaaggagaacagagggaagtgaggggttgagaactgacaccctacaacgccagcacctcagtggaaaggaggaatagagcccaggagggatgtgggggtgagggtttgtgtctgccttatgtgagcatatggtgtgtgcatgtgggtgtgtgggtggggttgtcaggagagtgatgggtgactgtgtttgtgagctgtgtgtgtctgctttatgagggtgagaaactgagtggtgtgtgacctggtgtgaggttggatgtatgtgcttccatggtgtgtgggaagctcggtcgtgatat

SEQ ID NO: 21037 - DNA, 889 bp, Homo sapiens
ggacccggtctatagactctgaccttagccctcagaatccctcattcagagcttagggatcgccaggccagaaggtggctgggaaggcaccagggagaagacagcctcccgcccccagttgagggaggtggtgaagagaggggagactgaaagcagtgggggagggtgagagaggggagccagcagagactcaagtggcctccagacttccaagtgctggccttcatctccccgcaagatgcgccccctccaactctcagccttcatcttcctactgtcactgtctccttcacaaggagagcagcaagagaaagaaagagagaggcaagcgaaattcctgaatggatagacagatgctacgtcatcggagctgcatcctccactccacaagaggctaggagctggggggagagaggcagtccagccgcaggggccacccgaacagtctctcctcctcacagaagcctggagctgggcatccaagaagaagcagcctcatttgttttctggtgtcatcgtaggtggccacctatggcttttgggaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21038 - DNA, 901 bp, Homo sapiens
ggactttcggaattcggctttagagaagcctggagctgggcatccaagaagaagcagcctcatttgttttctggtgtcatcgtaggtggccacctatggcttttgggaatgtaaaaagggcagctctctggcatgttcctgactgaggatctcataacatttaacttgaggaacttcctccttttccagctttgggagtcaagcttctcacctggggcgggtgggttctgcaccaccctcccaccctccttcctccgtgtggacgatagagccacatccagcaccacggacagctcccgggcgccttcatctcctcgtcctccaggcagcacaagccattgtggaatctccaccaggtgtacagaacggtgcctctgcgtcctgccactcaggacctctcaagtccccgatgtgatggctcctcagcatgatcaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21039 - DNA, 2817 bp, Homo sapiens
aggaatgccacctagctttagttacttcataaaggttcctggactccagctattagaataggaaaactgagacttgtctagcttggtgagaggtctgagtgccccttaaagacttgggagcccccacccaaaccttttgtttacagaagaggagtaaatgccacagaatgctttgaaattccccctctgtgccccatcagcaccccagaaagaggagccggagaccatggaatagcaatagtctctcaggccctctgggctccccctttggaagccagtctcccagctcctgccctggggggaacgttccaacagggtctcagagacatcctgggataatgagggtcccctccttctggagcccaactggaaggcagagaatggtcactttgacctcgaggggcatctataaggggcactaagcagaggccagatttgctgaggaaatcctgaatgaggagcaggtggagagaaaaaggaggccattctcaactgaggaagggtgggctgggagggaggggccagggataatttatgatatcattgctcccccgccgcacttacttcccagccctctgctactgtaccgttgctaggagagcctggctctgtctggggctgggagggtgtaacaagcgggaggctgttccatctgcactcctcctcccccacccaggggagggcaccgcatggagctgcatccaccaccccttcccaggccctgacagacaccagtctcttctgtcgttcccccaaatctagccactcaagggatagcaggactcccagttgggctgaggatctagagcaaggaatgggcaagagagcatggaaggagacacactggcagacttagaggggcactgaggaacagacagcccaccttgagtcctggcagccagcccgggtcaggaagagggccagagggggtcagggaaacaggcctggcagagatcaggtttggagaagacagggtcgttacatttgaggggctcctgatatgatgggcaaggcagacttctcatccccactcctccatactgtcaagatccaggttggagagctggcaaaggtagggggaggaggagctggggaagggaggagggatgtgagctgggagaggctgcgaagagtctaggaagaagaaaggccacactcgtctgagtggagctgggccatgcagggccgtggccgagatcccctcctctttctgaaactcttctcagatcttaaggctcttggagaagtcaagggaggtgaactttgggggtttccaaagcggctggctcccaaccctggatgggacaggaaaggaaggctgtgcccacagctgtgcctgacacctgattcctgtgcagcccctactgggtttatttgcctttcctggacatagcttccccagcccaggaaggaaggagctgaccctgatttgtgcccatttggttgtgtaagccctttcatagccattatctcagctaatcttcccaacagccctgaaaaccgggtgatattgtccccactttatgaaggaggaatcaaagcctcaggaaggctaagacactttcccagagtcacaggactggtaaattgggctgggcttcaagtgggtcttcgtagaccccaaagcatatgtccccttcctcccctgtgctgacttctgaaacacaaatggagggaccgagagaagagaggaccagataggcaggtggaattcttggcatgttctccagtgtaggggtaaagtctgagggatgataaacatcttgcaggttgaagacaggattggggaagaggccatgggagctgtggaagcgaccaaagtcttccaggctggtccttagcccaagtgcatcctgcaccctgccttcctgaagcaagtcccctgggctctctgcctaatctctcccgttcttgggatctgagtttacgccttaggcatttccctcaccccccattgccttggatggagcacctggaagaggtggaagaggtgcctagactcaagccactgtcatggtggatccctttgtgatgaccccttccctagctcctcaccttgcctgatggaagtgagctccttccaagatggctggaagtttgtcctctgcctcctcctaaagtctccatccgaagtgtattttttggctggacgtggtggctcacgcctgtaattccaacactctgggaggccgaggcaggtggatcacttgaggtcaggagttcgagaccagcctggccaacatggcgaaaccccgtgtcttctaaaaatacaaaatttagccaggtgtgatggcatgcgcctgtgatcccagctactcagaggctgaggtacgagaattgcttgaacctaggaggcagaggttgcagtgagccgagatcatgccactgcactccagcctgggtgacagagtgagattccatctcaaaaaaaagaagtatttttctttacgcttgacaatttttcttttcagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21040 - DNA, 1119 bp, Homo sapiens
atgttggccagtatggtcttgatctcttgatctcttgatctgcccgcctcggcctcccaaaatgctgggtttacaggcatgagccaccctggccggcctaacccaacccagtgctttttctactgaacttgcctgtgggaacaactggagagacagtgaaacagggagggtaagatggggttgagctgagaaaggaaggcatggggcacgggagggggagggtgcaccaagagaaaagccctgcctgtgagcaggggctgggagctgggatgagagaagaagcaccaagaaagataggattcctttaaaaacaaaaaaacaacaataacgaaagcctttcatgtagcttgttggaaatgtgtatttgggatccactgaggctcattcacatgagacttagaacctgtatcagtaaccacaatgggtttacattattattgttgtctcctattagtgcatttgacctacctcaggatatccaaaggagaacagagggaagtgaggggttgagaactgacaccctacaacgccagcacctcagtggaaaggaggaatagagcccaggagggatgtggggaatgtaaaaagggcagctctctggcatgttcctgactgaggatctcataacatttaacttgaggaacttcctccttttccagctttgggagtcaagcttctcacctggggcgggtgggttctgcaccaccctcccaccctccttcctccgtgtggacgatagagccacatccagcaccacggacagctcccgggcgaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21041 - DNA, 1141 bp, Homo sapiens
ttggcgaggggctatattgggataggcaggtggaattcttggcatgttctccagtgtaggggtaaagtctgagggatgataaacatcttgcaggttgaagacaggattggggaagaggccatgggagctgtggaagcgaccaaagtcttccaggctggtccttagcccaagtgcatcctgcaccctgccttcctgaagcaagtcccctgggctctctgcctaatctctcccgttcttgggatctgagtttacgccttaggcatttccctcaccccccattgccttggatggagcacctggaagaggtggaagaggtgcctagactcaagccactgtcatggtggatccctttgtgatgaccccttccctagctcctcaccttgcctgatggaagtgagctccttccaagatggctggaagtttgtcctctgcctcctcctaaagtctccatccgaagtgtattttttggctggacgtggtggctcacgcctgtaattccaacactctgggaggccgaggcaggtggatcacttgaggtcaggagttcgagaccagcctggccaacatggcgaaaccccgtgtcttctaaaaatacaaaatttagccaggtgtgatggcatgcgcctgtgatcccagctactcagaggctgaggtacgagaattgcttgaacctaggaggcagaggttgcagtgagccgagatcatgccactgcactccagcctgggtgacagagtgagattccatctcaaaaaaaagaagtatttttctttacgcttgacaatttttcttttcagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21042 - DNA, 776 bp, Homo sapiens
aggcctcctgggttgtgagggccatggatcaccgggtgcagtccataacggaggcctgactgagaaatggggctgggctccatggctggggcttttgtggtctgaaggaggtgagcatcttgctgaggctgtttcgagagggacccgttgttaacaattaggtggtgaactccacaacggcagcctcttttatccactggccaggtgtgaatgccacccaacataccaggaggaggggacaggtagggtgcagctctgccacattgcccctaacctgccctgctccctccctgcagccttcatctcctcgtcctccaggcagcacaagccattgtggaatctccaccaggtgtacagaacggtgcctctgcgtcctgccactcaggacctctcaagtccccgatgtgatggctcctcagcatgatcaggaaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21043 - DNA, 2132 bp, Homo sapiens
ggacccggtctatagactctgaccttagccctcagaatccctcattcagagcttagggatcgccaggccagaaggtggctgggaaggcaccagggagaagacagcctcccgcccccagttgagggaggtggtgaagagaggggagactgaaagcagtgggggagggtgagagaggggagccagcagagactcaagtggcctccagacttccaagtgctggccttcatctccccgcaagatgcgccccctccaactctcagccttcatcttcctactgtcactgtctccttcacaaggagagcagcaagagaaagaaagagagaggcaagcgaaattcctgaatggatagacagatgctacgtcatcggagctgcatcctccactccacaagaggctaggagctggggggagagaggcagtccagccgcaggggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgatcccatgggagtagaagaggtgtgagcaggttgcccagctggttagcggaaatgccaagatccaggctcctgaatttcagcctggccctttctatctgtctgatacctcctttacgagtctctctgcctgcgttgtgtggagcgggcctgctgctggttgggggagtttgcaggttgcccctatgcaaaaaaggacaggatgcatgactggcatgtaaggtgttcaggaaaaccaggaaaagccttcatctcctcgtcctccaggcagcacaagccattgtggaatctccaccaggtgtacagaacggtgcctctgcgtcctgccactcaggacctctcaagtccccgatgtgatggctcctcagcatgatcaggagtgagcgtaattcagacctatttagatccgtcagcccacggaccagggggaccttgagcaggacagtcttttgtctccaagcagtcattccctgttatacaagcaagagtcaggaggaggaatggttttggcatcatcccccacagacagcaatggggcctttaggcctggaaggaaggacccaggctgcggctggcatatggaggttgagccctgggcacggggcatcagcttcacccggctggggatgccttctgctgggtttgtccatctggcaccagctggcttcccagcaccgcccccacaaccaaccagactcctccttctgctgttgccatggcaattggctgccatattgtacctcagagcactagctcctatctggattttcccgcggggttcctagagggtgggagatgggtctccagggatttatccctttcccctgatatctatccaataaaaattcataataacatatgattttttaatagcctaagtggaggattactatgtgtcaggctctgtgccagacactctctacatgttatttaatgtggctaagaacagaattaatgagatagaattcaagaggttcccatccagtttcctgctactacgacagacttttcctctctccaaccaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21044 - DNA, 2068 bp, Homo sapiens
agtgtgaaaggatgaatgaaaagtccggagccggagcgcgccggggccagagccgcggcagaggcagaggagggagctaggaggtgagacccgctccaccctgctcgcctaggctcggcggaggctaagagcagggcagcctcctctgcccggcgcccgctgagccccggcatctggaactcagggccctggcgctccaggggcgggaactggccgggaggaccgcgcgggagagcacggatgggcaccctgggctcgattgcatttgacctacctcaggatatccaaaggagaacagagggaagtgaggggttgagaactgacaccctacaacgccagcacctcagtggaaaggaggaatagagcccaggagggatgtggggaatgtaaaaagggcagctctctggcatgttcctgactgaggatctcataacatttaacttgaggaacttcctccttttccagctttgggagtcaagcttctcacctggggcgggtgggttctgcaccaccctcccaccctccttcctccgtgtggacgatagagccacatccagcaccacggacagctcccgggcgatcccatgggagtagaagaggtgtgagcaggttgcccagctggttagcggaaatgccaagatccaggctcctgaatttcagcctggccctttctatctgtctgatacctcctttacgagtctctctgcctgcgttgtgtggagcgggcctgctgctggttgggggagtttgcaggttgcccctatgcaaaaaaggacaggatgcatgactggcatgtaaggtgttcaggaaaaccaggaaaagccttcatctcctcgtcctccaggcagcacaagccattgtggaatctccaccaggtgtacagaacggtgcctctgcgtcctgccactcaggacctctcaagtccccgatgtgatggctcctcagcatgatcaggagtgagcgtaattcagacctatttagatccgtcagcccacggaccagggggaccttgagcaggacagtcttttgtctccaagcagtcattccctgttatacaagcaagagtcaggaggaggaatggttttggcatcatcccccacagacagcaatggggcctttaggcctggaaggaaggacccaggctgcggctggcatatggaggttgagccctgggcacggggcatcagcttcacccggctggggatgccttctgctgggtttgtccatctggcaccagctggcttcccagcaccgcccccacaaccaaccagactcctccttctgctgttgccatggcaattggctgccatattgtacctcagagcactagctcctatctggattttcccgcggggttcctagagggtgggagatgggtctccagggatttatccctttcccctgatatctatccaataaaaattcataataacatatgattttttaatagcctaagtggaggattactatgtgtcaggctctgtgccagacactctctacatgttatttaatgtggctaagaacagaattaatgagatagaattcaagaggttcccatccagtttcctgctactacgacagacttttcctctctccaaccaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21045 - DNA, 2019 bp, Homo sapiens
atgttggccagtatggtcttgatctcttgatctcttgatctgcccgcctcggcctcccaaaatgctgggtttacaggcatgagccaccctggccggcctaacccaacccagtgctttttctactgaacttgcctgtgggaacaactggagagacagtgaaacagggagggtaagatggggttgagctgagaaaggaaggcatggggcacgggagggggagggtgcaccaagagaaaagccctgcctgtgagcaggggctgggagctgggatgagagaagaagcaccaagaaagataggattcctttaaaaacaaaaaaacaacaataacgaaagcctttcatgtagcttgttggaaatgtgtatttgggatccactgaggctcattcacatgagacttagaacctgtatcagtaaccacaatgggtttacattattattgttgtctcctattagtgcatttgacctacctcaggatatccaaaggagaacagagggaagtgaggggttgagaactgacaccctacaacgccagcacctcagtggaaaggaggaatagagcccaggagggatgtggggaatgtaaaaagggcagctctctggcatgttcctgactgaggatctcataacatttaacttgaggaacttcctccttttccagctttgggagtcaagcttctcacctggggcgggtgggttctgcaccaccctcccaccctccttcctccgtgtggacgatagagccacatccagcaccacggacagctcccgggcgccttcatctcctcgtcctccaggcagcacaagccattgtggaatctccaccaggtgtacagaacggtgcctctgcgtcctgccactcaggacctctcaagtccccgatgtgatggctcctcagcatgatcaggagtgagcgtaattcagacctatttagatccgtcagcccacggaccagggggaccttgagcaggacagtcttttgtctccaagcagtcattccctgttatacaagcaagagtcaggaggaggaatggttttggcatcatcccccacagacagcaatggggcctttaggcctggaaggaaggacccaggctgcggctggcatatggaggttgagccctgggcacggggcatcagcttcacccggctggggatgccttctgctgggtttgtccatctggcaccagctggcttcccagcaccgcccccacaaccaaccagactcctccttctgctgttgccatggcaattggctgccatattgtacctcagagcactagctcctatctggattttcccgcggggttcctagagggtgggagatgggtctccagggatttatccctttcccctgatatctatccaataaaaattcataataacatatgattttttaatagcctaagtggaggattactatgtgtcaggctctgtgccagacactctctacatgttatttaatgtggctaagaacagaattaatgagatagaattcaagaggttcccatccagtttcctgctactacgacagacttttcctctctccaaccaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21046 - DNA, 2104 bp, Homo sapiens
ggacccggtctatagactctgaccttagccctcagaatccctcattcagagcttagggatcgccaggccagaaggtggctgggaaggcaccagggagaagacagcctcccgcccccagttgagggaggtggtgaagagaggggagactgaaagcagtgggggagggtgagagaggggagccagcagagactcaagtggcctccagacttccaagtgctggccttcatctccccgcaagatgcgccccctccaactctcagccttcatcttcctactgtcactgtctccttcacaaggagagcagcaagagaaagaaagagagaggcaagcgaaattcctgaatggatagacagatgctacgtcatcggagctgcatcctccactccacaagaggctaggagctggggggagagaggcagtccagccgcaggggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgatcccatgggagtagaagaggtgtgagcaggttgcccagctggttagcggaaatgccaagatccaggctcctgaatttcagcctggccctttctatctgtctgatacctcctttacgagtctctctgcctgcgttgtgtggagcgggcctgctgctggttgggggagtttgcaggttgcccctatgcaaaaaaggacaggatgcatgactggcatccttcatctcctcgtcctccaggcagcacaagccattgtggaatctccaccaggtgtacagaacggtgcctctgcgtcctgccactcaggacctctcaagtccccgatgtgatggctcctcagcatgatcaggagtgagcgtaattcagacctatttagatccgtcagcccacggaccagggggaccttgagcaggacagtcttttgtctccaagcagtcattccctgttatacaagcaagagtcaggaggaggaatggttttggcatcatcccccacagacagcaatggggcctttaggcctggaaggaaggacccaggctgcggctggcatatggaggttgagccctgggcacggggcatcagcttcacccggctggggatgccttctgctgggtttgtccatctggcaccagctggcttcccagcaccgcccccacaaccaaccagactcctccttctgctgttgccatggcaattggctgccatattgtacctcagagcactagctcctatctggattttcccgcggggttcctagagggtgggagatgggtctccagggatttatccctttcccctgatatctatccaataaaaattcataataacatatgattttttaatagcctaagtggaggattactatgtgtcaggctctgtgccagacactctctacatgttatttaatgtggctaagaacagaattaatgagatagaattcaagaggttcccatccagtttcctgctactacgacagacttttcctctctccaaccaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21047 - DNA, 829 bp, Homo sapiens
  misc_feature (49)..(49): n is a, c, g, or t
gggctctggcttctctccgcgttgcgtgccgctcctcccgcagctgtgnccgctccttgtctcctcctcattgtcactgccaaacaggtcaatgtcatcatcctcgtcatcctctgctggtggggctgggctccatggctggggcttttgtggtctgaaggaggtgagcatcttgctgaggctgtttcgagagggacccgttgttaacaattaggtggtgaactccacaacggcagcctcttttatccactggccaggtgtgaatgccacccaacataccaggaggaggggacaggtagggtgcagctctgccacattgcccctaacctgccctgctccctccctgcagccttcatctcctcgtcctccaggcagcacaagccattgtggaatctccaccaggtgtacagaacggtgcctctgcgtcctgccactcaggacctctcaagtccccgatgtgatggctcctcagcatgatcaggaaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21048 - DNA, 1123 bp, Homo sapiens
ggacccggtctatagactctgaccttagccctcagaatccctcattcagagcttagggatcgccaggccagaaggtggctgggaaggcaccagggagaagacagcctcccgcccccagttgagggaggtggtgaagagaggggagactgaaagcagtgggggagggtgagagaggggagccagcagagactcaagtggcctccagacttccaagtgctggccttcatctccccgcaagatgcgccccctccaactctcagccttcatcttcctactgtcactgtctccttcacaaggagagcagcaagagaaagaaagagagaggcaagcgaaattcctgaatggatagacagatgctacgtcatcggagctgcatcctccactccacaagaggctaggagctggggggagagaggcagtccagccgcaggggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgccttcatctcctcgtcctccaggcagcacaagccattgtggaatctccaccaggtgtacagaacggtgcctctgcgtcctgccactcaggacctctcaagtccccgatgtgatggctcctcagcatgatcaggaaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21049 - DNA, 1017 bp, Homo sapiens
ggcctcaggctttaaccaggtctgggcaggaaggagagagaagctgaaaccaggccggggtctcacagtgaggccgttcatggtctggtccagctgtccccaggatgggctcctctccatcatccaaccagagacccagggccccagcaccaaggccctgacctgcccctgccttctccccatgtcttcccagctataactcctgatcctgccaggcctctccagccttccatcccctgctcatacatgctgtctcctgacactcttggaactgaccctgctcttgggactgaccctgcttgagcttctctcatcttcccagcatggggtctccttccatctcctgcacagtgctcctgctccagggagggctgtgttgagagggtagagacacaagattgaccagaactaaaaaggagtcccaaggccaccccagtctccacacccactcttgccttccccaggagaggctcctctcctggcctggcctcagtgtcacttactgctaatcatcgatgtgtagagacctttctcccatctccccaccaccaagcccttgttgagcacactgcacactggctttttatttttattttcctgggtgacagagtgagattccatctcaaaaaaaagaagtatttttctttacgcttgacaatttttcttttcagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21050 - DNA, 1455 bp, Homo sapiens
atgttggccagtatggtcttgatctcttgatctcttgatctgcccgcctcggcctcccaaaatgctgggtttacaggcatgagccaccctggccggcctaacccaacccagtgctttttctactgaacttgcctgtgggaacaactggagagacagtgaaacagggagggtaagatggggttgagctgagaaaggaaggcatggggcacgggagggggagggtgcaccaagagaaaagccctgcctgtgagcaggggctgggagctgggatgagagaagaagcaccaagaaagataggattcctttaaaaacaaaaaaacaacaataacgaaagcctttcatgtagcttgttggaaatgtgtatttgggatccactgaggctcattcacatgagacttagaacctgtatcagtaaccacaatgggtttacattattattgttgtctcctattagtgcatttgacctacctcaggatatccaaaggagaacagagggaagtgaggggttgagaactgacaccctacaacgccagcacctcagtggaaaggaggaatagagcccaggagggatgtggggaatgtaaaaagggcagctctctggcatgttcctgactgaggatctcataacatttaacttgaggaacttcctccttttccagctttgggagtcaagcttctcacctggggcgggtgggttctgcaccaccctcccaccctccttcctccgtgtggacgatagagccacatccagcaccacggacagctcccgggcgcactggaagctgagggtttgacagcggcaggccacataggcaaggaagctggtgcatgcagtgtctctgggcaaggttatgcaaccttcatctcctcgtcctccaggcagcacaagccattgtggaatctccaccaggtgtacagaacggtgcctctgcgtcctgccactcaggacctctcaagtccccgatgtgatggctcctcagcatgatcaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21051 - DNA, 1412 bp, Homo sapiens
ctgcgcagaggggcccggggaaagccggcctcacgggcgggagggagaggcttgagcgaggggctagagccgcgaggactgaccagcaccagaggatacaagaggaggagagagacctcactggttcgggcgacatttcacccccccagcaccccagtcggcacagccttcatctcctcgtcctccaggcagcacaagccattgtggaatctccaccaggtgtacagaacggtgcctctgcgtcctgccactcaggacctctcaagtccccgatgtgatggctcctcagcatgatcaggagtgagcgtaattcagacctatttagatccgtcagcccacggaccagggggaccttgagcaggacagtcttttgtctccaagcagtcattccctgttatacaagcaagagtcaggaggaggaatggttttggcatcatcccccacagacagcaatggggcctttaggcctggaaggaaggacccaggctgcggctggcatatggaggttgagccctgggcacggggcatcagcttcacccggctggggatgccttctgctgggtttgtccatctggcaccagctggcttcccagcaccgcccccacaaccaaccagactcctccttctgctgttgccatggcaattggctgccatattgtacctcagagcactagctcctatctggattttcccgcggggttcctagagggtgggagatgggtctccagggatttatccctttcccctgatatctatccaataaaaattcataataacatatgattttttaatagcctaagtggaggattactatgtgtcaggctctgtgccagacactctctacatgttatttaatgtggctaagaacagaattaatgagatagaattcaagaggttcccatccagtttcctgctactacgacagacttttcctctctccaaccaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21052 - DNA, 1324 bp, Homo sapiens
agtgtgaaaggatgaatgaaaagtccggagccggagcgcgccggggccagagccgcggcagaggcagaggagggagctaggaggtgagacccgctccaccctgctcgcctaggctcggcggaggctaagagcagggcagcctcctctgcccggcgcccgctgagccccggcatctggaactcagggccctggcgctccaggggcgggaactggccgggaggaccgcgcgggagagcacggatgggcaccctgggctcgattgcatttgacctacctcaggatatccaaaggagaacagagggaagtgaggggttgagaactgacaccctacaacgccagcacctcagtggaaaggaggaatagagcccaggagggatgtggggcttctcacctggggcgggtgggttctgcaccaccctcccaccctccttcctccgtgtggacgatagagccacatccagcaccacggacagctcccgggcgatcccatgggagtagaagaggtgtgagcaggttgcccagctggttagcggaaatgccaagatccaggctcctgaatttcagcctggccctttctatctgtctgatacctcctttacgagtctctctgcctgcgttgtgtggagcgggcctgctgctggttgggggagtttgcaggttgcccctatgcaaaaaaggacaggatgcatgactggcatgtaaggtgttcaggaaaaccaggaaaagccttcatctcctcgtcctccaggcagcacaagccattgtggaatctccaccaggtgtacagaacggtgcctctgcgtcctgccactcaggacctctcaagtccccgatgtgatggctcctcagcatgatcaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21053 - DNA, 1241 bp, Homo sapiens
ggacccggtctatagactctgaccttagccctcagaatccctcattcagagcttagggatcgccaggccagaaggtggctgggaaggcaccagggagaagacagcctcccgcccccagttgagggaggtggtgaagagaggggagactgaaagcagtgggggagggtgagagaggggagccagcagagactcaagtggcctccagacttccaagtgctggccttcatctccccgcaagatgcgccccctccaactctcagccttcatcttcctactgtcactgtctccttcacaaggagagcagcaagagaaagaaagagagaggcaagcgaaattcctgaatggatagacagatgctacgtcatcggagctgcatcctccactccacaagaggctaggagctggggggagagaggcagtccagccgcaggggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgccttcatctcctcgtcctccaggcagcacaagccattgtggaatctccaccaggtgtacagaacggtgcctctgcgtcctgccactcaggacctctcaagtccccgatgtgatggctcctcagcatgatcaggagaaattccatgatcttgcttattcctgtcttgggaagtccttctccatgtctaaccaagatctatatggctatagcaccagctctttggctcttggcttggcatggctaagttgggagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21054 - DNA, 1329 bp, Homo sapiens
ggacccggtctatagactctgaccttagccctcagaatccctcattcagagcttagggatcgccaggccagaaggtggctgggaaggcaccagggagaagacagcctcccgcccccagttgagggaggtggtgaagagaggggagactgaaagcagtgggggagggtgagagaggggagccagcagagactcaagtggcctccagacttccaagtgctggccttcatctccccgcaagatgcgccccctccaactctcagccttcatcttcctactgtcactgtctccttcacaaggagagcagcaagagaaagaaagagagaggcaagcgaaattcctgaatggatagacagatgctacgtcatcggagctgcatcctccactccacaagaggctaggagctggggggagagaggcagtccagccgcaggggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgatcccatgggagtagaagaggtgtgagcaggttgcccagctggttagcggaaatgccaagatccaggctcctgaatttcagcctggccctttctatctgtctgatacctcctttacgagtctctctgcctgcgttgtgtggagcgggcctgctgctggttgggggagtttgcaggttgcccctatgcaaaaaaggacaggatgcatgactggcatgtaaggtgttcaggaaaaccaggaaaaggtggaacagactgctacctctgtctgaagtggtttggagggaaggcctcagggacagggcatacctagcagtagctggcaagcccatgggagaaaagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21055 - DNA, 1232 bp, Homo sapiens
ggacccggtctatagactctgaccttagccctcagaatccctcattcagagcttagggatcgccaggccagaaggtggctgggaaggcaccagggagaagacagcctcccgcccccagttgagggaggtggtgaagagaggggagactgaaagcagtgggggagggtgagagaggggagccagcagagactcaagtggcctccagacttccaagtgctggccttcatctccccgcaagatgcgccccctccaactctcagccttcatcttcctactgtcactgtctccttcacaaggagagcagcaagagaaagaaagagagaggcaagcgaaattcctgaatggatagacagatgctacgtcatcggagctgcatcctccactccacaagaggctaggagctggggggagagaggcagtccagccgcaggggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgatcccatgggagtagaagaggtgtgagcaggttgcccagctggttagcggaaatgccaagatccaggctcctgaatttcagcctggccctttctatctgtctgatacctcctttacgagtctctctgcctgcgttgtgtggagcgggcctgctgctggttgggggagtttgcaggttgcccctatgcaaaaaaggacaggatgcatgactggcatgtaaggtgttcaggaaaaccaggaaaagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21056 - DNA, 2833 bp, Homo sapiens
aggaatgccacctagctttagttacttcataaaggttcctggactccagctattagaataggaaaactgagacttgtctagcttggtgagaggtctgagtgccccttaaagacttgggagcccccacccaaaccttttgtttacagaagaggagtaaatgccacagaatgctttgaaattccccctctgtgccccatcagcaccccagaaagaggagccggagaccatggaatagcaatagtctctcaggccctctgggctccccctttggaagccagtctcccagctcctgccctggggggaacgttccaacagggtctcagagacatcctgggataatgagggtcccctccttctggagcccaactggaaggcagagaatggtcactttgacctcgaggggcatctataaggggcactaagcagaggccagatttgctgaggaaatcctgaatgaggagcaggtggagagaaaaaggaggccattctcaactgaggaagggtgggctgggagggaggggccagggataatttatgatatcattgctcccccgccgcacttacttcccagccctctgctactgtaccgttgctaggagagcctggctctgtctggggctgggagggtgtaacaagcgggaggctgttccatctgcactcctcctcccccacccaggggagggcaccgcatggagctgcatccaccaccccttcccaggccctgacagacaccagtctcttctgtcgttcccccaaatctagccactcaagggatagcaggactcccagttgggctgaggatctagagcaaggaatgggcaagagagcatggaaggagacacactggcagacttagaggggcactgaggaacagacagcccaccttgagtcctggcagccagcccgggtcaggaagagggccagagggggtcagggaaacaggcctggcagagatcaggtttggagaagacagggtcgttacatttgaggggctcctgatatgatgggcaaggcagacttctcatccccactcctccatactgtcaagatccaggttggagagctggcaaaggtagggggaggaggagctggggaagggaggagggatgtgagctgggagaggctgcgaagagtctaggaagaagaaaggccacactcgtctgagtggagctgggccatgcagggccgtggccgagatcccctcctctttctgaaactcttctcagatcttaaggctcttggagaagtcaagggaggtgaactttgggggtttccaaagcggctggctcccaaccctggatgggacaggaaaggaaggctgtgcccacagctgtgcctgacacctgattcctgtgcagcccctactgggtttatttgcctttcctggacatagcttccccagcccaggaaggaaggagctgaccctgatttgtgcccatttggttgtgtaagccctttcatagccattatctcagctaatcttcccaacagccctgaaaaccgggtgatattgtccccactttatgaaggaggaatcaaagcctcaggaaggctaagacactttcccagagtcacaggactggtaaattgggctgggcttcaagtgggtcttcgtagaccccaaagcatatgtccccttcctcccctgtgctgacttctgaaacacaaatggagggaccgagagaagagaggaccagataggcaggtggaattcttggcatgttctccagtgtaggggtaaagtctgagggatgataaacatcttgcaggttgaagacaggattggggaagaggccatgggagctgtggaagcgaccaaagtcttccaggctggtccttagcccaagtgcatcctgcaccctgccttcctgaagcaagtcccctgggctctctgcctaatctctcccgttcttgggatctgagtttacgccttaggcatttccctcaccccccattgccttggatggagcacctggaagaggtggaagaggtgcctagactcaagccactgtcatggtggatccctttgtgatgaccccttccctagctcctcaccttgcctgatggaagtgagctccttccaagatggctggaagtttgtcctctgcctcctcctaaagtctccatccgaagtgtattttttggctggacgtggtggctcacgcctgtaattccaacactctgggaggccgaggcaggtggatcacttgaggtcaggagttcgagaccagcctggccaacatggcgaaaccccgtgtcttctaaaaatacaaaatttagccaggtgtgatggcatgcgcctgtgatcccagctactcagaggctgaggtacgagaattgcttgaacctaggaggcagaggttgcagtgagccgagatcatgccactgcactccagcctgggtgacagagtgagattccatctcaaaaaaaagaagtatttttctttacgcttgacaatttttcttttcagaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagttctctccctggcatatcctttttgcctatcacctaaccaaatcttaagtttagtacaaggatgtaactcagtataatgtctctgccatgcaaatactctaactcatcctcacttctagactgaaaccacctgccctccttgttcgccaaccgggggattctttaaaatctcgcccgc

SEQ ID NO: 21057 - DNA, 1168 bp, Homo sapiens
ggacccggtctatagactctgaccttagccctcagaatccctcattcagagcttagggatcgccaggccagaaggtggctgggaaggcaccagggagaagacagcctcccgcccccagttgagggaggtggtgaagagaggggagactgaaagcagtgggggagggtgagagaggggagccagcagagactcaagtggcctccagacttccaagtgctggccttcatctccccgcaagatgcgccccctccaactctcagccttcatcttcctactgtcactgtctccttcacaaggagagcagcaagagaaagaaagagagaggcaagcgaaattcctgaatggatagacagatgctacgtcatcggagctgcatcctccactccacaagaggctaggagctggggggagagaggcagtccagccgcaggggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgatcccatgggagtagaagaggtgtgagcaggttgcccagctggttagcggaaatgccaagatccaggctcctgaatttcagcctggccctttctatctgtctgatacctcctttacgagtctctctgcctgcgttgtgtggagcgggcctgctgctggttgggggagtttgcaggttgcccctatgcaaaaaaggacaggatgcatgactggcatgtaaggtgttcaggaaaaccaggaaaagactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21058 - DNA, 1578 bp, Homo sapiens
  misc_feature (1179)..(1179): n is a, c, g, or t
  misc_feature (1187)..(1187): n is a, c, g, or t
  misc_feature (1191)..(1191): n is a, c, g, or t
ggacccggtctatagactctgaccttagccctcagaatccctcattcagagcttagggatcgccaggccagaaggtggctgggaaggcaccagggagaagacagcctcccgcccccagttgagggaggtggtgaagagaggggagactgaaagcagtgggggagggtgagagaggggagccagcagagactcaagtggcctccagacttccaagtgctggccttcatctccccgcaagatgcgccccctccaactctcagccttcatcttcctactgtcactgtctccttcacaaggagagcagcaagagaaagaaagagagaggcaagcgaaattcctgaatggatagacagatgctacgtcatcggagctgcatcctccactccacaagaggctaggagctggggggagagaggcagtccagccgcaggggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgccttcatctcctcgtcctccaggcagcacaagccattgtggaatctccaccaggtgtacagaacggtgcctctgcgtcctgccactcaggacctctcaagtccccgatgtgatggctcctcagcatgatcaggaaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcacaaaaaacaacaaaaacaaaaaaaaaaaaaaaaaagaaaaaaaaaaaaaaaaaaaaanaaaaaaanaaanaaaaaaaaaaaaaaaaaaaagagagggggggcggggcgcaaaaaaaaaaccccccggggggggccccaaaggcacgcccccccatttttgaaaaagggggccccccaatggggggggcttaataaaaacaccgaggcagcgggggggggcggatctttaataacaaacaggtgtgtgagcgggagaaaaacttgtgtcgtgggggagacattgggtggagaaagaccacccaaccttggggggggggagacaataattggggaacaaactccacctatagaggtattagacccgcctcgggaaaataatacattgcaggtatgttagggtggacaaccgctattatttgcggggaaaaaatttgctagggtatatagtgaaacttcc

SEQ ID NO: 21059 - DNA, 675 bp, Homo sapiens
ggacccggtctatagactctgaccttagccctcagaatccctcattcagagcttagggatcgccaggccagaaggtggctgggaaggcaccagggagaagacagcctcccgcccccagttgagggaggtggtgaagagaggggagactgaaagcagtgggggagggtgagagaggggagccagcagagactcaagtggcctccagacttccaagtgctggccttcatctccccgcaagatgcgccccctccaactctcagccttcatcttcctactgtcactgtctccttcacaaggagagcagcaagagaaagaaagagagaggcaagcgaaattcctgaatggatagacagatgctacgtcatcggagctgcatcctccactccacaagagactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcaca

SEQ ID NO: 21060 - DNA, 1503 bp, Homo sapiens
ggacccggtctatagactctgaccttagccctcagaatccctcattcagagcttagggatcgccaggccagaaggtggctgggaaggcaccagggagaagacagcctcccgcccccagttgagggaggtggtgaagagaggggagactgaaagcagtgggggagggtgagagaggggagccagcagagactcaagtggcctccagacttccaagtgctggccttcatctccccgcaagatgcgccccctccaactctcagccttcatcttcctactgtcactgtctccttcacaaggagagcagcaagagaaagaaagagagaggcaagcgaaattcctgaatggatagacagatgctacgtcatcggagctgcatcctccactccacaagaggctaggagctggggggagagaggcagtccagccgcaggggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgatcccatgggagtagaagaggtgtgagcaggttgcccagctggttagcggaaatgccaagatccaggctcctgaatttcagcctggccctttctatctgtctgatacctcctttacgagtctctctgcctgcgttgtgtggagcgggcctgctgctggttgggggagtttgcaggttgcccctatgcaaaaaaggacaggatgcatgactggcatgtaaggtgttcaggaaaaccaggaaaagccttcatctcctcgtcctccaggcagcacaagccattgtggaatctccaccaggtgtacagaacggtgcctctgcgtcctgccactcaggacctctcaagtccccgatgtgatggctcctcagcatgatcaggagtgagcgtaattcagacctatttagatccgtcagcccacggaccagggggaccttgagcaggacagtcttttgtctccaagcagtcattccctgttatacaagcaagagtcaggaggaggaatggttttggcatcatcccccacagacagcaatggggcctttaggcctggaaggaaggacccaggctgcggctggcatatggaggttgagccctgggcacggggcatcagcttcacccggctggggatgccttctgctgggtttgtccatctggcaccagctggcttcccagcaccgcccccacaaccaaccagactcctccttctgctgttgccatggcaattggctgccatattgtacctcagagcactagctcctatctggattttcccgcggggttcctagagggtgggagatgggtctccagggatttatccctttcccctgatatctatccaataaaaattcataataacatatga

SEQ ID NO: 21061 - DNA, 1264 bp, Homo sapiens
ggacccggtctatagactctgaccttagccctcagaatccctcattcagagcttagggatcgccaggccagaaggtggctgggaaggcaccagggagaagacagcctcccgcccccagttgagggaggtggtgaagagaggggagactgaaagcagtgggggagggtgagagaggggagccagcagagactcaagtggcctccagacttccaagtgctggccttcatctccccgcaagatgcgccccctccaactctcagccttcatcttcctactgtcactgtctccttcacaaggagagcagcaagagaaagaaagagagaggcaagcgaaattcctgaatggatagacagatgctacgtcatcggagctgcatcctccactccacaagaggctaggagctggggggagagaggcagtccagccgcaggggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgatcccatgggagtagaagaggtgtgagcaggttgcccagctggttagcggaaatgccaagatccaggctcctgaatttcagcctggccctttctatctgtctgatacctcctttacgagtctctctgcctgcgttgtgtggagcgggcctgctgctggttgggggagtttgcaggttgcccctatgcaaaaaaggacaggatgcatgactggcatgtaaggtgttcaggaaaaccaggaaaaggtggaacagactgctacctctgtctgaagtggtttggagggaaggcctcagggacagggcatacctagcagtagctggcaagcccatgggagaaaaggcaagggggcaaccatctgccagggcacagaggccaggggatgtccacaaggagtctccagaggccagtgggagtcatgcaaactggaacggggcctgggaaaggcccttctgtgtgcccaggcctgcctccccaactccgtgagcctagttactaagagccatccatttcttagtatttagcatgtatccaggcactgaactaagtccgtgtacaaccgtatcgttatcgtatggttcatatgaatcctgggaaggtagtatgactagtagtaccatttc

SEQ ID NO: 21062 - DNA, 1701 bp, Homo sapiens
ggacccggtctatagactctgaccttagccctcagaatccctcattcagagcttagggatcgccaggccagaaggtggctgggaaggcaccagggagaagacagcctcccgcccccagttgagggaggtggtgaagagaggggagactgaaagcagtgggggagggtgagagaggggagccagcagagactcaagtggcctccagacttccaagtgctggccttcatctccccgcaagatgcgccccctccaactctcagccttcatcttcctactgtcactgtctccttcacaaggagagcagcaagagaaagaaagagagaggcaagcgaaattcctgaatggatagacagatgctacgtcatcggagctgcatcctccactccacaagaggctaggagctggggggagagaggcagtccagccgcaggggccacccgaacagtctctcctcctcacagaagcctggagctgggcatccaagaagaagcagcctcatttgttttctggtgtcatcgtaggtggccacctatggcttttggggtatttattttcttatttattgtttctgatggtggagtgggtgggggaagaaaaggaaaactggccctgtctcacttatgttttctcctgttctctgtacccctctacccctctccctgtctcttccagctttcggcccctgattttggtctactccaattgtagaaagacctacatagtcaatgataggccaccctgcttccagttctgtgatagagaggaaaggcattggggatacagggaactctttccccttctccaatgggctcctgagggcaaagttggaggccaattgaccttgggggagatgattggttggagaagggaacagagatacttgtacctgggtgacagaggtgagaaagaagaggagcatggggtatggtaaatggggacccaaggagcttaaataactgtgagtgggtatgtatgccagggtatacaactgcaagcactgggaggtggtactgctgggagtatcagtggatttgtcattgcattggtctgagttgataagtttgagtatgtgtgcatgtgtgtgtgtgtgcgcacgcgtgtatgtgtgtgcgtgtgtgtatgtgtatgtgtgtgcatgtgtgtgtgtgcgtgtgtgtgtgtgtgatgcgcagcacccttgcatactcatgcttatgccccttaaggaggccatttgctgatggttgagggtcttgtagaaaggactcagtctggacgaaccagccaaccctctaccatctctgccaccttgttcttacctcccagacacataaggttctcaggcaagtgagcaatgtgtgggctcaagaatagaactgggagcaggcaaggaaggcagtacttacacaagcccaaggaattctcaagctggcccctcaataggaggaacataccactctctcgtggggaagaagtgtgacatccttagggacgatatcctccagattatttctccatacctcctaccttttctgcccacatgaatagatattttgtatatatatatttttttcacacagcctcagtattttttattgctaattcttgcttttatttgtgactatcccatagacaatgcagatttctatagcaaaaaatgtatgatattgttcataatgatgcacttataagacaaataaatatctgaatccaccctttccc

SEQ ID NO: 21063 - DNA, 981 bp, Homo sapiens
agtgtgaaaggatgaatgaaaagtccggagccggagcgcgccggggccagagccgcggcagaggcagaggagggagctaggaggtgagacccgctccaccctgctcgcctaggctcggcggaggctaagagcagggcagcctcctctgcccggcgcccgctgagccccggcatctggaactcagggccctggcgctccaggggcgggaactggccgggaggaccgcgcgggagagcacggatgggcaccctgggctcgatcttctcacctggggcgggtgggttctgcaccaccctcccaccctccttcctccgtgtggacgatagagccacatccagcaccacggacagctcccgggcgatcccatgggagtagaagaggtgtgagcaggttgcccagctggttagcggaaatgccaagatccaggctcctgaatttcagcctggccctttctatctgtctgatacctcctttacgagtctctctgcctgcgttgtgtggagcgggcctgctgctggttgggggagtttgcaggttgcccctatgcaaaaaaggacaggatgcatgactggcatgtaaggtgttcaggaaaaccaggaaaaggtggaacagactgctacctctgtctgaagtggtttggagggaaggcctcagggacagggcatacctagcagtagctggcaagcccatgggagaaaaggcaagggggcaaccatctgccagggcacagaggccaggggatgtccacaaggagtctccagaggccagtgggagtcatgcaaactggaacggggcctgggaaaggcccttctgtgtgcccaggcctgcctccccaactccgtgagcctagttactaagagccatccatttcttagtatttagcatgtatccaggcactgaactaagtccgtgtacaaccgtatcgttatcgtatggttcatatgaatcctgggaaggtagtatgactagtagtaccatttc

SEQ ID NO: 21064 - DNA, 1100 bp, Homo sapiens
ggacccggtctatagactctgaccttagccctcagaatccctcattcagagcttagggatcgccaggccagaaggtggctgggaaggcaccagggagaagacagcctcccgcccccagttgagggaggtggtgaagagaggggagactgaaagcagtgggggagggtgagagaggggagccagcagagactcaagtggcctccagacttccaagtgctggccttcatctccccgcaagatgcgccccctccaactctcagccttcatcttcctactgtcactgtctccttcacaaggagagcagcaagagaaagaaagagagaggcaagcgaaattcctgaatggatagacagatgctacgtcatcggagctgcatcctccactccacaagaggctaggagctggggggagagaggcagtccagccgcaggggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgcactggaagctgagggtttgacagcggcaggccacataggcaaggaagctggtgcatgcagtgtctctgggcaaggttatgcaaaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagccatctgggataagactttgacccatgactcccatatccacagcctgtccatcctagcccatcccagtttatcctgtatcatttgagctgggattcccacatcctctgagttggaagtcccatctcaagtcttcaataaagactcttgaatattgaatcacaaaaaacaacacaaaattctccagcgct

SEQ ID NO: 21065 - DNA, 802 bp, Homo sapiens
ggacccggtctatagactctgaccttagccctcagaatccctcattcagagcttagggatcgccaggccagaaggtggctgggaaggcaccagggagaagacagcctcccgcccccagttgagggaggtggtgaagagaggggagactgaaagcagtgggggagggtgagagaggggagccagcagagactcaagtggcctccagacttccaagtgctggccttcatctccccgcaagatgcgccccctccaactctcagccttcatcttcctactgtcactgtctccttcacaaggagagcagcaagagaaagaaagagagaggcaagcgaaattcctgaatggatagacagatgctacgtcatcggagctgcatcctccactccacaagaggctaggagctggggggagagaggcagtccagccgcaggggccacccgaacagtctctcctcctcacagaagcctggagctgggcatccaagaagaagcagcctcatttgttttctggtgtcatcgtaggtggccacctatggcttttgggcttctcacctggggcgggtgggttctgcaccaccctcccaccctccttcctccgtgtggacgatagagccacatccagcaccacggacagctcccgggcgaccaaaaagaagaatgtacttcatctggttgggctggattccctctgataagccttcccagttgtttatcctgtatcatttgagctgggattcccacatcctctgagttggaagtcccatctcaagtcttcaataaagactcttgaatattgaatcaca

SEQ ID NO: 21066 - DNA, 910 bp, Homo sapiens
ggacccggtctatagactctgaccttagccctcagaatccctcattcagagcttagggatcgccaggccagaaggtggctgggaaggcaccagggagaagacagcctcccgcccccagttgagggaggtggtgaagagaggggagactgaaagcagtgggggagggtgagagaggggagccagcagagactcaagtggcctccagacttccaagtgctggccttcatctccccgcaagatgcgccccctccaactctcagccttcatcttcctactgtcactgtctccttcacaaggagagcagcaagagaaagaaagagagaggcaagcgaaattcctgaatggatagacagatgctacgtcatcggagctgcatcctccactccacaagaggctaggagctggggggagagaggcagtccagccgcaggggccacccgaacagtctctcctcctcacagaagcctgaccaaaaagaagaatgtacttcatctggttgggctggattccctctgataagccttcccagttgactgaaagatgaggctaggctctagcaagttgaagtcaaaccagctccttcaagaagctttgagcagaatgaagtggggaggacccagcttccagcccaggaagcccactgtacctggagaccgtggactagtactagtccacggttggctagtaaaaaacatgtagtattcgtgactgttcaccgctgtatctgcagtctcattcccaaggcagagcaggcactcagctaatgtttgctggctgaccgaattaaggattagaaactaaaaaatacaaatattgtcatgcattcttcagaaggttgccatgaggcctaagtgttatagtgaaatactatatgggaaaatgggtgcattcttttaaaattttttaaatg

SEQ ID NO: 21067 - DNA, 456 bp, Homo sapiens
gaaggttatatttcaagaatgatttaacctaggtcatgtaagatacggagggtatagatcaggtagagctgaaatgagccttagatatcatcattcctatattcctcattttacagatcccatgggagtagaagaggtgtgagcaggttgcccagctggttagcggaaatgccaagatccaggctcctgaatttcagcctggccctttctatctgtctgatacctcctttacgagtctctctgcctgcgttgtgtggagcgggcctgctgctggttgggggagtttgcaggttgcccctatgcaaaaaaggacaggatgcatgactggcatgtaaggtgttcaggaaaaccaggaaaaggtggaacagactgctacctctgtctgaagtggtttggagggaaggcctcagggacagggcatacctagcagtagctggcaagcccatgggagaaaag

SEQ ID NO: 21068 - DNA, 280 bp, Homo sapiens
ctaaccacaaaggccattagatacagaaataaagactgctacttgcctaaagaacaagtaaaattatctgcctatattctgtaaatcaggcagcaaaatgtgacatatattacataaatgtaatctccaaaaacaatgttaaaaatcagtgttttaggggccgggcatggtggctcacgcctgcaatgccagcactgtgggaggccgagacaggtagattacctgagatcaggagttcaagatcatcctggccaatatggtgaaaccccatctctacttt

SEQ ID NO: 21069 - DNA, 480 bp, Homo sapiens
gtttgtacgaggaggaggaggtacctgaaaaaggaaagcttgacagaagatacgatgtttgttgtggcttttgaatatgagccacagttattgaacctgtgattacctggacaagggtaagcaactacatagagtgaaggctggaaagctctattggagtgagagagataagggtcctgtttgcctggcttaggtgtttagactttagcctgtaggcaactgaaagtcattgaaggctttcaatcaggaggatgacataaccagatttgcatttttaaaagataactggcatcatcagtgagataaatggatctgtaacaagagacaggaggcagggagtctgcttgggagaactctgtgatacactgtgactcatggtaagaacctcaagtaaggtaaaggcactgatatttgagagcaattatctctatgctctccacaaagcctcaacttcacatattcaatgtgttaatttccagg

SEQ ID NO: 21070 - DNA, 154 bp, Homo sapiens
atcatgttgtatagcattagtaattgttaaacagaattaaaatttgatttattgcaataaaaatttaaaattcccaattaaaatattcaccctgagagtataatgcatttaatcatattttaacttcttatttttgcttgtacaatataagtct

SEQ ID NO: 21071 - DNA, 349 bp, Homo sapiens
tttcagctgcagcacatggatctctgccttgttacatggtgttcctcccttgtgtctctatgtctcgtctctttttcttttttctgagacagagccattgcactccagcctgggcgacagtgcgaggctctcaaaacaaacaaacaaaaaaaaatgcacaaaaaacaaaaataagattacatctcttaagtctctaaattgggaactgaaattcacacctgcaacatctttaatgatccaatggaaagaagtccaaactccttgaccagggtttgacaaattatggcccacgggccaaatttggttggctgcctgtttttgttattaaagagtttttggaatactgcca

SEQ ID NO: 21072 - DNA, 2903 bp, Homo sapiens
aagtgctctcctgacccgccgctgtgcagcgcagcgcaccgcgggaagatggcgttggaggtcggcgatatggaagatgggcagctttccgactcggattccgacatgacggtcgcacccagcgacaggccgctgcaattgccaaaagtgctaggtggcgacagtgctatgagggccttccagaacacggcaactgcatgtgcaccagtatcacattatcgagctgttgaaagtgtggattcaagtgaagaaagtttttctgattcagatgatgatagctgtctttggaaacgcaaacgacagaaatgttttaaccctcctcccaaaccagagccttttcagtttggccagagcagtcagaaaccacctgttgctggaggaaagaagattaacaacatatggggtgctgtgctgcaggaacagaatcaagatgcagtggccactgaacttggtatcttgggaatggagggcactattgacagaagcagacaatccgagacctacaattatttgcttgccaagaaacttaggaaggaatctcaagagcatacaaaagatctagacaaggaactagatgaatatatgcatggtggcaaaaaaatgggatcaaaggaagaggaaaatgggcaaggtcatctcaaaaggaaacgacctgtcaaagacaggctagggaacagaccagaaatgaactataaaggtcgatacgagatcacagcggaagattctcaagagaaagtggctgatgaaatttcattcaggttacaggaaccaaagaaagacctgatagcccgagtagtgaggattattggtaacaaaaaggcaattgaacttctgatggaaaccgctgaagttgaacaaaatggtggtctctttataatgaatggtagtcgaagaagaacaccaggtggagtttttctgaatctcttgaaaaacactcctagtatcagcgaggaacaaattaaggacattttctacattgaaaaccaaaaggaatatgaaaataaaaaagctgctaggaagaggagaacacaagtgttggggaaaaagatgaaacaagctattaaaagtctaaattttcaagaagatgatgatacatcacgagaaacttttgcaagtgacacgaatgaggccttggcctctcttgatgagtcacaggaaggacatgcagaagccaagttggaggcagaggaagccattgaagttgatcattctcatgatttggacatcttttaagtacattttcaacagtttgaggactaagcctttctaaaataacattgtaataaaccatttttactgagattgcaacgttttgcactgataaacatgagaatctggaggaaagacaattgttttcttgtttaaaatatgtgtggaaaggaatgcaattgatagaacatttaaagatatatctgacaaaatacttaagagtatatagcacaggatttaatttctcaatctgttgcatgtgctaattatgagtattactagttgataatcagttttgtctaggtcataacataccatttgtaagtttgtttgctttttcaggtttatctttgcagtgaattatgctttgctttaaaacattccgctaaaatcataatgggacatataaattattaagctgttagaaatgcattcaaatttgttttttctgtgttctaagaactcaggcaattttaaggataaaaactaacattggccaggcacggtggctcacgcctgtaatcccaacactttaggagaccaaggcgggcagatcacttgaggtcaggagtttgagaccagccaggccaacatggtgaaacttcatctctactaaaaatacaaaaactagccaggtgtggttctccatgcctataatcccggctactcgggaggctgaggcaggagaatcacctgaacccccaggctggagtacagtggcaggatctcagcttactgcagcttccatctcccaggttcaagcgatcatgtgcctaagcctcctgagtagctgggatcacaggtgtgtaccaccacgcccagctgatttttgtatttttagtaaagactttcgccatgttgtccaggctggtctcgaactcctggcctaatgatctgcccacctctgcctcccaaagtgctgggatcacaggcatgagccaccgaacccagccttattctgcttaaatttaacgtgttttttgacttcttaattaacttggtcatatactaaatgtgatctcctgtggattaccacatgcattaaaaaatttttcaagctgggcctagtggcgcacacctgcaatcccaacactttgggaggccaagagaggaagattgcttgagcccaggagtttgagaccaatctaggcaatgtagtgagaccctgtctctaatttaaaaaagaaaaagaaaaaaacattcccagtggcagcctgcctaagactgtcttaccttatgttaaggaagtcaggtatttaaaatgttacatatgccggcgcagtggctcatgtgtgtaatcccagcactctgggaggctgagacaggtagatcatttgaggtcaggagttcaaaaccaacctggtctacatggtgaaaccccatctcaactaaaaatacaaaaaatacaaaaaattagccgggcgcggtggctcacacctgtaatcccagcactttgggaggtggaggcgggtggatcacaaggtcaagagatcgagaccatcctggccaacatggtgaaaccctgtctctattaaaaatacaaaaattagctgggcgtggtggcgcatgcctgtagtcccaactactagggaggctgaggcaggagaatcacttgaacccaggaggtggaggttgcagtgagccgagatcacgccactgcactccagcctggcgacagagcgagactccctctc

SEQ ID NO: 21073 - DNA, 1825 bp, Homo sapiens
aagtgctctcctgacccgccgctgtgcagcgcagcgcaccgcgggaagatggcgttggaggtcggcgatatggaagatgggcagctttccgactcggattccgacatgacggtcgcacccagcgacaggccgctgcaattgccaaaagtgctaggtggcgacagtgctatgagggccttccagaacacggcaactgcatgtgcaccagtatcacattatcgagctgttgaaagtgtggattcaagtgaagaaagtttttctgattcagatgatgatagctgtctttggaaacgcaaacgacagaaatgttttaaccctcctcccaaaccagagccttttcagtttggccagagcagtcagaaaccacctgttgctggaggaaagaagattaacaacatatggggtgctgtgctgcaggaacagaatcaagatgcagtggccactgaacttggtatcttgggaatggagggcactattgacagaagcagacaatccgagacctacaattatttgcttgccaagaaacttaggaaggaatctcaagagcatacaaaagatctagacaaggaactagatgaatatatgcatggtggcaaaaaaatgggatcaaaggaagaggaaaatgggcaaggtcatctcaaaaggaaacgacctgtcaaagacaggctagggaacagaccagaaatgaactataaaggtcgatacgagatcacagcggaagattctcaagagaaagtggctgatgaaatttcattcaggttacaggaaccaaagaaagacctgatagcccgagtagtgaggattattggtaacaaaaaggcaattgaacttctgatggaaaccgctgaagttgaacaaaatggtggtctctttataatgaatggtagtcgaagaagaacaccaggtggagtttttctgaatctcttgaaaaacactcctagtatcagcgaggaacaaattaaggacattttctacattgaaaaccaaaaggaatatgaaaataaaaaagctgctaggaagaggagaacacaagtgttggggaaaaagatgaaacaagctattaaaagtctaaattttcaagaagatgatgatacatcacgagaaacttttgcaagtgacacgaatgaggccttggcctctcttgatgagtcacaggaaggacatgcagaagccaagttggaggcagaggaagccattgaagttgatcattctcatgatttggacatcttttaagtacattttcaacagtttgaggactaagcctttctaaaataacattgtaataaaccatttttactgagattgcaacgttttgcactgataaacatgagaatctggaggaaagacaattgttttcttgtttaaaatatgtgtggaaaggaatgcaattgatagaacatttaaagatatatctgacaaaatacttaagagtatatagcacaggatttaatttctcaatctgttgcatgtgctaattatgagtattactagttgataatcagttttgtctaggtcataacataccatttgtaagtttgtttgctttttcaggtttatctttgcagtgaattatgctttgctttaaaacattccgctaaaatcataatgggacatataaattattaagctgttagaaatgcattcaaatttgttttttctgtgttctaagaactcaggcaattttaaggataaaaactaacattgagccaccatgcctggtgggactttaacttttaactttggagcacttactccttttctctggagcccatgtttctggatgactattctcagatttttgctggaataaactctcaaaaactgg

SEQ ID NO: 21074 - DNA, 865 bp, Homo sapiens
  misc_feature (11)..(11): n is a, c, g, or t
  misc_feature (18)..(18): n is a, c, g, or t
  misc_feature (837)..(837): n is a, c, g, or t
  misc_feature (839)..(839): n is a, c, g, or t
tcggctaggtncgaggcngggtgtcgtatctttgcagtgaattatgctttgctttaaaacattccgctaaaatcataatgggacatataaattattaagctgttagaaatgcattcaaatttgttttttctgtgttctaagaactcaggcaattttaaggataaaaactaacattggccaggcacggtggctcacgcctgtaatcccaacactttaggagaccaaggcgggcagatcacttgaggtcaggagtttgagaccagccaggccaacatggtgaaacttcatctctactaaaaatacaaaaactagccaggtgtggttctccatgcctataatcccggctactcgggaggctgaggcaggagaatcacctgaacccgggaggctggagtacagtggtgcagtcatagctcgctgcagcctcaacctcccaggctcaaggtatcctcccacctcagccttctaagtagctggtaccacaggcatgcaccaccatgtctcgcttagttgcccaggtttgtctcttaactcctggcctcaagcagtcctcccacctgggcctcccaaagtgctgggatcacaggcatgagccaccgaacccagccttattctgcttaaatttaacgtgttttttgacttcttaattaacttggtcatatactaaatgtgatctcctgtggattaccacatgcattaaaaaatttttcaagctgggcctagtggcgcacacctgcaatcccaacactttgggaggccaagagaggaagattgcttgagcccaggagtttgagaccaatctaggcaatgtagtgagacctggtcttcttaatttananaaaaaaaaaccggggttcttggcggg

SEQ ID NO: 21075 - DNA, 1990 bp, Homo sapiens
aagtgctctcctgacccgccgctgtgcagcgcagcgcaccgcgggaagatggcgttggaggtcggcgatatggaagatgggcagctttccgactcggattccgacatgacggtcgcacccagcgacaggccgctgcaattgccaaaagtgctaggtggcgacagtgctatgagggccttccagaacacggcaactgcatgtgcaccagtatcacattatcgagctgttgaaagtgtggattcaagtgaagaaagtttttctgattcagatgatgatagctgtctttggaaacgcaaacgacagaaatgttttaaccctcctcccaaaccagagccttttcagtttggccagagcagtcagaaaccacctgttgctggaggaaagaagattaacaacatatggggtgctgtgctgcaggaacagaatcaagatgcagtggccactgaacttggtatcttgggaatggagggcactattgacagaagcagacaatccgagacctacaattatttgcttgccaagaaacttaggaaggaatctcaagagcatacaaaagatctagacaaggaactagatgaatatatgcatggtggcaaaaaaatgggatcaaaggaagaggaaaatgggcaaggtcatctcaaaaggaaacgacctgtcaaagacaggctagggaacagaccagaaatgaactataaaggtcgatacgagatcacagcggaagattctcaagagaaagtggctgatgaaatttcattcaggttacaggaaccaaagaaagacctgatagcccgagtagtgaggattattggtaacaaaaaggcaattgaacttctgatggaaaccgctgaagttgaacaaaatggtggtctctttataatgaatggtagtcgaagaagaacaccaggtggagtttttctgaatctcttgaaaaacactcctagtatcagcgaggaacaaattaaggacattttctacattgaaaaccaaaaggaatatgaaaataaaaaagctgctaggaagaggagaacacaagtgttggggaaaaagatgaaacaagctattaaaagtctaaattttcaagaagatgatgatacatcacgagaaacttttgcaagtgacacgaatgaggccttggcctctcttgatgagtcacaggaaggacatgcagaagccaagttggaggcagaggaagccattgaagttgatcattctcatgatttggacatcttttaagtacattttcaacagtttgaggactaagcctttctaaaataacattgtaataaaccatttttactgagattgcaacgttttgcactgataaacatgagaatctggaggaaagacaattgttttcttgtttaaaatatgtgtggaaaggaatgcaattgatagaacatttaaagatatatctgacaaaatacttaagagtatatagcacaggatttaatttctcaatctgttgcatgtgctaattatgagtattactagttgataatcagttttgtctaggtcataacataccatttgtaagtttgtttgctttttcaggtttatctttgcagtgaattatgctttgctttaaaacattccgctaaaatcataatgggacatataaattattaagctgttagaaatgcattcaaatttgttttttctgtgttctaagaactcaggcaattttaaggataaaaactaacattggccaggcacggtggctcacgcctgtaatcccaacactttaggagaccaaggcgggcagatcacttgaggtcaggagtttgagaccagccaggccaacatggtgaaacttcatctctactaaaaatacaaaaactagccaggtgtggttctccatgcctataatcccggctactcgggaggctgaggcaggagaatcacctgaacccgggaggcaaaggttgcagtgagctgagatcgtaccactgtactccagcctgggcgacagagcaagactctgtctcaaaaa

SEQ ID NO: 21076 - DNA, 2393 bp, Homo sapiens
  misc_feature (2365)..(2365): n is a, c, g, or t
  misc_feature (2367)..(2367): n is a, c, g, or t
aagtgctctcctgacccgccgctgtgcagcgcagcgcaccgcgggaagatggcgttggaggtcggcgatatggaagatgggcagctttccgactcggattccgacatgacggtcgcacccagcgacaggccgctgcaattgccaaaagtgctaggtggcgacagtgctatgagggccttccagaacacggcaactgcatgtgcaccagtatcacattatcgagctgttgaaagtgtggattcaagtgaagaaagtttttctgattcagatgatgatagctgtctttggaaacgcaaacgacagaaatgttttaaccctcctcccaaaccagagccttttcagtttggccagagcagtcagaaaccacctgttgctggaggaaagaagattaacaacatatggggtgctgtgctgcaggaacagaatcaagatgcagtggccactgaacttggtatcttgggaatggagggcactattgacagaagcagacaatccgagacctacaattatttgcttgccaagaaacttaggaaggaatctcaagagcatacaaaagatctagacaaggaactagatgaatatatgcatggtggcaaaaaaatgggatcaaaggaagaggaaaatgggcaaggtcatctcaaaaggaaacgacctgtcaaagacaggctagggaacagaccagaaatgaactataaaggtcgatacgagatcacagcggaagattctcaagagaaagtggctgatgaaatttcattcaggttacaggaaccaaagaaagacctgatagcccgagtagtgaggattattggtaacaaaaaggcaattgaacttctgatggaaaccgctgaagttgaacaaaatggtggtctctttataatgaatggtagtcgaagaagaacaccaggtggagtttttctgaatctcttgaaaaacactcctagtatcagcgaggaacaaattaaggacattttctacattgaaaaccaaaaggaatatgaaaataaaaaagctgctaggaagaggagaacacaagtgttggggaaaaagatgaaacaagctattaaaagtctaaattttcaagaagatgatgatacatcacgagaaacttttgcaagtgacacgaatgaggccttggcctctcttgatgagtcacaggaaggacatgcagaagccaagttggaggcagaggaagccattgaagttgatcattctcatgatttggacatcttttaagtacattttcaacagtttgaggactaagcctttctaaaataacattgtaataaaccatttttactgagattgcaacgttttgcactgataaacatgagaatctggaggaaagacaattgttttcttgtttaaaatatgtgtggaaaggaatgcaattgatagaacatttaaagatatatctgacaaaatacttaagagtatatagcacaggatttaatttctcaatctgttgcatgtgctaattatgagtattactagttgataatcagttttgtctaggtcataacataccatttgtaagtttgtttgctttttcaggtttatctttgcagtgaattatgctttgctttaaaacattccgctaaaatcataatgggacatataaattattaagctgttagaaatgcattcaaatttgttttttctgtgttctaagaactcaggcaattttaaggataaaaactaacattggccaggcacggtggctcacgcctgtaatcccaacactttaggagaccaaggcgggcagatcacttgaggtcaggagtttgagaccagccaggccaacatggtgaaacttcatctctactaaaaatacaaaaactagccaggtgtggttctccatgcctataatcccggctactcgggaggctgaggcaggagaatcacctgaacccgggaggctggagtacagtggtgcagtcatagctcgctgcagcctcaacctcccaggctcaaggtatcctcccacctcagccttctaagtagctggtaccacaggcatgcaccaccatgtctcgcttagttgcccaggtttgtctcttaactcctggcctcaagcagtcctcccacctgggcctcccaaagtgctgggatcacaggcatgagccaccgaacccagccttattctgcttaaatttaacgtgttttttgacttcttaattaacttggtcatatactaaatgtgatctcctgtggattaccacatgcattaaaaaatttttcaagctgggcctagtggcgcacacctgcaatcccaacactttgggaggccaagagaggaagattgcttgagcccaggagtttgagaccaatctaggcaatgtagtgagacctggtcttcttaatttananaaaaaaaaaccggggttcttggcggg

SEQ ID NO: 21077 - DNA, 2466 bp, Homo sapiens
aagtgctctcctgacccgccgctgtgcagcgcagcgcaccgcgggaagatggcgttggaggtcggcgatatggaagatgggcagctttccgactcggattccgacatgacggtcgcacccagcgacaggccgctgcaattgccaaaagtgctaggtggcgacagtgctatgagggccttccagaacacggcaactgcatgtgcaccagtatcacattatcgagctgttgaaagtgtggattcaagtgaagaaagtttttctgattcagatgatgatagctgtctttggaaacgcaaacgacagaaatgttttaaccctcctcccaaaccagagccttttcagtttggccagagcagtcagaaaccacctgttgctggaggaaagaagattaacaacatatggggtgctgtgctgcaggaacagaatcaagatgcagtggccactgaacttggtatcttgggaatggagggcactattgacagaagcagacaatccgagacctacaattatttgcttgccaagaaacttaggaaggaatctcaagagcatacaaaagatctagacaaggaactagatgaatatatgcatggtggcaaaaaaatgggatcaaaggaagaggaaaatgggcaaggtcatctcaaaaggaaacgacctgtcaaagacaggctagggaacagaccagaaatgaactataaaggtcgatacgagatcacagcggaagattctcaagagaaagtggctgatgaaatttcattcaggttacaggaaccaaagaaagacctgatagcccgagtagtgaggattattggtaacaaaaaggcaattgaacttctgatggaaaccgctgaagttgaacaaaatggtggtctctttataatgaatggtagtcgaagaagaacaccaggtggagtttttctgaatctcttgaaaaacactcctagtatcagcgaggaacaaattaaggacattttctacattgaaaaccaaaaggaatatgaaaataaaaaagctgctaggaagaggagaacacaagtgttggggaaaaagatgaaacaagctattaaaagtctaaattttcaagaagatgatgatacatcacgagaaacttttgcaagtgacacgaatgaggccttggcctctcttgatgagtcacaggaaggacatgcagaagccaagttggaggcagaggaagccattgaagttgatcattctcatgatttggacatcttttaagtacattttcaacagtttgaggactaagcctttctaaaataacattgtaataaaccatttttactgagattgcaacgttttgcactgataaacatgagaatctggaggaaagacaattgttttcttgtttaaaatatgtgtggaaaggaatgcaattgatagaacatttaaagatatatctgacaaaatacttaagagtatatagcacaggatttaatttctcaatctgttgcatgtgctaattatgagtattactagttgataatcagttttgtctaggtcataacataccatttgtaagtttgtttgctttttcaggtttatctttgcagtgaattatgctttgctttaaaacattccgctaaaatcataatgggacatataaattattaagctgttagaaatgcattcaaatttgttttttctgtgttctaagaactcaggcaattttaaggataaaaactaacattgcatgagccaccgaacccagccttattctgcttaaatttaacgtgttttttgacttcttaattaacttggtcatatactaaatgtgatctcctgtggattaccacatgcattaaaaaatttttcaagctgggcctagtggcgcacacctgcaatcccaacactttgggaggccaagagaggaagattgcttgagcccaggagtttgagaccaatctaggcaatgtagtgagaccctgtctctaatttaaaaaagaaaaagaaaaaaacattcccagtggcagcctgcctaagactgtcttaccttatgttaaggaagtcaggtatttaaaatgttacatatgccggcgcagtggctcatgtgtgtaatcccagcactctgggaggctgagacaggtagatcatttgaggtcaggagttcaaaaccaacctggtctacatggtgaaaccccatctcaactaaaaatacaaaaaatacaaaaaattagccgggcgcggtggctcacacctgtaatcccagcactttgggaggtggaggcgggtggatcacaaggtcaagagatcgagaccatcctggccaacatggtgaaaccctgtctctattaaaaatacaaaaattagctgggcgtggtggcgcatgcctgtagtcccaactactagggaggctgaggcaggagaatcacttgaacccaggaggtggaggttgcagtgagccgagatcacgccactgcactccagcctggcgacagagcgagactccctctc

SEQ ID NO: 21078 - DNA, 2504 bp, Homo sapiens
aagtgctctcctgacccgccgctgtgcagcgcagcgcaccgcgggaagatggcgttggaggtcggcgatatggaagatgggcagctttccgactcggattccgacatgacggtcgcacccagcgacaggccgctgcaattgccaaaagtgctaggtggcgacagtgctatgagggccttccagaacacggcaactgcatgtgcaccagtatcacattatcgagctgttgaaagtgtggattcaagtgaagaaagtttttctgattcagatgatgatagctgtctttggaaacgcaaacgacagaaatgttttaaccctcctcccaaaccagagccttttcagtttggccagagcagtcagaaaccacctgttgctggaggaaagaagattaacaacatatggggtgctgtgctgcaggaacagaatcaagatgcagtggccactgaacttggtatcttgggaatggagggcactattgacagaagcagacaatccgagacctacaattatttgcttgccaagaaacttaggaaggaatctcaagagcatacaaaagatctagacaaggaactagatgaatatatgcatggtggcaaaaaaatgggatcaaaggaagaggaaaatgggcaaggtcatctcaaaaggaaacgacctgtcaaagacaggctagggaacagaccagaaatgaactataaaggtcgatacgagatcacagcggaagattctcaagagaaagtggctgatgaaatttcattcaggttacaggaaccaaagaaagacctgatagcccgagtagtgaggattattggtaacaaaaaggcaattgaacttctgatggaaaccgctgaagttgaacaaaatggtggtctctttataatgaatggtagtcgaagaagaacaccaggtggagtttttctgaatctcttgaaaaacactcctagtatcagcgaggaacaaattaaggacattttctacattgaaaaccaaaaggaatatgaaaataaaaaagctgctaggaagaggagaacacaagtgttggggaaaaagatgaaacaagctattaaaagtctaaattttcaagaagatgatgatacatcacgagaaacttttgcaagtgacacgaatgaggccttggcctctcttgatgagtcacaggaaggacatgcagaagccaagttggaggcagaggaagccattgaagttgatcattctcatgatttggacatcttttaagtacattttcaacagtttgaggactaagcctttctaaaataacattgtaataaaccatttttactgagattgcaacgttttgcactgataaacatgagaatctggaggaaagacaattgttttcttgtttaaaatatgtgtggaaaggaatgcaattgatagaacatttaaagatatatctgacaaaatacttaagagtatatagcacaggatttaatttctcaatctgttgcatgtgctaattatgagtattactagttgataatcagttttgtctaggtcataacataccatttgtaagtttgtttgctttttcaggtttatctttgcagtgaattatgctttgctttaaaacattccgctaaaatcataatgggacatataaattattaagctgttagaaatgcattcaaatttgttttttctgtgttctaagaactcaggctggtctcgaactcctggcctaatgatctgcccacctctgcctcccaaagtgctgggatcacaggcatgagccaccgaacccagccttattctgcttaaatttaacgtgttttttgacttcttaattaacttggtcatatactaaatgtgatctcctgtggattaccacatgcattaaaaaatttttcaagctgggcctagtggcgcacacctgcaatcccaacactttgggaggccaagagaggaagattgcttgagcccaggagtttgagaccaatctaggcaatgtagtgagaccctgtctctaatttaaaaaagaaaaagaaaaaaacattcccagtggcagcctgcctaagactgtcttaccttatgttaaggaagtcaggtatttaaaatgttacatatgccggcgcagtggctcatgtgtgtaatcccagcactctgggaggctgagacaggtagatcatttgaggtcaggagttcaaaaccaacctggtctacatggtgaaaccccatctcaactaaaaatacaaaaaatacaaaaaattagccgggcgcggtggctcacacctgtaatcccagcactttgggaggtggaggcgggtggatcacaaggtcaagagatcgagaccatcctggccaacatggtgaaaccctgtctctattaaaaatacaaaaattagctgggcgtggtggcgcatgcctgtagtcccaactactagggaggctgaggcaggagaatcacttgaacccaggaggtggaggttgcagtgagccgagatcacgccactgcactccagcctggcgacagagcgagactccctctc

SEQ ID NO: 21079 - DNA, 2027 bp, Homo sapiens
aagtgctctcctgacccgccgctgtgcagcgcagcgcaccgcgggaagatggcgttggaggtcggcgatatggaagatgggcagctttccgactcggattccgacatgacggtcgcacccagcgacaggccgctgcaattgccaaaagtgctaggtggcgacagtgctatgagggccttccagaacacggcaactgcatgtgcaccagtatcacattatcgagctgttgaaagtgtggattcaagtgaagaaagtttttctgattcagatgatgatagctgtctttggaaacgcaaacgacagaaatgttttaaccctcctcccaaaccagagccttttcagtttggccagagcagtcagaaaccacctgttgctggaggaaagaagattaacaacatatggggtgctgtgctgcaggaacagaatcaagatgcagtggccactgaacttggtatcttgggaatggagggcactattgacagaagcagacaatccgagacctacaattatttgcttgccaagaaacttaggaaggaatctcaagagcatacaaaagatctagacaaggaactagatgaatatatgcatggtggcaaaaaaatgggatcaaaggaagaggaaaatgggcaaggtcatctcaaaaggaaacgacctgtcaaagacaggctagggaacagaccagaaatgaactataaaggtcgatacgagatcacagcggaagattctcaagagaaagtggctgatgaaatttcattcaggttacaggaaccaaagaaagacctgatagcccgagtagtgaggattattggtaacaaaaaggcaattgaacttctgatggaaaccgctgaagttgaacaaaatggtggtctctttataatgaatggtagtcgaagaagaacaccaggtggagtttttctgaatctcttgaaaaacactcctagtatcagcgaggaacaaattaaggacattttctacattgaaaaccaaaaggaatatgaaaataaaaaagctgctaggaagaggagaacacaagtgttggggaaaaagatgaaacaagctattaaaagtctaaattttcaagaagatgatgatacatcacgagaaacttttgcaagtgacacgaatgaggccttggcctctcttgatgagtcacaggaaggacatgcagaagccaagttggaggcagaggaagccattgaagttgatcattctcatgatttggacatcttttaagtacattttcaacagtttgaggactaagcctttctaaaataacattgtaataaaccatttttactgagattgcaacgttttgcactgataaacatgagaatctggaggaaagacaattgttttcttgtttaaaatatgtgtggaaaggaatgcaattgatagaacatttaaagatatatctgacaaaatacttaagagtatatagcacaggatttaatttctcaatctgttgcatgtgctaattatgagtattactagttgataatcagttttgtctaggtcataacataccatttgtaagtttgtttgctttttcaggtttatctttgcagtgaattatgctttgctttaaaacattccgctaaaatcataatgggacatataaattattaagctgttagaaatgcattcaaatttgttttttctgtgttctaagaactcaggcaattttaaggataaaaactaacattgaggctggtctcgaactcctggcctaatgatctgcccacctctgcctcccaaagtgctgggatcacaggcatgagccaccgaacccagccttattctgcttaaatttaacgtgttttttgacttcttaattaacttggtcatatactaaatgtgatctcctgtggattaccacatgcattaaaaaatttttcaagctgggcctagtggcgcacacctgcaatcccaacactttgggaggccaagagaggaagattgcttgagcccaggagtttgagaccaatctaggcaatgtagtgagaccctgtctctaatttaaaaaaaaa

SEQ ID NO: 21080 - DNA, 1597 bp, Homo sapiens
aagtgctctcctgacccgccgctgtgcagcgcagcgcaccgcgggaagatggcgttggaggtcggcgatatggaagatgggcagctttccgactcggattccgacatgacggtcgcacccagcgacaggccgctgcaattgccaaaagtgctaggtggcgacagtgctatgagggccttccagaacacggcaactgcatgtgcaccagtatcacattatcgagctgttgaaagtgtggattcaagtgaagaaagtttttctgattcagatgatgatagctgtctttggaaacgcaaacgacagaaatgttttaaccctcctcccaaaccagagccttttcagtttggccagagcagtcagaaaccacctgttgctggaggaaagaagattaacaacatatggggtgctgtgctgcaggaacagaatcaagatgcagtggccactgaacttggtatcttgggaatggagggcactattgacagaagcagacaatccgagacctacaattatttgcttgccaagaaacttaggaaggaatctcaagagcatacaaaagatctagacaaggaactagatgaatatatgcatggtggcaaaaaaatgggatcaaaggaagaggaaaatgggcaaggtcatctcaaaaggaaacgacctgtcaaagacaggctagggaacagaccagaaatgaactataaaggtcgatacgagatcacagcggaagattctcaagagaaagtggctgatgaaatttcattcaggttacaggaaccaaagaaagacctgatagcccgagtagtgaggattattggtaacaaaaaggcaattgaacttctgatggaaaccgctgaagttgaacaaaatggtggtctctttataatgaatggtagtcgaagaagaacaccaggtggagtttttctgaatctcttgaaaaacactcctagtatcagcgaggaacaaattaaggacattttctacattgaaaaccaaaaggaatatgaaaataaaaaagctgctaggaagaggagaacacaagtgttggggaaaaagatgaaacaagctattaaaagtctaaattttcaagaagatgatgatacatcacgagaaacttttgcaagtgacacgaatgaggccttggcctctcttgatgagtcacaggaaggacatgcagaagccaagttggaggcagaggaagccattgaagttgatcattctcatgatttggacatcttttaagtacattttcaacagtttgaggactaagcctttctaaaataacattgtaataaaccatttttactgagattgcaacgttttgcactgataaacatgagaatctggaaaaaaaaaaaaaaaaaaaaaaaaaacacaaaaaaaaaaccgggagaagcacaaaaatactcggggcggcgcgagaaacaaaacaagcagtaatcgagacagggcggcgcacagcggcggccacacagccgggtcctcgagaaccccaactttcgtgaggaacaacacggggggaaatacagcggggaccccaaaaaaggagacagcgaaaatcagtgcaaaaaacaccgggaaccccgatagagagcgaaacacgagc

SEQ ID NO: 21081 - DNA, 1981 bp, Homo sapiens
tggttatttcaagtcaccagggacctggcgacttaagtttgtaaatgacatggcctcttggttcgatcaatttgacattccgactcggattccgacatgacggtcgcacccagcgacaggccgctgcaattgccaaaagtgctaggtggcgacagtgctatgagggccttccagaacacggcaactgcatgtgcaccagtatcacattatcgagctgttgaaagtgtggattcaagtgaagaaagtttttctgattcagatgatgatagctgtctttggaaacgcaaacgacagaaatgttttaaccctcctcccaaaccagagccttttcagtttggccagagcagtcagaaaccacctgttgctggaggaaagaagattaacaacatatggggtgctgtgctgcaggaacagaatcaagatgcagtggccactgaacttggtatcttgggaatggagggcactattgacagaagcagacaatccgagacctacaattatttgcttgccaagaaacttaggaaggaatctcaagagcatacaaaagatctagacaaggaactagatgaatatatgcatggtggcaaaaaaatgggatcaaaggaagaggaaaatgggcaaggtcatctcaaaaggaaacgacctgtcaaagacaggctagggaacagaccagaaatgaactataaaggtcgatacgagatcacagcggaagattctcaagagaaagtggctgatgaaatttcattcaggttacaggaaccaaagaaagacctgatagcccgagtagtgaggattattggtaacaaaaaggcaattgaacttctgatggaaaccgctgaagttgaacaaaatggtggtctctttataatgaatggtagtcgaagaagaacaccaggtggagtttttctgaatctcttgaaaaacactcctagtatcagcgaggaacaaattaaggacattttctacattgaaaaccaaaaggaatatgaaaataaaaaagctgctaggaagaggagaacacaagtgttggggaaaaagatgaaacaagctattaaaagtctaaattttcaagaagatgatgatacatcacgagaaacttttgcaagtgacacgaatgaggccttggcctctcttgatgagtcacaggaaggacatgcagaagccaagttggaggcagaggaagccattgaagttgatcattctcatgatttggacatcttttaagtacattttcaacagtttgaggactaagcctttctaaaataacattgtaataaaccatttttactgagattgcaacgttttgcactgataaacatgagaatctggaggaaagacaattgttttcttgtttaaaatatgtgtggaaaggaatgcaattgatagaacatttaaagatatatctgacaaaatacttaagagtatatagcacaggatttaatttctcaatctgttgcatgtgctaattatgagtattactagttgataatcagttttgtctaggtcataacataccatttgtaagtttgtttgctttttcaggtttatctttgcagtgaattatgctttgctttaaaacattccgctaaaatcataatgggacatataaattattaagctgttagaaatgcattcaaatttgttttttctgtgttctaagaactcaggcaattttaaggataaaaactaacattggccaggcacggtggctcacgcctgtaatcccaacactttaggagaccaaggcgggcagatcacttgaggtcaggagtttgagaccagccaggccaacatggtgaaacttcatctctactaaaaatacaaaaactagccaggtgtggttctccatgcctataatcccggctactcgggaggctgaggcaggagaatcacctgaacccgggaggcaaaggttgcagtgagctgagatcgtaccactgtactccagcctgggcgacagagcaagactctgtctcaaaaa

SEQ ID NO: 21082 - DNA, 1937 bp, Homo sapiens
aagtgctctcctgacccgccgctgtgcagcgcagcgcaccgcgggaagatggcgttggaggtcggcgatatggaagatgggcagctttccgactcggattccgacatgacggtcgcacccagcgacaggccgctgcaattgccaaaagtgctaggtggcgacagtgctatgagggccttccagaacacggcaactgcatgtgcaccagtatcacattatcgagctgttgaaagtgtggattcaagtgaagaaagtttttctgattcagatgatgatagctgtctttggaaacgcaaacgacagaaatgttttaaccctcctcccaaaccagagccttttcagtttggccagagcagtcagaaaccacctgttgctggaggaaagaagattaacaacatatggggtgctgtgctgcaggaacagaatcaagatgcagtggccactgaacttggtatcttgggaatggagggcactattgacagaagcagacaatccgagacctacaattatttgcttgccaagaaacttaggaaggaatctcaagagcatacaaaagatctagacaaggaactagatgaatatatgcatggtggcaaaaaaatgggatcaaaggaagaggaaaatgggcaaggtcatctctaaaggtcgatacgagatcacagcggaagattctcaagagaaagtggctgatgaaatttcattcaggttacaggaaccaaagaaagacctgatagcccgagtagtgaggattattggtaacaaaaaggcaattgaacttctgatggaaaccgctgaagttgaacaaaatggtggtctctttataatgaatggtagtcgaagaagaacaccaggtggagtttttctgaatctcttgaaaaacactcctagtatcagcgaggaacaaattaaggacattttctacattgaaaaccaaaaggaatatgaaaataaaaaagctgctaggaagaggagaacacaagtgttggggaaaaagatgaaacaagctattaaaagtctaaattttcaagaagatgatgatacatcacgagaaacttttgcaagtgacacgaatgaggccttggcctctcttgatgagtcacaggaaggacatgcagaagccaagttggaggcagaggaagccattgaagttgatcattctcatgatttggacatcttttaagtacattttcaacagtttgaggactaagcctttctaaaataacattgtaataaaccatttttactgagattgcaacgttttgcactgataaacatgagaatctggaggaaagacaattgttttcttgtttaaaatatgtgtggaaaggaatgcaattgatagaacatttaaagatatatctgacaaaatacttaagagtatatagcacaggatttaatttctcaatctgttgcatgtgctaattatgagtattactagttgataatcagttttgtctaggtcataacataccatttgtaagtttgtttgctttttcaggtttatctttgcagtgaattatgctttgctttaaaacattccgctaaaatcataatgggacatataaattattaagctgttagaaatgcattcaaatttgttttttctgtgttctaagaactcaggcaattttaaggataaaaactaacattggccaggcacggtggctcacgcctgtaatcccaacactttaggagaccaaggcgggcagatcacttgaggtcaggagtttgagaccagccaggccaacatggtgaaacttcatctctactaaaaatacaaaaactagccaggtgtggttctccatgcctataatcccggctactcgggaggctgaggcaggagaatcacctgaacccgggaggcaaaggttgcagtgagctgagatcgtaccactgtactccagcctgggcgacagagcaagactctgtctcaaaaa

SEQ ID NO: 21083 - DNA, 1423 bp, Homo sapiens
gctgaggtgatctcagaggatcccccaggtcttttcccctcaaaggaagaggaaaatgggcaaggtcatctcaaaaggaaacgacctgtcaaagacaggctagggaacagaccagaaatgaactataaaggtcgatacgagatcacagcggaagattctcaagagaaagtggctgatgaaatttcattcaggttacaggaaccaaagaaagacctgatagcccgagtagtgaggattattggtaacaaaaaggcaattgaacttctgatggaaaccgctgaagttgaacaaaatggtggtctctttataatgaatggtagtcgaagaagaacaccaggtggagtttttctgaatctcttgaaaaacactcctagtatcagcgaggaacaaattaaggacattttctacattgaaaaccaaaaggaatatgaaaataaaaaagctgctaggaagaggagaacacaagtgttggggaaaaagatgaaacaagctattaaaagtctaaattttcaagaagatgatgatacatcacgagaaacttttgcaagtgacacgaatgaggccttggcctctcttgatgagtcacaggaaggacatgcagaagccaagttggaggcagaggaagccattgaagttgatcattctcatgatttggacatcttttaagtacattttcaacagtttgaggactaagcctttctaaaataacattgtaataaaccatttttactgagattgcaacgttttgcactgataaacatgagaatctggaggaaagacaattgttttcttgtttaaaatatgtgtggaaaggaatgcaattgatagaacatttaaagatatatctgacaaaatacttaagagtatatagcacaggatttaatttctcaatctgttgcatgtgctaattatgagtattactagttgataatcagttttgtctaggtcataacataccatttgtaagtttgtttgctttttcaggtttatctttgcagtgaattatgctttgctttaaaacattccgctaaaatcataatgggacatataaattattaagctgttagaaatgcattcaaatttgttttttctgtgttctaagaactcaggcaattttaaggataaaaactaacattggccaggcacggtggctcacgcctgtaatcccaacactttaggagaccaaggcgggcagatcacttgaggtcaggagtttgagaccagccaggccaacatggtgaaacttcatctctactaaaaatacaaaaactagccaggtgtggttctccatgcctataatcccggctactcgggaggctgaggcaggagaatcacctgaacccgggaggcaaaggttgcagtgagctgagatcgtaccactgtactccagcctgggcgacagagcaagactctgtctcaaaaa

SEQ ID NO: 21084 - DNA, 867 bp, Homo sapiens
  misc_feature (839)..(839): n is a, c, g, or t
  misc_feature (841)..(841): n is a, c, g, or t
aactaggctaggcacgaggccgggggcgtatctttgcagtgaattatgctttgctttaaaacattccgctaaaatcataatgggacatataaattattaagctgttagaaatgcattcaaatttgttttttctgtgttctaagaactcaggcaattttaaggataaaaactaacattggccaggcacggtggctcacgcctgtaatcccaacactttaggagaccaaggcgggcagatcacttgaggtcaggagtttgagaccagccaggccaacatggtgaaacttcatctctactaaaaatacaaaaactagccaggtgtggttctccatgcctataatcccggctactcgggaggctgaggcaggagaatcacctgaacccgggaggctggagtacagtggtgcagtcatagctcgctgcagcctcaacctcccaggctcaaggtatcctcccacctcagccttctaagtagctggtaccacaggcatgcaccaccatgtctcgcttagttgcccaggtttgtctcttaactcctggcctcaagcagtcctcccacctgggcctcccaaagtgctgggatcacaggcatgagccaccgaacccagccttattctgcttaaatttaacgtgttttttgacttcttaattaacttggtcatatactaaatgtgatctcctgtggattaccacatgcattaaaaaatttttcaagctgggcctagtggcgcacacctgcaatcccaacactttgggaggccaagagaggaagattgcttgagcccaggagtttgagaccaatctaggcaatgtagtgagacctggtcttcttaatttananaaaaaaaaaccggggttcttggcggg

SEQ ID NO: 21085 - DNA, 863 bp, Homo sapiens
  misc_feature (835)..(835): n is a, c, g, or t
  misc_feature (837)..(837): n is a, c, g, or t
agtatgcaggagaggcccgggtgttatctttgcagtgaattatgctttgctttaaaacattccgctaaaatcataatgggacatataaattattaagctgttagaaatgcattcaaatttgttttttctgtgttctaagaactcaggcaattttaaggataaaaactaacattggccaggcacggtggctcacgcctgtaatcccaacactttaggagaccaaggcgggcagatcacttgaggtcaggagtttgagaccagccaggccaacatggtgaaacttcatctctactaaaaatacaaaaactagccaggtgtggttctccatgcctataatcccggctactcgggaggctgaggcaggagaatcacctgaacccgggaggctggagtacagtggtgcagtcatagctcgctgcagcctcaacctcccaggctcaaggtatcctcccacctcagccttctaagtagctggtaccacaggcatgcaccaccatgtctcgcttagttgcccaggtttgtctcttaactcctggcctcaagcagtcctcccacctgggcctcccaaagtgctgggatcacaggcatgagccaccgaacccagccttattctgcttaaatttaacgtgttttttgacttcttaattaacttggtcatatactaaatgtgatctcctgtggattaccacatgcattaaaaaatttttcaagctgggcctagtggcgcacacctgcaatcccaacactttgggaggccaagagaggaagattgcttgagcccaggagtttgagaccaatctaggcaatgtagtgagacctggtcttcttaatttananaaaaaaaaaccggggttcttggcggg

SEQ ID NO: 21086 - DNA, 786 bp, Homo sapiens
ggtcccactttgtaggcacacacacacacacacaccaatctaagcacaaaattatcttgttgtcctcaatagtttgcatggataagtaatgcagaataagcatcatacccaatattaataaatacttaacaagaagcccaagattttaccttgtttcctattttttccttcagccatcacattcaaacctggcccaaaggtttctcacattctggcctccatcaccaccactactgctttggcctggccttttgtcaagctagaaattgccagaatttcctgacaacaggctctgtaagattcagtttagagcttacactttggctggagttcatcttcctaaaaagagactgtgatatgtaaatccacaacctgaaatctcattggctctccattgcctaccaataacccaaaatcctctactcaggaagtcctggatggtgtaactccattgcacacaggttcatcccacaaggcctcttggtaatggggtactttcatgtgcatactattctgctgctcttgtggaaagagtcttcaaccccattctgtataccctggacactcacctgagacccagctgaaacagaccttgtcatctcggaccctgcccttggttctgttgaaagaattagccaccagatccttgaggctgtctcaggacttttgcttcacctttattataacaattggaatgcaggcaaaatagtgtttccagttactaaaataaaacaagatgcggccagttctctctcaaaattatccataatggatgatgctggatcc

SEQ ID NO: 21087 - DNA, 436 bp, Homo sapiens
atttcagaacctttcctggcctcgcacaatggcaaagtttccctatgaataaaaactggtttgaaggatggccaacattcccaataacctatgggtattggggggttctccatgtcctccccagcaagtctgacattctttaagtcttataagaatgtcagccacaataaggatatctagacagctgacagatgcccattaattgatctgatttaaaaatagaggccaagagcctcggaatgatgggatcgattttgagtttgctcctctactcaccgctccaatgaatgttgtaccttggattcccagccaatgcaccaacatgacatggctccattgtctggagaaacacccagggtccttggtcttgcaccgagaaaattagtgacacagacacaggtggagtggatttaaggagcagaaagtgtaataggca

SEQ ID NO: 21088 - DNA, 402 bp, Homo sapiens
tttaatggaattaagacatgacttgagggcctaagtcttactctgcccatagctctgagtaatttcaggatccacaaggaaccatgtttaacaccccagtcactcttttcactcatctcttcatcttcagggatcttctccactcccttctagttctcccacttccgcaggcactccctggaccgcaccatcccctaggactgcttcacctctaaatactaaacttacaggtaggtccccattctctgacaactcacctcctaaccttccaggtcactcactccattattcccaagacacccattcttcaacctatttggaatgtccagttcaccaatcccttggctatttctctacagccttattctgttttacctctctgagttaggtcccaagaaccaa

SEQ ID NO: 21089 - DNA, 377 bp, Homo sapiens
gtattacatatatgtgtagtatatatggcacacaaatatgtacatgcatatacataaatatatttatatattaaattttattaactattgaaaatctttaaaatctatgattattcttgtttacttgatctgataaattctttatttattttttctgagatggagtctcactctgtcacccaggctggattgcaatggggtaatcttagctcgctgcaacctccgcctcccggattcaagtgattcttgtgcctcagctactcgggaggctgatgcacaagaactgactgaacctggaaggtggaggctgcagtgagcccagattgtatcattgcactccagcctgagtgacagagcgcgaccctgtctcaaaaaac

SEQ ID NO: 21090 - DNA, 443 bp, Homo sapiens
gcaccagtcatcttacaaagcttccttctagaaatgctaagtcatcctgtgtgtgcatttgggccaggagagaggtagctgcttttgtgtgtttggagtagggttagcagtctcaagccatagctgctcctctttcctcagaaataaagtcctctgttagttccctgagattttacttcattttgtctatgggggaaaaagtggttaaagagtcatttattctaactataagttgtcagttgagcaagtcttttataaggaatactttctgaaaatactaaatgtcttaatattaaaatactacattgactttttaattcaaatgaagtaaagtggttaaacttgaatgattacggctatactgaaaaccgtaaaatataaaaacctaacatttttttgagaggtgagtccgtaaatgtgacttatcaatgtaaaatcttcaa

SEQ ID NO: 21091 - DNA, 537 bp, Homo sapiens
gctcatttcgaagagtgtgtccagtatgattatagaatatttcttatcagtattttctcaaagtatgggaaactaatccctcaaacaaagggaaatagattatttcaatgctttcaacatgtggtagaggaattgcatcacacagtatttggcctgctttatttatgaatctctattgtacagctgaaatttaaggagtttttttattaattgaaatattttatctttcatatagtttgccacatcagccaggttcagtggctcatacttgtaatctcaacactttgggaggctgaatcaggaggattgcttgaggccaggcctggcaacatagtgagacctcccctctacagaaaatttaaaaatcagccaggcatcgtggcatgcacctctagtcccagctactcagaaggctgaggtaagaggattgcttgagcccaggaatcaagactgcagtgagctatggtcacatcactgtactcccgcctgggtgacagagcaaaaccttgtatctttaaaaaaaaaaaagaaagaaag

SEQ ID NO: 21092 - DNA, 408 bp, Homo sapiens
acaaagatggggaaaaaggaagaggtagggtgtgttcaagaatgaggaacagaccagcatggcagtcaaagcaaaggatttgcacagagcaccagatcataaatgccctgagaatcagccaatggttctccagagaaacagaaccagtaggagatgtatgtgtgtgtttataaagagacttattataaggaagtggcttacgcaattatagaggccaagaagtctcaagatctgcagtcagcaagctggagacccaagagagacaataacataagttatagtttgagtctgaatctgaaggcaggagaagaccgatgtcccaggttgaaaacagtcaaacagagagagagagaggagagtgaattctcccttactcagtctttttgtactactgaagccttcaataga

SEQ ID NO: 21093 - DNA, 250 bp, Homo sapiens
aaaactggctatccatatgcagaagagtgaaactagacccctaattcttgctgtatataaaaataaaaatggattgaagacttaaatatgtgtccacatactatgaaacaactaaaattaaacatcgaggaaactctttagtttttgtttttgttttagtttttgtgttttttttcccacaaaaagcacaggcagccaaagcaaaaatgaacacataggatctcatcaagttaaaaagcttctgcacagc

SEQ ID NO: 21094 - DNA, 789 bp, Homo sapiens
  misc_feature (658)..(658): n is a, c, g, or t
ctccgccatgatgagaagcgcctgcttccccttccccttccgccatgattgtgtttcctgagacctcccagccacgcttcctgtacagcctgcagaactgtgagtcaaccaaacttccttttaaaataaattacccagtctcagctaggtctttctagcagtgtgagaacggacacgtagagggtgtgagagccagaagactttaaggagagggacgagctggggcctggatgcccggggaggtggacctggaccaggacaggtgtcagcgggcagagatggggcagaggtgtggctgtctacctgcgaccggggccatgccctctcgggctcggttgaggagctgctcttcctccagaatgcgctcggacggaacgttaggaaggccctggtgagtggccccgacctcctcccccaggactggcttctccggccctctgccctttcgggcagaacagctcgtggctcttccaggacctggggctccatcttgcagaacagctcgtggctcttccaggacctggggctccatcttgcagaacagctcgtggctcttccaggacctggggctccatcttgcagaacagctcgtggctcttccaggacctggggctccatcttgcagaacagctcgtggctcttccaggacctggggctnccatcttgcagaacagctcgtggctcttccaggacctggggctccatcttgcagaacagctcgtggctcttccaggacctggggctccatcttgcgaacagctcgtggctcttccaggacctgggctcctc

SEQ ID NO: 21095 - DNA, 1045 bp, Homo sapiens
ctccgccatgatgagaagcgcctgcttccccttccccttccgccatgattgtgtttcctgagacctcccagccacgcttcctgtacagcctgcagaactgtgagtcaaccaaacttccttttaaaataaattacccagtctcagctaggtctttctagcagtgtgagaacggacacgtagagggtgtgagagccagaagactttaaggagagggacgagctggggcctggatgcccggggaggtggacctggaccaggacaggtgtcagcgggcagagatggggcagaggtgtggctgtctacctgcgaccggggccatgccctctcgggctcggttgaggagctgctcttcctccagaatgcgctcggacggaacgttaggaaggccctggaccaaaggacacttgatccgccttttcaagcctgacattgaacaattcaaatcaatggatgggattaccggctgatagaaatgggggttctccacgctcagagaatgacaacaggggctgctgggggctccgtccgcccgaagagccgtgctcgggagatgcggaggggaatgaagtggagcaggctcacctttggacgtttttaatgcattatttcagagtaacatattcttattttaattaacttttgatgtttctgagctttcagttatccacagagccgagagaaccactccgccggctggagcaggctctgtgatcctaggatgtgttgtggatacgccttggggctcgtcacaggctgctgagcctcagtttcccttctcacagagcctcctctctgactgattcttgcggtgactccccaaatcgactgtgaaatcagttttgagtaccttgaaaaatttctaagaagttatgattttgacacagaaagttagctaaataatgcagcaggctaaatcacatctggaagaactgagaattcgatccaagagtctaaacactgaatcagcaagcggtttctctggctgttctgtggcctgtgttttgggggcacccggggaggtctcagaggccgcggggacctgtcc

SEQ ID NO: 21096 - DNA, 484 bp, Homo sapiens
cagacaaaagttcctgtaattaagggaacacagatgataacgattggcctggaagaattcttggttgctttgatcttatctgaaatcggactgtcagtgggacttctttctcaattgtggtaaagctaaggagccgatttcctttgtaactgctgagcagagaccaaggtacaggtctgaaggaacttataaagtcagtattttggaactggatgcagcggctcatacctgtaatcccagcactttggaggccatggtgggaaaaatcacttgaggccaggagtttgatgccagcaacatagcgagacccccgtctctgtggaaagtaaaacaattagctgggtgtagtggtgtgtgcctgtagtctcagctattctggaggctgaggcaagaggatggcttgagcccaagagttcgaggctatagtgagttatgattgtgccactgctccagcctgggcgacagaacaagaccacctctcttt

SEQ ID NO: 21097 - DNA, 6411 bp, Homo sapiens
  misc_feature (5623)..(5623): n is a, c, g, or t
aaagcaagaaagactgctctcggcacttgtgcttttgttagttctacagaagaggcagaaaaacaagagataacaaaggctccgtttcctttctgtgagagaaggcttttgtctttcctcctgctacgatgtcagtgtctggcaagaaagagtttgatgtgaaacagatcctaaggctacgctggaggtggtttagtcatccttttcaaggttccaccaacactggaagctgtcttcagcaggaaggatatgagcatagagggaccccggttcagggcaggttgaagagccactctcgggacagaaacggactgaagaaaagcaacagtcctgtccaccacaatatactggcaccagtgccaggaccggcccctgcccatcagagagccgttcagaatttgcagcaacataatctgatagtacattttcaagcaaatgaagatactcctaaatcagttccagagaagaatttattcaaagaagcttgtgagaaacgcgcacaagatttggagatgatggctgatgacaatatagaagattctacagcaagattagatacacaacactctgaagacatgaatgccaccagatctgaagagcagttccatgttataaaccacgcagagcaaactcttcgtaaaatggagaactacttgaaagagaaacaactatgtgatgtgctactgattgcaggacacctccgcatcccagcccataggttggttctcagcgcagtgtctgattattttgctgcaatgtttactaatgatgtgcttgaagccaaacaagaagaggtcaggatggaaggagtagatccaaatgcactaaattccttggtgcagtatgcttacacaggagtcctgcaattgaaagaagataccattgaaagtttgctggctgcagcttgtcttctgcagctgactcaggtcattgatgtttgctccaattttctcataaagcagctccatccttcaaactgcttagggattcgatcatttggagatgcccaaggctgtacagaacttctgaacgtggcacacaaatacactatggaacacttcattgaggtaataaaaaaccaagaattcctcctgcttccagctaatgaaatttcaaaacttctgtgcagtgatgacattaatgtgcctgatgaagagaccatttttcatgctctaatgcagtgggtggggcatgatgtgcagaataggcaaggagaactggggatgctgctttcttacatcagactgccattactcccaccacagttactggcagatcttgaaaccagttccatgtttactggtgatcttgagtgtcagaagctcctgatggaagctatgaagtatcatcttttgcctgagagaagatccatgatgcaaagccctcggacaaagcctagaaaatcaactgtgggggcactttatgctgtaggaggcatggatgctatgaaaggtactactactattgaaaaatatgacctcaggaccaacagttggctacatattggcaccatgaatggccgtaggcttcaatttggagtcgcagttattgataataagctctatgtcgtgggaggaagagacggtttaaaaactttgaatacagtggaatgttttaatccagttggcaaaatctggactgtgatgcctcccatgtcaacacatcggcacggcttaggtgtagccactcttgaaggaccaatgtatgctgtaggtggtcatgatggatggagctatctaaatactgtagaaagatgggaccctgagggacgacagtggaattacgtagccagtatgtcaactcctagaagcacagttggtgttgttgcattaaacaacaaattatatgctattggtggacgtgatggaagttcctgcctcaaatcaatggaatactttgacccacacactaacaagtggagtttgtgtgctccaatgtccaaaagacgtggaggtgtgggagttgccacatacaatggattcttatatgttgtaggggggcatgatgcccctgcttccaaccattgctccaggctttctgactgtgtggaacggtatgatccaaaaggtgattcatggtcaactgtggcacctctgagtgttcctcgagatgctgttgctgtgtgccctcttggagacaaactctacgtggttggaggatatgacggacatacttatttgaacacagttgagtcatatgatgcacagagaaatgaatggaaagaggaagttcctgttaacattggaagagctggtgcatgtgttgtagtggtgaagctaccctaaagctatctatctttatcaaatggaatgaaactagataatttcaagaaactgagtaggacaaagggagaaagaaatacatgttctttttcctgcaattaataatcagactggaaaattgttgtatcattttaatttgtagttacaattgctttcattcgtgaagccgaaacgtttttaaacatgaattacatatgaattattaagcatatgtgctttcgcagctgataatataaaaggaaatcccacagtctagatatagccccattactacaaaatgctaaaatatttaatgaaaattgatggtggccacagtgtgcaggttataaaagcattaatacatttcaaggtaagagccttaaaagttaaaaacattttcagtttttttttaaaaaacgtactcttattatctggaacatagaaatataaaaggtaacatctaaagcttagaatagtgtgatttttagtaagccattattctcctattcaaataatatcccaaagagctaaacaattccttacatttaccaagaggaaagcttttactgtgttgaagctaaaaaaaataatggctctttgacaaaacttgttatgttgatcgcggtatgtcaaaatttttacaggtttgctcatctgccagagcacacatataaatttggtatttcttaacatattatcttgttagatttgttaccagtaaaatattactgtaatttcatatacacagtctatacaatgaaataatgaatatttatcatattgatacaaactgtgacctcagcttcagagtgtcagggcctcacttgtatagaatgtaatgttctcctcaaacatttatgttaactctataaacaaatatcgttaagttaaacaagttttcaaaaacaaaacaatttttaaagtaccttaaaattgaggatgttactcagtgttaacacatgggaacaccaaaatattcaataagcctggtcaattctatagttatcttttttgtaccaacacatgcttttctgttactgttatattatccagtagaaaatgttaggatatgtgtgctatataaaaaaaaaaaaagacttgttaagttttaaaataacaaaaatggctagttgaatagtattttatgtgtaattcttccatttattctgtttaattatacaactaagatgaaatattgaaaaaccctttgtgaaagtaacttttcaagtaaatgcacaactttagaatttctacaaataagttcttttaaacagtctttttattgtggattgtgaaatcaaaatctggagaaatgcttataaaatatactactagcttttaagttttaagaaagaagaacgtaagttgtacaaagatatttgtactttgacaaactgaatttaaataaactttatttcctctcactatagtgtggctttagaatatatcaagtacaacctgaatggactttttgattttacatttcctatatcactaaaatacttaaacacaaaaataaaattccactcctttatttcttcttacacctgccattgtctctaattctaaagagagagctatagatttctgcagttctagaggtgaagatagagacatagagaggctgtgaaacacacatacagccctgttaggtcttttgaattcacaccttattgaaatcagtgtagaagtagagttacctaaacctttatcgccaatgcacagcttggcctgttaagttaaatgtgggtgtcaaccagtggaaaagatcaaaggaccttttgcagcctagcttgccaatcttccagtaacaacgaggtgctaccaataggcagactgtgtctagagtcatgcatggacaagaggaaagtgaaagttgaatactctcttctcaatggcatagctggacttgattaagtattgactcatagaagagacatgtatgtttcccggggctaccccttcatagctgcatttaaaaatggtgttcaggccactatggctgctgtggtttgaatatttttttccctcgaaaactcatgttgaaacttaactcctaatgtagcagtactgagaggcagggcccttaagaggtgattgggccatgaggtctgtgccctcctgaatggattaatccattcatggattaatggattattatgagtgggggactggtgactttatatgaaaaggaaggaagagtgacctaagctagcatgctcagggtgcaccgtatgtcccctggtcatgtgatgctatgtgttaccttgggacttacctgacagctcttaccaacaagaaggccatcccagatatggcctctcaacctcagacttctcagcctgcctaactgtaagaaattaattctttttctttataaattacccaggttctgttttaagcctcagaaaatgaactaagacaatgccctagatgagctgccaaaatctgagcagatatgagccatcagaatagagacctgcagaggcccagggcactcaaacataactgtgcttgtctcagtcaaacttaattgggaaaaggaggagtaagagcaggccctttctgacatgctttagcagagataacttatcagggctagtttaaacaaatgtgtataggaaaggatgttatttatatattcttacaagagtgtaagggctcacacatttactgtactcagatctgaaagacaatgttgcttcttgatttttttctataatcactatgaccgtgttcacgattccctactctgcaactctcagcatgcatcatgatgattctctaacactgtctgtcaccttcctgtatttccacagagcatgcaagaacttctacaaaacttctataccacacagaagctgaaagagactctggggcactaaattcagatcctttctccacacagcaatgacatttatcaatctgactcaggtgtggctgttgcccctttttgatatggagggaacactgaaagacagtttccttctggagttccaaatgcaatatagaaaaaaaaaccctgtgactctggattttattttaagttctctaacaagactcctaccttgagatcttagtctaggtaaagaaaaaaaaaaaaaggtcatgaaacacaaatgtcctcaactgtcatcattctatgtttactttctcccaatcacatcacctgaggtagaagagatttttcagttgctatttctcttcgtaatgaattttctttacatcctgtccacactgctggagatactaagtcccaacctaaatgatggaaggagcatctcccctcttgtctgtggaagatatcacatgaactacctaattttcaagcatggatctccatatttcaaaggaaagttttnaaaatgtttttaaaacttcaaatatctcaccacagtgaattatgggtaaggtgataatatgtttaattagcttgatttaatcatcccacactgtatacatatgccaaaatatcattttgtatgccataatatatatgatttatgaattatagtaatattaataaaagtgttaaagcttaaaaaaaaaaaaaaaaaaaaaaaaaaattgttgggggggtgggccggaaaagttttaacaacaatcccgttgggggccgcacaggccccagtaggtgctagggtgaacgtctgccaagaacgcggtgttctaagaggaaccaccgcgggccatgaatagggggtgggttcccaccccaaataaaaaaaacggcgcggggggaacacagaagcggctttcgggaaacaactcccagacaaggggaagtcgcgaggacacacagcggcatcctacacaggggtcccagacgaagctcgatataaattaagccgcgcgagggggacaaactacacacagaccaaaacaacaaaaacacactaacccagagaaaaacacaccaaacagaacccacaacagagaaaatacagaaaaagacaagaacacaaccaacacgacgagaaccaaacaagaagagcacataacagaggaaacacgacagaacacagaaatccaggacaacacaaagacaaagaaaaagaagagaaaaaaaaagacaaacaacagaaccaaaagaaaagacaaacgcaagagcacacacccacgaagaaaaaagagacgaagaacaagaacc

SEQ ID NO: 21098 - DNA, 3556 bp, Homo sapiens
  misc_feature (2768)..(2768): n is a, c, g, or t
aaagcaagaaagactgctctcggcacttgtgcttttgttagttctacagaagaggcagaaaaacaagagataacaaaggctccgtttcctttctgtgagagaaggcttttgtctttcctcctgctacgatgtcagtgtctggcaagaaagagtttgatgtgaaacagatcctaaggctacgctggaggtggtttagtcatccttttcaaggttccaccaacactggaagctgtcttcagcaggaaggatatgagcatagagggaccccggttcagggcaggttgaagagccactctcgggacagaaacggactgaagaaaagcaacagtcctgtccaccacaatatactggcaccagtgccaggaccggcccctgcccatcagagagccgttcagaatttgcagcaacataatctgatagtacattttcaagcaaatgaagatactcctaaatcagttccagagaagaatttattcaaagaagcttgtgagaaacgcgcacaagatttggagatgatggctgatgacaatatagaagattctacagcaagattagatacacaacactctgaagacatgaatgccaccagatctgaagagcagttccatgttataaaccacgcagagcaaactcttcgtaaaatggagaactacttgaaagagaaacaactatgtgatgtgctactgattgcaggacacctccgcatcccagcccataggttggttctcagcgcagtgtctgattattttgctgcaatgtttactaatgatgtgcttgaagccaaacaagaagaggtcaggatggaaggagtagatccaaatgcactaaattccttggtgcagtatgcttacacaggagtcctgcaattgaaagaagataccattgaaagtttgctggctgcagcttgtcttctgcagctgactcaggtcattgatgtttgctccaattttctcataaagcagctccatccttcaaactgcttagggattcgatcatttggagatgcccaaggctgtacagaacttctgaacgtggcacacaaatacactatggaacacttcattgaggtaataaaaaaccaagaattcctcctgcttccagctaatgaaatttcaaaacttctgtgcagtgatgacattaatgtgcctgatgaagagaccatttttcatgctctaatgcagtgggtggggcatgatgtgcagaataggcaaggagaactggggatgctgctttcttacatcagactgccattactcccaccacagttactggcagatcttgaaaccagttccatgtttactggtgatcttgagtgtcagaagctcctgatggaagctatgaagtatcatcttttgcctgagagaagatccatgatgcaaagccctcggacaaagcctagaaaatcaactgtgggggcactttatgctgtaggaggcatggatgctatgaaaggtactactactattgaaaaatatgacctcaggaccaacagttggctacatattggcaccatgaatggccgtaggcttcaatttggagtcgcagttattgataataagctctatgtcgtgggaggaagagacggtttaaaaactttgaatacagtggaatgttttaatccagttggcaaaatctggactgtgatgcctcccatgtcaacacatcggcacggcttaggtgtagccactcttgaaggaccaatgtatgctgtaggtggtcatgatggatggagctatctaaatactgtagaaagatgggaccctgagggacgacagtggaattacgtagccagtatgtcaactcctagaagcacagttggtgttgttgcattaaacaacaaattatatgctattggtggacgtgatggaagttcctgcctcaaatcaatggaatactttgacccacacactaacaagtggagtttgtgtgctccaatgtccaaaagacgtggaggtgtgggagttgccacatacaatggattcttatatgttgtaggggggcatgatgcccctgcttccaaccattgctccaggctttctgactgtgtggaacggtatgatccaaaaggtgattcatggtcaactgtggcacctctgagtgttcctcgagatgctgttgctgtgtgccctcttggagacaaactctacgtggttggaggatatgacggacatacttatttgaacacagttgagtcatatgatgcacagagaaatgaatggaaagagagcatgcaagaacttctacaaaacttctataccacacagaagctgaaagagactctggggcactaaattcagatcctttctccacacagcaatgacatttatcaatctgactcaggtgtggctgttgcccctttttgatatggagggaacactgaaagacagtttccttctggagttccaaatgcaatatagaaaaaaaaaccctgtgactctggattttattttaagttctctaacaagactcctaccttgagatcttagtctaggtaaagaaaaaaaaaaaaaggtcatgaaacacaaatgtcctcaactgtcatcattctatgtttactttctcccaatcacatcacctgaggtagaagagatttttcagttgctatttctcttcgtaatgaattttctttacatcctgtccacactgctggagatactaagtcccaacctaaatgatggaaggagcatctcccctcttgtctgtggaagatatcacatgaactacctaattttcaagcatggatctccatatttcaaaggaaagttttnaaaatgtttttaaaacttcaaatatctcaccacagtgaattatgggtaaggtgataatatgtttaattagcttgatttaatcatcccacactgtatacatatgccaaaatatcattttgtatgccataatatatatgatttatgaattatagtaatattaataaaagtgttaaagcttaaaaaaaaaaaaaaaaaaaaaaaaaaattgttgggggggtgggccggaaaagttttaacaacaatcccgttgggggccgcacaggccccagtaggtgctagggtgaacgtctgccaagaacgcggtgttctaagaggaaccaccgcgggccatgaatagggggtgggttcccaccccaaataaaaaaaacggcgcggggggaacacagaagcggctttcgggaaacaactcccagacaaggggaagtcgcgaggacacacagcggcatcctacacaggggtcccagacgaagctcgatataaattaagccgcgcgagggggacaaactacacacagaccaaaacaacaaaaacacactaacccagagaaaaacacaccaaacagaacccacaacagagaaaatacagaaaaagacaagaacacaaccaacacgacgagaaccaaacaagaagagcacataacagaggaaacacgacagaacacagaaatccaggacaacacaaagacaaagaaaaagaagagaaaaaaaaagacaaacaacagaaccaaaagaaaagacaaacgcaagagcacacacccacgaagaaaaaagagacgaagaacaagaacc

SEQ ID NO: 21099 - DNA, 267 bp, Homo sapiens
gcttcacccctgcccctctttgtctaggcacagtggagttcctctgatccccaaaccgatgttccttcacattgctgtgcttactattctaatgtccttttatttctctattttcaaaaaatgcattctacttggtagttttctctctatggaagcttcatctgaagacttctatcttaaaacaaatttttctcttttttttaactccagaaaactttgttctagtatttaccatatttcattgaaatgatacaataattcacacag

SEQ ID NO: 21100 - DNA, 358 bp, Homo sapiens
caccacagcggcaggcctggcgtctccgctcttttcccagccttcctctcagtcttgttgctgcatggtcacccgtcgactgccattgctccagccattatgtttgcattcaagatagaaagagaaagaagggggaaggaaaaaagcccacctaatagccactctctctctttaatcagataaagcacgtgttttcccagaagcccccagcagacttctgcttacatcccattggccggagcctgtcacatggccagccccagctgcaagggagcctggggaagcaaatggcagaggagaaggatgttggggtattggctaagttagccagggaacagggtctgccataccaagtctc

SEQ ID NO: 21101 - DNA, 337 bp, Homo sapiens
tcaagatagccctatctaaccttatttccagattatatggacaaatatgctcttactagggtaacaaaaacttatcttctctttagctcatgtcaaaagcagactgagaaggaactctttatccaagttaagtgaaggttggtgtcaccacacctctagtctttatctaaagtgttaagtcatcaggaagttgaatcacacttagtttaacctttattgagttattgaaatggtgcccttggcttttatcaatagaaaagccacataaaaacttcttccaattctccttcaattattttgcccattatattatagagtttgctatgcaaaaaaaaaa

SEQ ID NO: 21102 - DNA, 438 bp, Homo sapiens
aaaatcccattctctcctcagatctgagaatatgagggtaattcttcaaaggttgtacaaaccaaacaaaaaatcctctcatttgagtatctatttgcacccaaatgggcccaatcaccaaccatttaatattatttactaattatgtcaactgtatgccgaggcattgttagggttaaaagagtataagatattatttctcctctaagtctttagtgaaatacattccccaaaagctcagcatagatttatgggtgtcactttgaagcttaaaatccttcaatggctttcagtcattttcatggtgatgttcaaaatctttgcagtgacatacaaggtaccacctgcctttccaacctcatctcctcctgttccccctcctctgggttgtttaagtagattgtcctcatcagcacccacctaatcctggtctattgg

SEQ ID NO: 21103 - DNA, 458 bp, Homo sapiens
gccatcaaactccaaaccatcacgcaaccagactggagcctcaaacaataaccttttttgccaggaaccctttcataggcccctgagggagatcagactgctgttttctgaaaacagtaccctctgtcagcaggaagcagttaagattggtcttcatccttatctttattctaacggcagttagatgtacttctttaggtgcaaaatgatagatgcaggaggcagatgagggaacctacccagggcattgtatgtgtatgcctgcaatggactagggacccacctgcacactggaagggtggggtggagccactggaacatttacactttgcgcagaagggaggagcctggcatcttcagttcctgtgtggttgcctggtgttcaagattccctcttgctttgctgagagttgtttttccttttcacccaataaattctgctgcttatccatcagtgt

SEQ ID NO: 21104 - DNA, 347 bp, Homo sapiens
tcaacccggaagtctgagttagatagaggccaaagtgttggctaaaacctctttgaaaaacaaacgttgagttttgtgctatcttcaagagtccacagaacttctgaaggaatgggttcgagctactctacaagtaatttatacaaagacagaatcactaattttaggggtggtgtgtgtgtgtgtgtgtatgtgtttacctccgccctttggagggagccttctgggtacccgctgatgggtcctgctttgatgtgctttgagctttggttacactgatgaattaaacatttgaatggctttaatcaagttttaaatgtgttaaaaaaatacctttcccccatttt

SEQ ID NO: 21105 - DNA, 408 bp, Homo sapiens
agattcggaacgaggcaaacaaacaagaaacagaactttcaaggcattctttgtccagtcattcttccattatttgccacacccctacagctgtacaaaatgatcagccctaatacagttgttaaaaatattaacctgaaaatactacaggaatttcattataaaaataacataaacctatggtaacaagaaaagcatttagggtctgtcttacaaacttgaaacgtttccagattttcttgtaattataatacctatctctgctaatatatagtagaaccactgagctgttccttgattgaagtaattgacaagagtctaaattgtggtggttctcttctgtacactaattctactaaggctagacatgtaacaatgcatagatttttatacatatgcagcatactc

SEQ ID NO: 21106 - DNA, 849 bp, Homo sapiens
tctcatccacactacccattgcaccaggtgttggcacccatactcagctgttcttaggtcaacagttagagtatttctgagtcttacatattttcttgacttcattttgttgactacctcgtccattgaaattttcttcctgcgcacacctgtaatcccagcactctgggaggccaagacgggcagatcacttaaggtcaggagttcgagaccagcctggccaacatggtgaaaccccgcctctactcaaaatataaaaattagccaggcgtggtggcgggcacctgtaatcccagctacttggggaggctgagacaggagaatcacttgaacccagggaggcagaggttgcagtgagccgagattgtgccactgcactgagccgagattgtgctactgcactgatccagcctgagcaacatagcaagactgtctcaaaaaaagaaaaaaaaaaattttcccattgctggttttcccattttctttttgaccttcccacctaccagtctttgttcccccatccttgaccctcttctccatgtggataccgttgatacacttttaggtttgaatatcaccttccttttagaatgttccatacctttaagcatttgataaaagctatggtggtttccccagaaaaatgttcaacaggaagttttgcctacatttttggattcacagacctcagttcctatggcagtgttcatatacgtaagttcagctgttacgtgtttacaactcaaatccaatggctaccagttttcccactggacctctctggatttagcaatctctaaaattgtattcacttgattcttaaaaaaataaaaaagcttaaatgcagat

SEQ ID NO: 21107 - DNA, 469 bp, Homo sapiens
acctcggctcactgcaacctctgcctcctgggttcaagtgattcttctgcctcagcctaccaagtagctcagactacaggcgtgcgccgccacgcccagctaatttttgtatttttagtagagatggggtttcaccacgttggccaggattgtcttgatctcttgaccttgtgatctgcctgcctcagcctcccaacgtgctgggataacaggcgtatgccactgcgctctgccgtcctttccacttctaaactaaattatattttggaattttcccttatgaaaatagtatttttttgttgttgttattggtagtcactcacctttttatcaatggatgacattttaaaaatgttttcccaggaaaaaatggtaccatttaaataatactttttgtttagtccctaagatctggccctgaaagcatttacaagtttgatagaagtaagaattttagtaaaaatggaaa

SEQ ID NO: 21108 - DNA, 668 bp, Homo sapiens
acttgatcatgcgtgacagggacttaagaaagcccctaattatagccgtgtggggtttgtctcccttctgaagcttggcgcccgtgtgctcaaggcaagggcgtgaccaaggtaagagaccccttctctcccttaggcagaagtcctagcagagtatgcccacgctggttagtgctgctgcaaagatgagccgaagaccatgagagacctccaggtggtccttctggggagaagaaatgggttttggccccaaatccttctgctgcatttttcccctatccctgggaagccatgagacctcaaacctgtgttcccaaggaggcgagctgctgttcccaggtgatgatatgatgtgcttggggaaagtaagtggctgccagacatggctgagagctgttgtcactgccgtcaagtgcatgtctccaagccatatcacacggcgtccctcgatgtgaggccacatggcaagtgggccgtggatctccctctgccctttgcaagcacgtaagacagcagattttgcagataccttgtggcgcaggggaatttcctttggccaggtctgaagaaataaagcagcaggcaccgagaacaaagccaaggctttcaaaagacaaggagccaaaaaacttactcaaaataaaagtagttttaaaatgtctctgcca

SEQ ID NO: 21109 - DNA, 378 bp, Homo sapiens
ataactaatatcacaatctttgtcgctatttgttacatgcctttaattattaagataccatgaataatttatgaactctgatgctaagaaatcctgtcccttctagtttctaccaccttcagattggagtttgcatgagcacaatagcctcagctctagaggtaatgtttttctccctctgcaaaatcaacacaattagattacttccttagtgatattattatggtgttatttcaatatttattataataatagatattgctattttaaaaaagctggtattttctgtttccatctgtgaaataggataatgtaaacaccacattaatacaagcatttatataaagtttgtgactataataaatgccaatcctgaga

SEQ ID NO: 21110 - DNA, 335 bp, Homo sapiens
caattatggaggcaattttaaaaataaatgcagaataaacatttcatttgaaacatttgttaataaatacatgaattaattaagcacaaccattaagatcctaattaccatgtgatgggaaggaaaaagggtcaaatagatctgtaactgctaactctttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttg

SEQ ID NO: 21111 - DNA, 550 bp, Homo sapiens
tgggattctatgttaaataataaatcagtttctcacgttgcagaggcaactctagagaatgtggttggatgaaattttctgaataattcattcaggtctagtttacattgaagaaaaagaggtttagggtacttttccttcattgccatgaatcttatttctctctctttcttacaacacacccaactaggtcttgtcatgccaggaaacaaacagctacaaaagctgattttttagatgtaaaagttagtaatgatgacccaaattaacttcgataaaacactatcttctactggaacgtaactcttaaacatgacttatactgaaccaaactgcctaaaatatggaagagtggtgttgtttggagatttacttatgggtcatgttattatttactcttaagatatagaaaccatgtaagcacaattatgatagaactatcaattagtgttttctaccattgcaaagggaaataaactaattgagaataaaaaataggcatgattattttattatgtgtagaattttaattttgaagggcaatttatga

SEQ ID NO: 21112 - DNA, 465 bp, Homo sapiens
tccgcgctcctgggcagtggggaagctttagtgagcaggcttttctctccgcagcaaacttgtagcccagacccagatgggccgccccagctctctcgggactaggcaggtgcggttgagttaatttttccgcattacaaagaaagatgaccccagcccgcccttggactctcttttccccaaaatctcccaaccaaacccgcggtaacgttatcaaaggacacagagcccaggcatatctgtgtgtttatcttacaggcacacacgcatggttttctcttttatatgctagatttcatccctgacagcagaaaatgattggcaatggttctgacggagaacatgcaatagcgtggtccttaaaaacctgccattccttacaagtgccttagaaaggattcagggcgaaccaactgggttaattgcattcagtaaaataacacgattacaaaaaaaaaaatgtac

SEQ ID NO: 21113 - DNA, 574 bp, Homo sapiens
gctgggactataggcatgtgccaccacgctcagctaattttttgtatttttagtagagacggggtttcattgtgttggccaggctggtctcgaactcctggcctcaagtgatctgctggccttggcctcccaaagtgctgggattacaggtgtgagccaccgagcttggccaagtgcttaaaatagttaatgctaatgccacagtccaatttaaatcttttcttagttctcaactttccttaatcttaaagcagcattcggttctgagcagctacactcagtctccactaatggctgctgagactatgtttcctctctcaattctctgatctatttgctttcttgtcattccttgttttttgtgtgtattccttgacttacctcttctcctgtcttcattaattaggttaattttggggccccatggtgtttcacgtaaaaagatttggctgggcgtgatggctcatgcctgtaatcccagcactttgggaggccatagtggaggatctcttgagcccaggagttccagaccagcctgggcaacatagcaagactctatctacaaaaaataaaa

SEQ ID NO: 21114 - DNA, 371 bp, Homo sapiens
tcattcaacaactatttctcaacctctcactttgtgctgggtaccgttctaggtgattcagcagtgaataaaagaaaaaaagttatttgtccttaggaatcttgcctgctaatggggaatacagatgatttttttaaatcgtgaaaatgctaagagagaagattaagtgggaagggagctctaagatatcatggtgtatgctgaaattttagcaagggtggaccatgcataaattaggaaatttctaagaattagaatacacaaaaggctgtggtatttaataccattcacctagtagagcacaaagaccatttgtggggtatgagggaaactgaaatctaggtctcgctttgtcacaaattcattgggca

SEQ ID NO: 21115 - DNA, 156 bp, Homo sapiens
cacccgatacacaggcagacacactcaggtagaaagcacagatagacagacacagaagacaccaagatgggcatgcaggcacagacacagactcagaagcactggcagaccctctggggacactccagggcagagtcatgcacatacagggagaca

SEQ ID NO: 21116 - DNA, 877 bp, Homo sapiens
cttgttttggttaaaaagctttggatttggtacaacttttgtcatttcaaaatttaaatcaggaccagcactttttcctttttgttctttcttcttccgagatgtttctgagcatcagggagggaaagtgtgaggttttcaggcatgccaacaagcccgtggggaatctggtttgacactggtctgtgagctacaaggctgaagtgtggcctttctgtgcaacctgctggcatctgctgctgaatccctccagctaatataacccagagcctcctctctgtcttcagggactttggccatcatctcttgtttcctgcactccagatgcccttgggtttgattcccactaggaccctcggacaactccagttaaaccttcagacccaagaccacttttctggcaggacctctagcatgtttcccagccagaatctcaacttctttctaggcccttcctgggctacatgggaatctctagattacttccatgctgggcacagtctgttggtgcaaggttatgccaggtggagtggcaattggtccctgatgccaagcagagaacatggcaaaagttcctctgctcccagctttccactgagcctatcaaacacctatcacatctggaatttgaagcatgaatgacagcctcctgactgtgtctcacaatccccagagctgaagaagttgactttatcccccgttccccaattcctctatgacaagaacttacaacattccctctaactatagcatacaataaaactctatgatatacttggcaaagtctcactcttagtatgaaaatagatgattaaaacaattagaatatcatgttcccttatgttccctttctctaaattatggatttgaaaactag

SEQ ID NO: 21117 - DNA, 352 bp, Homo sapiens
attaaaagtaataattaaaatttgaacatctccaaataaaacttgaacttgggaccttattaacaataaaacatcagcagctttctctgcatgttgatctgaccagtcctggccacttttagtggctagtttggggaattagcctgacttcctggcgggtgtggcttcctggaggggtgtggcttcctggaggggtgtgacttcctggagggggcatggctttggagtctgatcaccctggcttgagtcccgccccgccactaactagctggctgaccttgggggaggttatgtgatctgtctctgcttagtttcctcatttgaaaaaaaggaatagtaatgcctactcaga

SEQ ID NO: 21118 - DNA, 324 bp, Homo sapiens
aggtgggaggtactgaacacatcttcctaatcggcttatgtttaattcttacaatattctcatattcattcttatacttcatgcttttgtttatttctcagcagtgaatgccaggcacagtgtcggtcctggaaaaccgcaggtgatttagacgtagaacctgagctgtacaactatctatggctcacagcctatgggggtaccgactgatcaccagccaatcataataaatgtggcacagaaatgacaaagacttggttataatttggttcataaatcattagtatcctatcatcaatttgaagcttcttggaaagtctaatc

SEQ ID NO: 21119 - DNA, 382 bp, Homo sapiens
ttctttttctctaacttcctaagtgattgtgattatacacccctaggagaaatactgatcctcttgaaccccgtaacttctgaaatgtaaaagctcgaggtcacaggctaattggaactaaagctgctaataataggaagtgaaatattttttccattaagccatattgcaaattttctaaagctcttgattaaccaaattcaactgcatccctgactcttacaatatttgcaatgctattgctgtcttattctgaaaagttctttcctggatgggtatagtggctcacacctgtaatcccaacacttcgggaggcagagatgggaggatttcactatgttgcccaggctagtcttaaactcctggccttgagcaatccgtc

SEQ ID NO: 21120 - DNA, 539 bp, Homo sapiens
gaattattatgagccctgatcagcgcactttgccctctcataacgtctatttattcgtctgtataatggaataatagtggctgctgttaaatgaattaaatacgacggcgtttggagggaaacattactactccagttttacagataaggaaactgatgatcaggtgcttgaagtgacttccgaagatcaggaagacagcatatggcagggacaggaacccacgcctacgccccagcctctttttaccgaaccttgttcttcaggaagtggttaaaacacctgggctactcccagcaaaacgccagtcacgcagtcctgaaacaggtcctttaaggtgcccagcccaacacaggctgggcgtgctgagccaacagaatgtttgttcctctgtcccttcctagaaccccaagtcacctttctccagccagttaaaaacgttacttttaactaggatgacgtttcaatttatcggccatatccaagcatttttgagaatgaactgtgagacatgctattaataaattaaccatgaacagca

SEQ ID NO: 21121 - DNA, 669 bp, Homo sapiens
gaattattatgagccctgatcagcgcactttgccctctcataacgtctatttattcgtctgtataatggaataatagtggctgctgttaaatgaattaaatacgacggcgtttggagggaaacattactactccagttttacagataaggaaactgatgatcaggtgcttgaagtgacttccgaagatcaggaagacagcatatggcagggacaggaacccacgcctacgccccagcctctttttaccgaaccttgttcttcaggaagtggttaaaacacctgggctactcccagcaaaacgccagtcacgcagtcctgaaacaggtcctttaaggtgcccagcccaacacaggctgggcgtgctgagccaacagaatgtttgttcctctgtcccttcctagaaccccaagtcacctttctccagccagttaaaaacgttacttttaactaggatgacgtttcaatttatcggccatatccaagcatttttgagaatgaactgtgagacatgctattaataaattaaccatgaacagcaggttcaaacctggatggatagtcatcctacttataactgaaagtatccttaaatatctttagaatccggatgagcccacttagtttgcaaaccgaggtcaataaaactgacttgaaataggaagtaatta

SEQ ID NO: 21122 - DNA, 615 bp, Homo sapiens
gaattattatgagccctgatcagcgcactttgccctctcataacgtctatttattcgtctgtataatggaataatagtggctgctgttaaatgaattaaatacgacggcgtttggagggaaacattactactccagttttacagataaggaaactgatgatcaggtgcttgaagtgacttccgaagatcaggaagacagcatatggcagggacaggaacccacgcctacgccccagcctctttttaccgaaccttgttcttcaggaagtggttaaaacacctgggctactcccagccaggctgggcgtgctgagccaacagaatgtttgttcctctgtcccttcctagaaccccaagtcacctttctccagccagttaaaaacgttacttttaactaggatgacgtttcaatttatcggccatatccaagcatttttgagaatgaactgtgagacatgctattaataaattaaccatgaacagcaggttcaaacctggatggatagtcatcctacttataactgaaagtatccttaaatatctttagaatccggatgagcccacttagtttgcaaaccgaggtcaataaaactgacttgaaataggaagtaatta

SEQ ID NO: 21123 - DNA, 443 bp, Homo sapiens
caattacagttcaggtttttctaccccatactggttcccacaaaggtttctgctcaagggtttctgctgcagtaatttgtgattctaagtattttcttgtcagtctttccaatttaaggggcagtaaacctcacttctctgatggatctaagagttgttaattaatcagtttgttcagccttttatttgttgttaggatgtagtgacaacttccaagctccttacgtactggattgcaaaccagaagtcaaactattccttagaaatgaaggggaagtaaagtcattttcagatgacaggatactaaaagaatatgtcaccagaagacttgcccttaaggaatgactaaagcaagtgctcagaacagaaaggaaataataacaaaagacttcaggacctcaggaagaaagaaagaaaagtggatatgaccataaaatgtaatc

SEQ ID NO: 21124 - DNA, 401 bp, Homo sapiens
gactggggcgcggggaaccgcggtcttggggagaaggatggggaggcggatggagtgctggtcggaagcgggcattccggggtccccttctcagagttccctaaagccagggtgccgcgccccctgccaccaggagggggtagtctccccgaggcgccgccggccctcccactccccggctggctccagaccacccctcccctccggcccccccgcatagtccttcagtcccgtccggggcgcccagactgggggttgcccggggcccccatccccaatctccgggttgagaggcgaagccaggaaaggcgggtggcgggtaaggtcggacaaggggtcagacagaagagggagcagctgggtgggaatgggaaagatgagcccggagagttggacctgac

SEQ ID NO: 21125 - DNA, 170 bp, Homo sapiens
ttatacctcaaattttctattaatacactattttttagaaaatggagacccaagccaccatcactgtagttccaggtaacagggacgctgaatggctggctttgccttatctcattgttggtctctgggtcaattaggataagaaatttgattttttttttagcgtcaca

SEQ ID NO: 21126 - DNA, 927 bp, Homo sapiens
ctatatcttctaaagagtgggaaattcatcctctggttttgctaacttttttggaggtaagcaggaaataattaatgggcctcttttgcagttaggaaaatttaagtcagcattcagatgatctagagatgagctcctgaccttctgaatctcaactattaggaatccttgaggtaaatgtaaactttcaatgatacatttgaacacatttttgccaccattgccttatgttttttttgttccaggtggaggccagttactgcttcaacctaaagtcagccttcaacctaaagtctgttatattttaggcacatgcatatacaggttcaccagcttccttcccctctgtctccaacatggttaccacccctttcaccaccctggttagctcagcaataacagaataagaataaggaaacctaggacagtctggcgtgcttagcgccacttctgatgcagaatgttgcaatcccagggctgttgaaataactccccagcccatatcatatgtaaaaaaaaaaaactgttaaagtcttgacgtttaaagtcccaactcttccacaaaaatgacagttttggtcagacagtggttcctgaaataaataggaagaatggcggcgagagaacaggataggaggtgcctgtgacactctgcagttggcttaggtttgatactctgatgagaacatgctttggagggattcccatgattgaggaaattttactctgcctgttgagaatcattttttccatcgcatgggtggtgactggtaggcacttggatggatgtccagttttgccctaagtactgcatttttgagctggtactattggtgtatataataggagcccccatttggaggtgatgtcaggtggactctactgtatgatagtcactgattcttacctctgtttttctcttttttt

SEQ ID NO: 21127 - DNA, 4887 bp, Homo sapiens
atgttccgcttccctatggggctcctgcttggctctgtgctcctggtggcttcggccccagccactctggagcctcccggctgcagcaacaaggagcaacaggtcactgtcagccacacctacaagatcgatgtgcccaagtctgccttggttcaggttgacgctgaccctcagcccctcagtgacgatggggcttcgctcttggccctgggggaggccagggaggaacagaacatcatcttcaggcacaacatccgccttcagacgccacagaaggactgcgagttggcaggcagtgtccaggacctcctggcccgggtgaagaagctggaggaagagatggtggagatgaaggaacagtgtagtgcccagcgctgctgccagggagtcactgatctaagccgccactgcagcggccacgggaccttctccctggagacctgcagctgccactgcgaagagggcagggagggccccgcctgcgagcggctggcctgccccggggcgtgcagcggccacgggcgttgcgtggacgggcgctgcctgtgccatgagccctacgtgggtgccgactgcggctacccggcctgccctgagaactgcagcggacacggcgagtgcgtgcgcggcgtgtgccagtgccacgaagacttcatgtcggaggactgcagcgagaagcgctgtcccggcgactgcagcggccacggcttctgtgacacgggcgagtgctactgcgaggagggcttcacaggcctggactgtgcccaggtggtcaccccacagggcctgcagctgctcaagaacacggaggattctctgctggtgagctgggagccctccagccaggtggatcactacctcctcagctactaccccctggggaaggagctctctgggaagcagatccaagtgcccaaggagcagcacagctatgagattcttggtttgctgcctggaaccaagtacatagtcaccctgcgtaacgtcaagaatgaagtttctagcagcccacagcatctacttgccaccacagaccttgctgtgcttggcactgcctgggtgacagatgagactgagaactcccttgacgtggagtgggaaaacccctcaactgaggtggactactacaagctgcgatatggccccatgacaggacaggaggtagctgaggtcactgtgcccaagagcagtgaccccaagagccgatatgacatcactggtctgcacccggggactgagtataagatcacggtggtgcccatgagaggagagctggagggcaagccgatcctcctgaatggcaggacagaaattgacagtccaaccaatgttgtcactgatcgagtgactgaagacacagcaactgtctcctgggacccagtgcaggctgtcatagacaagtatgtagtgcgctacacttctgctgatggggacaccaaggaaatggcagtgcacaaggatgagagcagcactgtcctgacgggcctgaagccaggagaggcatacaaggtctacgtgtgggctgaaaggggcaaccaggggagcaagaaagctgacaccaatgccctcacagaaattgacagcccagcaaacctggtgactgaccgggtgactgagaataccgccaccatctcctgggacccggtacaggccaccattgacaagtacgtggtgcgctacacctctgctgacgaccaagagaccagagaggttctggtggggaaggagcagagcagcactgtcctgacaggcctgaggccaggtgtggagtacacagtgcatgtctgggcccagaagggggaccgagagagcaagaaggctgacaccaacgccccgacagatattgacagccccaaaaacctggtgactgaccgggtgacagagaatatggccacggtctcctgggacccggtgcaggccgccattgacaagtacgtggtgcgctacacctctgctggtggagagaccagggaggttccggtggggaaggagcagagcagcacagtcctgacaggcctgagaccgggtatggagtacatggtgcacgtgtgggcccagaagggggaccaggagagcaagaaggccgacaccaaggcccagacagacattgacagcccccaaaacctggtgaccgaccgggtgacagagaatatggccactgtctcctgggacccggtgcgggccaccattgacaggtatgtggtgcgctacacctctgccaaggacggagagaccagggaggttccggtggggaaggagcagagtagcactgtcctgacgggcctgaggccgggtgtggagtacacggtgcacgtgtgggcccagaagggggcccaggagagcaagaaggctgacaccaaggcccagacagacattgacagcccccaaaacctggtcactgactgggtgacagagaatacagccactgtctcctgggacccggtgcaggccaccattgacaggtatgtggtgcactacacgtctgccaacggagagaccagggaggttccagtggggaaggagcagagcagcactgtcctgacgggcctgaggccgggcatggagtacacggtgcacgtgtgggcccagaaggggaaccaggagagcaagaaggctgacaccaaggcccagacagaaattgacggccccaaaaacctagtgactgactgggtgacggagaatatggccactgtctcctgggacccggttcaggccaccattgacaagtacatggtgcgctacacctctgctgacggagagaccagggaggttccggtggggaaggagcacagcagcactgtcctgacgggcctgagaccaggcatggagtacatggtgcacgtgtgggcccagaagggggcccaggagagcaagaaggctgacaccaaggcccagacagaactcgaccctcccagaaaccttcgtccatctgctgtaacgcagtctggtggcatattgacctggacgcccccctctgctcagatccacggctacattctgacttaccagttcccagatggcacagttaaggagatgcagctgggacgggaagaccagaggtttgcgttgcaaggccttgagcaaggcgccacctaccctgtctcccttgttgcctttaagggtggtcgccggagcagaaatgtatccaccaccctctccacagttggtgcccgtttcccacacccttcggactgcagtcaggttcagcagaacagcaatgccgccagtggtctgtacaccatctacctgcatggcgatgccagccggcccctgcaggtgtactgtgacatggaaacggacggaggtggctggattgtcttccagaggcggaacactgggcagctggatttcttcaagcgatggaggagctatgtggaaggctttggggaccccatgaaggagttctggcttggacttgacaagctacacaacctcaccaccggcactccagcgcggtatgaggtgagagtggatttacagactgccaatgaatctgcctatgctatatatgatttcttccaagtggcctccagcaaggagcggtataagctgacagttgggaaatacagaggcacggcaggggatgctcttacttaccacaatggatggaagtttacaacttttgacagagacaatgatatcgcactcagcaactgtgccctgacacatcatggtggctggtggtataagaactgccacttggccaaccctaatggcagatatggggagaccaagcacagtgagggggtgaactgggagccttggaaaggacatgaattctccattccttacgtggagttgaaaatccgccctcatggctacagcagggagcctgtcctgggcagaaagaagcggacgctgagaggaaggctgcgaacgttctgatggcccgtgtgagcagtcctcgcaggagacaccaccagctgtggcagcttggggcggggtgggtagtggtcactgcggtctgggagtgctcagatagcccgcagaacaaatcatgtcaccaagcttcaagccatggaggttccttccctctcacctgcatttttgcccgtctttatgagggtcttgaaaatcaaaatagtagttgcacagtatgtgtaggaaagacagtactggaacggcaaggtttctcagcttatcttcagcaacatatatactggattagggcaagagaaggaatcacccagcacttcaccagttggaaatctctggaaatttacatctatgtatttaaagttctgctaatgcaaatcttttctctggaaagaagcacagaggaggagttctgatgacccaggggttagggctgagacaaccggacgtttgtcacctcctttcccattgggtttttaggaaaacagtgtgaacctcccccttttaatttctggtgttatgaggaagaataaaggggataaaaggggctaagatggactcatgtttagctaagttctgacttgtatccagcatgctggagaccaaagctgccgccttactgctatttttaagtgccctcttttcagtcatttgcataattgcgtccatagagctgcatatgttgtgaataaattctcactcatttcaactttgaataatttgactgtcttgataattggttcctcccaaagactcttctgcaactcccattcatgcccaccaggcctcagactccctcttttccccgccctgcactattggagccctgggttttgtgggagtgctcagcaccgtgagtcttactgtttgatcggacagttagcaagatcagatcctttttgcttattttctatcactttggagggttttctgtagcaaaatcagtgaccaatgaagtaacttaaattcctattgaagaaaaaaaataataaaccacttgatttaaaaaaa

SEQ ID NO: 21128 - DNA, 1300 bp, Homo sapiens
ccttggcctcccaaagtgctgagattacaggcctgagccactgaccctggccaaattttttttctactagctactgaggctgccacatctggatggaactgagtggagggggaaaagaatgaaaaactcaaaagaattcccatgagggtgtcttgctttctctcctgagttacaatactttagcaaaatcatgaggctttagagatatggtgtagtctgcaaacttcttaatgcccttacccacatttaccatgtttcctggccttcctctgtgtcaactcttagctcttcctaatcattatttaatacatgagtgagtttagtagtgatcatatttctcaggtcctttagaagctggaattttaaaagaattagaaggaggagtatgtgaattctttggagctcactgcctgacttgcttatgaccaggaaaatctatcccctgtatctaattttaatttcatggttaaatttgagaattgtggaaaccaagttccacaaggctattctcatatttctcccaatttctttttcagccaactccaaggatatgtatcacctttgacttaatttgctttctctaagggaaaggggaaaaaatgttcacatagctccactgcaatgttttttataatagaggagagatattgtaaatagagactgccagccagtttccacaaaaaaacgaagagttcataaatttgacatgtttgaacccataaagcattttctttgcttggaaccattataaaagtaagtgagttttcaggctctatatacattttaattcctcacgttttatattggagagttcggtacagactgtccattactgcaccaaaagaatgagtgaactgttacctatagggaaagaacacttcttcttcctgctgtttgggaaccatctcagtgtggcgtaatggttaggagtacagattccagatcctgtttcttagatttaaatcttgactctgccacatactagctgtctgactgaaccttggtttttctgtgcttcagtttcctcatctgtaaaacggagataacagtacttacctcatagagctgttgtgaaaagtgatgactgaatatgtaaaagcacctagaacagtgcctggcacatgctaagtgctttgttcattattgttgttattatgtaattttctctcagactgagagcactgttagtgacccaagtaaatttatagtttttaagtacagaggaaaaataaagcctattttttgttaacagtcttaataaataataaaatggaataaagaaaccaagaccccaaaaaaa

SEQ ID NO: 21129 - DNA, 353 bp, Homo sapiens
gcacccctttttcctccccagtaaatcatccagagagcaagtttgctgacagcagatgccaagacaattgtctttgcacctccagggctgctacagagtcagagccaagtccctaagcctaattagatgtctccccatacaaggcttaaacaagcacatggggaagccaggtctctgatgagtaaagaaagagaacacaggctatatcagggtcatgtggacaggcattggtcacagatacagatgactcattttcagtctgagatgttgaaagaaatggaaatgactcccccatctcccaacctccagccccacattcagtgtctattgtcattggtttgggtctgtctggg

SEQ ID NO: 21130 - DNA, 1498 bp, Homo sapiens
cttaaagcgaagtgggaaatggctgaagacatggaaaaagaaatacgtcaccctgtgttccaatggcgtgctcacctattattcaagcttaggtgattatatgaagaatattcataaaaaagagattgaccttcggacatctaccatcaaagtcccaggaaagtggccatccctagccacatcggcctgtgcacccatctccagctctaaaagcaatggcctatccaaggacatggacaccgggctgggtgactccatatgcttcagccccagtatctccagcaccaccagccccaagctcaacccgcccccctctcctcatgccaataaaaagaaacacctaaagaagaaaagcaccaacaactttatgattgtgtctgccactggccaaacatggcactttgaagccacgacgtatgaggagcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactatgagacccagaatcctaagtgggccagtttgaacttgggagtcctcatgtgtattgaatgctcaggaatccaccgcagtcttggcacccgcctttcccgtgtgcgatctctggagctggatgactggccagttgagctcaggaaggttatgtcatctattggcaatgacctagccaacagcatctgggaagggagcagccaggggcagacaaaaccctcagtaaagtccacgagggaagagaaggaacggtggatccgttccaaatatgaggagaagctctttctggccccactaccctgcactgagctgtccctgggccagcacctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcacagctcctgatctggtacggggtggacgtcatggcccgagatgcccacgggaacacagcgctgacctacgcccggcaggcctccagccaggagtgcatcaacgtgcttctgcagtacggctgccccgacgagtgcgtgtagtatctgttttatttgactgcagtctccttggtgcaaaaacaaaatgggaaaaataaggataactcagaatttcaaaaggaaatcacaaattcagctagtaatagcattttcagtacttttcataaactaagtaaatacacaaaatgttgatttttctgaccataagacatattttatgtccttttgccaaggtggatgtgttagtctcaggccctcctggccacattgcccaagtcacacaggcttctgtattatgtatttagataaaatgtgtgaaaatatatttgaaaaaaaagttcataa

SEQ ID NO: 21131 - DNA, 302 bp, Homo sapiens
gtcaaggaaggggctttggggttcaactcagccccctcaaaaggacactgtattttcatccccccgcctgatttctcctctgaggagcagctccctgggtggtatgcggcagatggtgggggtacctgttcccaattccctgcataatctgagctgccctggaatgggaagagtccagaattaggagatatataacaagaaggaattagggactcagggtgcaggggaggggtggaggaagtcaataactaaaacctgagttgtgtcctaagttctaaggaagagaagtgaggcaaggagaa

SEQ ID NO: 21132 - DNA, 367 bp, Homo sapiens
agtagagacggggtttcaccatgttggccaggctggtctcgaactcttgatcttatgagccacccacctcagcctcacaaggtgctgggattacaggcgtcagccactatgccaggcccaagagggatggtttttgaggtggttgtttgagatttattctgaacccagggagtctgttcttagctatttcactggtccttgtcctctttggtaacctagttagcctatgggttagctaatatcactgtcaaatctaccggtccttcttttttatggctgtgtggtgggggaaaaaaaaaaggacaaagctatcagtgtttaactccaataaatattcagaaagaaaaaaaaaagctatcaatgtcct

SEQ ID NO: 21133 - DNA, 741 bp, Homo sapiens
gctttctcaaccccttcacgtggcttctgcagcaaattccaaggttcagaatgccagagggagaataagttccagaagcatggtatccggcaacttcagcatctgccagtgacatctgtcccctcttcaaccagacctgaatctcagccccagtatgggaacagccctagagttagtggctacttattaagtctgctcttacagtattcttaaaagttgtctttacttcttacaagtcaatttctatttcttcaatcatgttataactagtaattctgtgtattaaacctccactgttaaaatcactatatggtctctgtctcctagttggacagtatgagatagttttttttttaaatttaattcacacactctaaaattcagcctttcaaagtatataatgcaatggtttttagtatattcacagacttctacaatcatctccactacctatctttgaatatttccatcctccccaaaagaaaactcatgcctccccattctaccctccttccagctccaggcaacatacactttcccgcctctgtttttacctgctctggatacttaatctagaatcttagaatatgtggccttctgcatctggcttctttcacatagcatatgttcaaggttcatctgtgttggagcatgtatcagtatttcattcattttcatagcagaataatattccattgtatgtataccacattatatttatgctgtcatcagctgatgaca

SEQ ID NO: 21134 - DNA, 377 bp, Homo sapiens
atgcacattgccaatcagtgcacttgctggattgaagaatgtgagtgtttgtatcactctttcagtaggctgtaccaatttagacttgctctaccaatttagatttccatcagcagtaaacaaagacattcctgcctggcagtcttgaactcctgctattatctcttaaatttttgccagtgtgtgaaaagtagtatcttactttaacttgtattttcctggtccaatagtgcactaaatgcccgagttctgtatttattctatttggatagccattagatagccattaagtccactcatagagttattttaaatgttttcctttagtttccaaccacattttcaaataaaatttagaattagcttgtcaagtaagt

SEQ ID NO: 21135 - DNA, 823 bp, Homo sapiens
  misc_feature (9)..(9): n is a, c, g, or t
tagtaggtntggggtttcaccgttttagccgggatggtctcgatctcctgacctcgtgatccgcccgcctcggcctcccaaagtgctgggattacaggcgtgacactgcgcctggccatcttttaattcttaaagatatctgaagtggttggcttggtgatggccagtttccgtaggccgcataatgctgagaaggaagatttcaaaggtctgttttctttaggtttttcttttgtccagtcttctttggcttgcatttctttgaatttcttctgttactttatgctccaaagtatttagtacatactgctcacagttttgatacacgtttctttttgttgttcataaaatttctgttcagccaaatagaacatgctttccagtcagttcttcctggtaatttccaaactcttaaaatttttctgggtttagagttttaaaaaatgcgatcaaaatagtttattttctgataaggtttatttgtttgtttatttttgtttttaaacaagggcttaaaaaatggcacccttttatccttggcaaaattacttatagatagcaaagcaatggagatatgaagcaaaattaagaagtcaagaatagggaaattattaagtggacttgggataagcagggttctgaaacagttaaaatagagatgtgtcgtaattgttataaatctcaatgtacttactaaaaaaacaaaaaatcaatcttcatctaaacccctaggtgtccaatcttttggtttccctgggccacagtggaagaaagaattatcttgggccacacataaaatacactaacattagctgatgagctt

SEQ ID NO: 21136 - DNA, 798 bp, Homo sapiens
cttgactatatttgctaaattcaggaaaataattttatattgaacacaaattgtattttaaattaccactatatagatccttattaccaatgtttgaaaaatttgttttggtttattcctgacattgggtggaaggggcattggatttaggtcagaatggctatctaccccttgaactgacctttccactaacttgctttgtgactttagatggagcctctgaagaacttcatcaccattttcttcatcagctttaaaagagagagagagagagaatataggttaaataataactggctaggcgtggtggctcacacttgtaatcccaacacttttggaggccaaggcgggcggatcacgaggtcaggagttcaagaccagcctgacaaacatcgtgaaaccccgtctctactaaaaatacaaaaattagccaggcgtggtggtgcacgcctgtagtcccagctactcgggaggctgaggcaagagaattgcttgaacccgggaggcggaggttgcagtgagtcaggatcatgccactgcactccagcctaggcgacagagcgagactctgtctcaaaaataataataataaccagagtcccctgttacttaacagttctgtgattcataagtaattccttttagtattcagtaggactgtcttcttatcctgtttcttctactgactttgtgaaagctattcttccatcttactagcaaataatgagttaacatttagattaaggttatctcaaaataatttatactaatgcttataattttctatcaagaaaatcc

SEQ ID NO: 21137 - DNA, 619 bp, Homo sapiens
ggacgccaggggtgaggcagaaggaagcgattatatatcctgtgcatctgatgaacctgtctgcccagcggtcccctgagggcaggcagagagctccctgtctcaatttcattcccttccttccttggagaggtagcccaccttctcaaatagaatcgctcgtattaaaccagaggtgaagaactaggcctttcatagcccttcaaccttcttgctccacctcccagctccttgtctggcctgagtgcagcatgatgttggtcccttatcatagcctagactcctgccagacagctggagaacaaagtgaaggaaagtacatttgaaaaacagtaagcaattgggtgtggtggctcacacctgtaatcccagcactgggaggcccaggcgggaggatcacttgagttcaagaattcaagaccagcctaggcaacacagccagaccctgtctcttaaaaaaaaaaaaaatagcctggcatggtggtgtgcagcatccctgtagtgccagctacttgggaggctgaggtaggaagatcccttaagcccaggagttcaaggctgcaacaagctatgattgtactacagtactccagcctgggtgagagagtgagaccctgtc

SEQ ID NO: 21138 - DNA, 149 bp, Homo sapiens
caattttaaatgttgcattttaaaaaaaatatgtaacaaaactattttcagtgtaaccttaatgatttttttaaaaattttatacattttttctcattgaactctgacagcattaatgaaatgtaaacgtgttttgcatctagtaagac

SEQ ID NO: 21139 - DNA, 453 bp, Homo sapiens
gtgaatatggttgaaagtgacctaccattcttagagtcctggctggatttagggagaggcataagaaaggataggttatcatggacttggaaaatgggagttttttactgatccatgtgtgggtaaagaccaagttgtggccgggtgcagtggctcacacctgtaatcccagcatgtcagaaggctgaagcaggcagatggcttgagtccaggagtttaagaccagcctgaccaacatggtgaaacctcatctctaccaaaaatacaaaaacttagctgaccgtggtggcgcgtccctgtagtcccagctacttgggagtctgaggcaagaggatggcttgaaccccggaggtggaggttgcagtgagccgagattgtgccactgcactccagcctgggcaacagagtgagaccctgtctcaaaaataaagtagttgaaaaaaatattgtcca

SEQ ID NO: 21140 - DNA, 314 bp, Homo sapiens
gtgaatatggttgaaagtgacctaccattcttagagtcctggctggatttagggagaggcataagaaaggataggttatcatggacttggaaaatgggagttttttactgatccatgtgtgggtaaagacccggccaagggactaatttctactcactggtcctgcaatgtatacaagtcaaatgccatagtcaaaaatatgaattatttcaggtaatagatgtttaggttactattagtaggttcaaacagatgagcaaatgccaagggtctactgtactaaaaatttctaaggaggtggctagcagacaata

SEQ ID NO: 21141 - DNA, 461 bp, Homo sapiens
tcagctcggtaccggttcgatgccaccgatcagaggcagatgcccaccgctgagtacaccgctccgtagagaccagaggagttcagaggagagttgcctcatacagcctggaggcaggatggggtgagggggtgaaggatggctttgtggatggggagggcatctgagctgagtctggaagttgctccaatcattttctctccttcttcagtggatgtgagggagggtcaccagccctggggactggtgtcgggaagaggtagcttgcatctgtgactgccagacccctccaaatgtgaggtcacatgggcccatgggtgtgaggagaggagccgggtggtgaaggtgtcggcaggcatggtgctgtgggacaggaactgtcacctctgctccgacatgagatcacaggtctatctatcctgttcaagttgggttttaaaataaaattgctccttgttctg

SEQ ID NO: 21142 - DNA, 151 bp, Homo sapiens
ggcatcatgggtcaaaagtctcagaatgcgttcagagtaagaggctgaatcccacggacgcacgctggccatgcaggatcgagatcagcagccccaaacacagacatggtagaaagcacccaggaagctggctggaatgctggttcccagg

SEQ ID NO: 21143 - DNA, 344 bp, Homo sapiens
ctagcagcagaattgtaaagaggagaggtcttaggtgggtagtctagtactttaggattgtatgggtcatctagggcagggtcaggtgtagacaactgccttcttttgtaaatgaagtactgtgaataagtttttgtgaatatagttttacagccactttcatttctttacatgttatctgtggctgctttcaccttacagcagtagagttgtaggacggtcacagcgtgactgtaaggtgagaagataaagaagaatcataagacacaaataaaagaaaagatatctatgttcatgggttggaacaattaatattgtcaaaatatccatactacctaaagcaa

SEQ ID NO: 21144 - DNA, 650 bp, Homo sapiens
tagcaggtaagtccattttatcatgtaatatttacatggatttgctcattgtttaggagagagtggcagtggaactaaaacactcccttctcattaggacctggctgtggataaaaatttctccccaggtccatcccatcttatgcagtgacaatgacctgtaatgctatcctgacaccaactggtaacatactgcagtataattcccgggctaaccacccagagtcagcacagaccacacaagttccagggcatagtcctcaaaaagatgcccttacttcatacgccaactgctttttgggtgaccccaggccactcatactttggaccaaataggtacaaattcaggggttaccatcatcccttcagtttgataattcactagaatgactcacagaattcacaggagcacagtacttgccattacagttttattataaaggacacagatcagcaacagccaaatgaagagacacatggggcaagatctgagtgggttttgaacgcagggcttctgtgccctgttctttgtgggaatctggggtacattcacccttctggtacggtgatgtgtttaccaaccgggaagctccactgagcttcaatgtccaaagttttcacaggggtttcattacgtaggcatgattgac

SEQ ID NO: 21145 - DNA, 429 bp, Homo sapiens
ggagacagaagaaaagagtatgaccacagtgacagagattggagtaatatagatatggtttgatatggtttggcttgatatgatttggctgtgaccccatccaaatctcatcttgaattgtagttcccttaatccccatgcatcgtaggacggaactggtgggaggtaattgaatcatggggggtgatggttttataaggggcttttctccctttgcttggctcttattctctctcctgctgccctgtgaagaggtgtcttccaccatgattgtaaatttcctgaggcctccccagccatgcagaactgtgagtcaattaaacctcttttctttacaaattattcagtctcgggtatttcttcatagcagcatgaaaacggactaatacgcagctataagccaagaaatactgacagccaccagcaggt

SEQ ID NO: 21146 - DNA, 344 bp, Homo sapiens
agcttctgtgttgggtgcggcatctagacaaggggaacacggtggcgcccaaaaactcggagatgctagcaattgcagagtcctaagaggtgttatagctcctgctcagggagtcccaaggtctgagcccccagaaatgttacagctgttcactcctgtagttcaacgagcaggagcatgttacaactctctcctgtagtctagcgagcgggagcgtgttacggctcttttattcccgctgcccatagcttggcgagctgcccaggggtgtcacagccctttcattcccatcacccacagctcagcaagttccgggttcttgtcccatgatgaagaggaatggg

SEQ ID NO: 21147 - DNA, 647 bp, Homo sapiens
ccagctacaaatgaaaatcaatgtgtgtattggcaacagaaaatcacggtgttgtcattggatgtgactttctgaagtggtgggcaattcttgttaatgttttaaacaaaaaaaaaaaaaccttacagtcttgccctgatttacacagcagtcacattcctggaaaattcaagtgtttattaaaactatgcaacagttactgtgtgttatacgttgaaaggtcttcactaatatctcactaagtaatgagaatgcctacatatcagaattttttttttcaggagccaagcacatatactgatttggaaaaaggcacaggtagctcagtttatttgctttctaccctgcctggccacttgctgtttcttcagtttctaatttgagctgtaactacacaaggaaagctaaatagtctggaaaatttttggaaagaatccacaaagccaaaggagactggcctatactcattttatctggggatgtaccttacccttagagactttgaaaaatgtgaagctcttattttgtaacctgggtaaatgttagtttctagattttcggcttaacatctaataataacatttaaaaagtgcttttgtaactattagttatttgcaataaaatgctttccttctacagtcccaagt

SEQ ID NO: 21148 - DNA, 475 bp, Homo sapiens
ccaggccccacgcgagagcaattaaatcaatttctaggagtgggagcccacaaagctcctcaggcaaaggctttcctgaaacttcgtggcccttaccagcttctcttttgagttttacctctgaaatctggaccaatttttattatagtaatcagtttatttgctttctaccctgcctggccacttgctgtttcttcagtttctaatttgagctgtaactacacaaggaaagctaaatagtctggaaaatttttggaaagaatccacaaagccaaaggagactggcctatactcattttatctggggatgtaccttacccttagagactttgaaaaatgtgaagctcttattttgtaacctgggtaaatgttagtttctagattttcggcttaacatctaataataacatttaaaaagtgcttttgtaactattagttatttgcaataaaatgctttccttctacagtcccaagt

SEQ ID NO: 21149 - DNA, 411 bp, Homo sapiens
gccagagtagttgggagtgaggggttacttggagggtaaaatgaccaaataaataggaaatcacaataaaatattatcactgctatggaagtttaacaacacagaagtgaggtgcaaaaaccagcttttcctatcatggattacacagcattaatgctggagttacacatgtgaataagatagttctgccttgatttttagtggttgacaaggcaaagtggagggactggagatagatccatagatagatgtattgtaagacaatatggaagaacaaagtgttagaagagtagagaaggtatgactgcttgggagaatcagggaagcattctcagaggtaagatgatttagctatatcatgaagggcattgtatttaccagcagtataagatgtggaaggcatgtctaaag

SEQ ID NO: 21150 - DNA, 432 bp, Homo sapiens
  misc_feature (328)..(328): n is a, c, g, or t
  misc_feature (340)..(340): n is a, c, g, or t
  misc_feature (383)..(383): n is a, c, g, or t
  misc_feature (418)..(418): n is a, c, g, or t
tttaatgttggttttccccacaacgctagcagctgcaggaaggcagagactgtgtcttatttactggtctagctccagcacctcacagatgttcagtaaacacaagtttatttctacgagtgaccacatggaaaatgtgagtgggctggaggagaggtgcaggcagggtgctgtggagggtcagggatgcaaaggcctgagttggctgaggtggggtcgggctcgtggaagaactgccatttggttgggcttcagagagatgtaagcagaccacacctcacccagaccacaccccatccagtccacaccccatccagtccacaccccntccagaccacantgtatccagttccacgccccttacagaccttaccccattccantgcccaccagctttgttccttattaaatttagttntattcttttaaaaa

SEQ ID NO: 21151 - DNA, 519 bp, Homo sapiens
aatcttttttttttggagggagagggagaacaaaatgtcatttctcaaatgatttgttttaccctaaccataccaaatgaaataaaaatttcaatggatcaaatgcaaatactgaaacaggaacataaaggtgtgaaggctacaaataagtcttctcttccccatcccaacacgtaaaagttgagtttaacctaagttatttgaatcaacctggaaattttttaggagaatatctgagtattaaacagcaattcagaggttgagatttaagtaataatttgatttgtaacactttagcatgtcatcccattggattccagttttctttcctttaaagctgacattagaacgctcttggtggatatatttacatcacgaaatttgcaagcctaaatcactttttttaaaaaagttttaggtgctagaatttcgggcttatttcaaccagttctagacaaaaaccataatatcaagaaataattttctttcacatttataaaatacccaagtgacaactca

SEQ ID NO: 21152 - DNA, 431 bp, Homo sapiens
tctcctgacgtggtgatctgcccgcctcagcctcccaaagtgctgggattacaggcaagaaccactgtgcccagccataggatttttattaatataaattcacatttaattgtttttaaacttaattgcacatttgttagtgaatacatttcacttcacagtaaaatgtcatccaaatgcatttattttacttaataaggcttaaggagaagttgaacagaatgtataatttccacataccccctaactctcctcactatttttctaataataacatctggtattaatttggtgtacttgttatgattgatgagccagtatcaatgcattattgactaatgtccatagtttacattagggttcattctttgtgtagacaaatgaagaatgacaagtatcctcattagagttttatagagaatagtttgatc

SEQ ID NO: 21153 - DNA, 359 bp, Homo sapiens
tactactaaattcgcggccgcgtcgactcatcatctgtaaaatgggaatgtcctgaatgacttctaaggctctttctggcttgaactgtcagagccaagcccacatccctccttgggcagggcagcagctgctgccacagcctccagcggctgccactgtgggctctgggagccggagcgatgctgtgtgagaggcagagtgccaaggatgaagctggcactgaacagtaagcggctccaggcctcctctgggcccagggcccagccaatttctgttctgttcctgtagaacgctctctggattccatagctggaatctcctctcttagctcagtgaaaaataaaaatcccaaatggtg

SEQ ID NO: 21154 - DNA, 2386 bp, Homo sapiens
agctgtccgcgaaacctagtgctgaagtaggcgcggacgtgcccggtgcctggcgcgtggtagcaggcgcccggtgccccggccggcgaagaccatggcgttcatggtgaagaccatggtgggcggccagctgaagaacctcactgggagcctgggaggcggcgaggataagggagatggggacaagtcggcagccgaagctcagggcatgagccgggaggagtacgaggagtatcagaagcaactcgtggaagagaagatggagcgggatgcacagttcacacagaggaaggcagagcgggccacactgcggagccacttccgagacaaataccggctacccaagaacgagacagatgagagccagatccagatggcaggtggagacgtggagctgccccgggagctggccaagatgatcgaggaggacacagaggaggaggaggagaaggcctcagtccttgggcagctggccagccttcctggcttgaacctgggctcactcaaggacaaggcccaggccacactgggggatctcaagcaatcagctgagaagtgtcacgtcatgtgaccacttccccggggttacccactgggctgggcccccatgagggctaagagtgtgtcaacttccagggacccatactccatttggggctttgtttcccttgccccatcctagttccaagacctttcccatccatgccccaagcctatcttctggtttcttcctctccgctgggagtaaagtccccatcttcactctacccttcaggaccctccccaccagctcagcctgtggaggcctcccaagattgtaggaataggcccatccctctctggccatggccccaagttcctgcacacaggagcacccacagagagacacacacaggacacaaaacccctggcacgttcagagacagaagccacagatacatcccggcacagacagacacacacgaggccagctcccttgcgtgtccagcccctccagacaccaccactcagaaactctgagagagagcatgggcagacaccctcagcagacaggaggcctgagttccagtctccacctttattgttcttgaaagcccctgctctctctgagccttatttcatcatctgtaaaatgggaatgtcctgaatgacttctaaggctctttctggcttgaactgtcagagccaagcccacatccctccttgggcagggcagcagctgctgccacagcctccagcggctgccactgtgggctctgggagccggagcgatgctgtgtgagaggcagagtgccaaggatgaagctggcactgaacagtaagcggctccaggcctcctctgggcccagggcccagccaatttctgttctgttcctgtagaacgctctctggattccatagctggaatctcctctcttagctcagtgaaaaataaaaatcccaaatggtgtgcctaccttcccacttcttactggcttccaggagtcttggagttcatagccccccgagcctgccttaaaggggtgtcctccaccccccacctacagcttcacaggaggggagaaggcatccagtgctaggagtagaagtgtctccagctctgttctcttggggccctgggtgaaggtggggtctggggcttatgaaataggtctgggctttgaggaggatggagcagcctcattatgtggggaagatggggcctctggggcgtcactgagaccacaggtggggccggggctggaccgcagctgtcttgggtgcctgtgcctacacccctcctcaccctagagacggaagatgtgcaaaaagaaagaaggaagggcaactgcattccagccccacactgtgatgactttgagcctgtcctttccctccttgagcctgtcttgcttgtcccctgtaaaatgaacagtccccctctcccccaaatagtaataatacatgtttcaaagggtgaccatttataaagcatatgacaaaccatatcaataaatgtaactcattcttttaaaaaaaaaaaaaaactcgtgccgaattcggcacgagggagaaaaccaagcagggggtcaccgaggcggcggagaagaccaaggagggcgtcctctacgtcggaagcaagacccgagaaggtgtggtacaaggtgtggcttcagtggctgaaaaaaccaaggaacaggcctcacatctgggaggagctgtgttctctggggcagggaacatcgcagcagccacaggactggtgaaaaaggaggaattccctactgatctgaagccagagaagtggcccagaagcttgtgaagaccactgattgagccctgatgagccagaaggggagagtatgaggacccacccaggaggaatttcagagtttaacccaaagcg

SEQ ID NO: 21155 - DNA, 2332 bp, Homo sapiens
agctgtccgcgaaacctagtgctgaagtaggcgcggacgtgcccggtgcctggcgcgtggtagcaggcgcccggtgccccggccggcgaagaccatggcgttcatggtgaagaccatggtgggcggccagctgaagaacctcactgggagcctgggaggcggcgaggataagggagatggggacaagtcggcagccgaagctcagggcatgagccgggaggagtacgaggagtatcagaagcaactcgtggaagagaagatggagcgggatgcacagttcacacagaggaaggcagagcgggccacactgcggagccacttccgagacaaataccggctacccaagaacgagacagatgagagccagatccagatggcaggtggagacgtggagctgccccgggagctggccaagatgatcgaggaggacacagaggaggaggaggagaaggcctcagtccttgggcagctggccagccttcctggcttgaacctgggctcactcaaggacaaggcccaggccacactgggggatctcaagcaatcagctgagaagtgtcacgtcatgtgaccacttccccggggttacccactgggctgggcccccatgagggctaagagtgtgtcaacttccagggacccatactccatttggggctttgtttcccttgccccatcctagttccaagacctttcccatccatgccccaagcctatcttctggtttcttcctctccgctgggagtaaagtccccatcttcactctacccttcaggaccctccccaccagctcagcctgtggaggcctcccaagattgtaggaataggcccatccctctctggccatggccccaagttcctgcacacaggagcacccacagagagacacacacaggacacgacacacacgaggccagctcccttgcgtgtccagcccctccagacaccaccactcagaaactctgagagagagcatgggcagacaccctcagcagacaggaggcctgagttccagtctccacctttattgttcttgaaagcccctgctctctctgagccttatttcatcatctgtaaaatgggaatgtcctgaatgacttctaaggctctttctggcttgaactgtcagagccaagcccacatccctccttgggcagggcagcagctgctgccacagcctccagcggctgccactgtgggctctgggagccggagcgatgctgtgtgagaggcagagtgccaaggatgaagctggcactgaacagtaagcggctccaggcctcctctgggcccagggcccagccaatttctgttctgttcctgtagaacgctctctggattccatagctggaatctcctctcttagctcagtgaaaaataaaaatcccaaatggtgtgcctaccttcccacttcttactggcttccaggagtcttggagttcatagccccccgagcctgccttaaaggggtgtcctccaccccccacctacagcttcacaggaggggagaaggcatccagtgctaggagtagaagtgtctccagctctgttctcttggggccctgggtgaaggtggggtctggggcttatgaaataggtctgggctttgaggaggatggagcagcctcattatgtggggaagatggggcctctggggcgtcactgagaccacaggtggggccggggctggaccgcagctgtcttgggtgcctgtgcctacacccctcctcaccctagagacggaagatgtgcaaaaagaaagaaggaagggcaactgcattccagccccacactgtgatgactttgagcctgtcctttccctccttgagcctgtcttgcttgtcccctgtaaaatgaacagtccccctctcccccaaatagtaataatacatgtttcaaagggtgaccatttataaagcatatgacaaaccatatcaataaatgtaactcattcttttaaaaaaaaaaaaaaactcgtgccgaattcggcacgagggagaaaaccaagcagggggtcaccgaggcggcggagaagaccaaggagggcgtcctctacgtcggaagcaagacccgagaaggtgtggtacaaggtgtggcttcagtggctgaaaaaaccaaggaacaggcctcacatctgggaggagctgtgttctctggggcagggaacatcgcagcagccacaggactggtgaaaaaggaggaattccctactgatctgaagccagagaagtggcccagaagcttgtgaagaccactgattgagccctgatgagccagaaggggagagtatgaggacccacccaggaggaatttcagagtttaacccaaagcg

SEQ ID NO: 21156 - DNA, 2468 bp, Homo sapiens
ttgcggcttgtcctgctatactgggactacaggcacacgccacatgcctaattttattttttgtagagacaggctctggctatgttggccaggctggtctcaagtgatctttccacctcagcctcccaaaaacactgggattacagggacaagccagcactccgggtcatgctggtgcacttgggctgccatggtgcacaggaggtatgagctggggggcagaatctgctcctggacctctacccaggcctgcacccagactgacccctgggctacagggaacaggtgtggagagaatgcagcaagcagagcgggctagtcagtgatggagaccctgcaggatggagcgggatgcacagttcacacagaggaaggcagagcgggccacactgcggagccacttccgagacaaataccggctacccaagaacgagacagatgagagccagatccagatggcaggtggagacgtggagctgccccgggagctggccaagatgatcgaggaggacacagaggaggaggaggagaaggcctcagtccttgggcagctggccagccttcctggcttgaacctgggctcactcaaggacaaggcccaggccacactgggggatctcaagcaatcagctgagaagtgtcacgtcatgtgaccacttccccggggttacccactgggctgggcccccatgagggctaagagtgtgtcaacttccagggacccatactccatttggggctttgtttcccttgccccatcctagttccaagacctttcccatccatgccccaagcctatcttctggtttcttcctctccgctgggagtaaagtccccatcttcactctacccttcaggaccctccccaccagctcagcctgtggaggcctcccaagattgtaggaataggcccatccctctctggccatggccccaagttcctgcacacaggagcacccacagagagacacacacaggacacaaaacccctggcacgttcagagacagaagccacagatacatcccggcacagacagacacacacgaggccagctcccttgcgtgtccagcccctccagacaccaccactcagaaactctgagagagagcatgggcagacaccctcagcagacaggaggcctgagttccagtctccacctttattgttcttgaaagcccctgctctctctgagccttatttcatcatctgtaaaatgggaatgtcctgaatgacttctaaggctctttctggcttgaactgtcagagccaagcccacatccctccttgggcagggcagcagctgctgccacagcctccagcggctgccactgtgggctctgggagccggagcgatgctgtgtgagaggcagagtgccaaggatgaagctggcactgaacagtaagcggctccaggcctcctctgggcccagggcccagccaatttctgttctgttcctgtagaacgctctctggattccatagctggaatctcctctcttagctcagtgaaaaataaaaatcccaaatggtgtgcctaccttcccacttcttactggcttccaggagtcttggagttcatagccccccgagcctgccttaaaggggtgtcctccaccccccacctacagcttcacaggaggggagaaggcatccagtgctaggagtagaagtgtctccagctctgttctcttggggccctgggtgaaggtggggtctggggcttatgaaataggtctgggctttgaggaggatggagcagcctcattatgtggggaagatggggcctctggggcgtcactgagaccacaggtggggccggggctggaccgcagctgtcttgggtgcctgtgcctacacccctcctcaccctagagacggaagatgtgcaaaaagaaagaaggaagggcaactgcattccagccccacactgtgatgactttgagcctgtcctttccctccttgagcctgtcttgcttgtcccctgtaaaatgaacagtccccctctcccccaaatagtaataatacatgtttcaaagggtgaccatttataaagcatatgacaaaccatatcaataaatgtaactcattcttttaaaaaaaaaaaaaaactcgtgccgaattcggcacgagggagaaaaccaagcagggggtcaccgaggcggcggagaagaccaaggagggcgtcctctacgtcggaagcaagacccgagaaggtgtggtacaaggtgtggcttcagtggctgaaaaaaccaaggaacaggcctcacatctgggaggagctgtgttctctggggcagggaacatcgcagcagccacaggactggtgaaaaaggaggaattccctactgatctgaagccagagaagtggcccagaagcttgtgaagaccactgattgagccctgatgagccagaaggggagagtatgaggacccacccaggaggaatttcagagtttaacccaaagcg

SEQ ID NO: 21157 - DNA, 1450 bp, Homo sapiens
agctgtccgcgaaacctagtgctgaagtaggcgcggacgtgcccggtgcctggcgcgtggtagcaggcgcccggtgccccggccggcgaagaccatggcgttcatggtgaagaccatggtgggcggccagctgaagaacctcactgggagcctgggaggcggcgaggataagggagatggggacaagtcggcagccgaagctcagggcatgagccgggaggagtacgaggagtatcagaagcaactcgtggaagagaagatggagcgggatgcacagttcacacagaggaaggcagagcgggccacactgcggagccacttccgagacaaataccggctacccaagaacgagacagatgagagccagatccagatggcaggtggagacgtggagctgccccgggagctggccaagatgatcgaggaggacacagaggaggaggaggagaaggcctcagtccttgggcagctggccagccttcctggcttgaacctgggctcactcaaggacaaggcccaggccacactgggggatctcaagcaatcagctgagaagtgtcacgtcatgtgaccacttccccggggttacccactgggctgggcccccatgagggctaagagtgtgtcaacttccagggacccatactccatttggggctttgtttcccttgccccatcctagttccaagacctttcccatccatgccccaagcctatcttctggtttcttcctctccgctgggagtaaagtccccatcttcactctacccttcaggaccctccccaccagctcagcctgtggaggcctcccaagattgtaggaataggcccatccctctctggccatggccccaagttcctgcacacaggagcacccacagagagacacacacaggacacaaaacccctggcacgttcagagacagaagccacagatacatcccggcacagacagacacacacgaggccagctcccttgcgtgtccagcccctccagacaccaccactcagaaactctgagagagagcatgggcagacaccctcagcagacaggaggcctgagttccagtctccacctttattgttcttgaaagcccctgctctctctgagccttatttcatcatctgtaaaatgggaatgtcctgaatgacttctaaggctctttctggcttgaactgtcagagccaagcccacatccctccttgggcagggcagcagctgctgccacagcctccagcggctgccactgtgggctctgggagccggagcgatgctgtgtgagaggcagagtgccaaggatgaagctggcactgaacagtaagcggctccaggcctcctctgggcccagggcccagccaatttctgttctgttcctgtagaacgctctctggattccatagctggaatctcctctcttagctcagtgaaaaataaaaatcccaaatggtg

SEQ ID NO: 21158 - DNA, 542 bp, Homo sapiens
ctgccctcctgcacagcccagcactccctgcctctagtggttgttttgttcttttttcagctgctttattgagatctgatttacatataagattccccagctttaagtgtacagtgcggttttgtacatttttaggaaatttacagagttgtgcatccataaccacaatccaattttggaacatttccatcacccccagaacacctcctgcatccatttgcagttattcttcatgcccactcctgccccagctcaccattcactttctgtctggccatttcatatgtatggaatcatgcggattattttttagagaaattatttgattctaaaagtaatccctgttggaaaacatctggaagaatgggaaccaagttattattggcagttacctttggggagtctctaggtggtgagatcacagggggatgtttcactttctgtaatgctttgaatttcctacagagagcctatgttccatttataatcagaaggaaagggcaaagcggggaaagtgcatgttttactcttggaaaatgcca

SEQ ID NO: 21159 - DNA, 3447 bp, Homo sapiens
aaccacttttcgcgcgaaacctggttgttgctgtagtggcggagaggatcgtggtactgctatggcggaatcatcggaatccttcaccatggcatccagcccggcccagcgtcggcgaggcaatgatcctctcacctccagccctggccgaagctcccggcgtactgatgccctcacctccagccctggccgtgaccttccaccatttgaggatgagtccgaggggctcctaggcacagaggggcccctggaggaagaagaggatggagaggagctcattggagatggcatggaaagggactaccgcgccatcccagagctggacgcctatgaggccgagggactggctctggatgatgaggacgtagaggagctgacggccagtcagagggaggcagcagagcgggccatgcggcagcgtgaccgggaggctggccggggcctgggccgcatgcgccgtgggctcctgtatgacagcgatgaggaggacgaggagcgccctgcccgcaagcgccgccaggtggagcgggccacggaggacggcgaggaggacgaggagatgattgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggagaccatctatcagaactaccagcgtatccgaatccaggagagtccaggcaaagtggcggctggccggctgccccgctccaaggacgccattctcctcgcagatctggtggacagctgcaagccaggagacgagatagagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaagatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggaggcccacgcgcgcatccatctgcgggactatgtgatcgaagacgacgtcaacatggccatccgcgtgatgctggagagcttcatagacacacagaagttcagcgtcatgcgcagcatgcgcaagacttttgcccgctacctttcattccggcgtgacaacaatgagctgttgctcttcatactgaagcagttagtggcagagcaggtgacatatcagcgcaaccgctttggggcccagcaggacactattgaggtccctgagaaggacttggtggataaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcaggtttctgtgcccctgtggtggaagagggcacgacagtgccagcgcagcgttctgggctcctcagtcgcaggggtgggatgtgagtcatgcggattatccactcgccacagttatcagctgccattgctccctgtctgtttccccactctcttatttgtgcattcggtttggtttctgtagttttaatttttaataaagttgaataaaatataaaaaaaaaaa

SEQ ID NO: 21160 - DNA, 3433 bp, Homo sapiens
aaaaataacgctaaggtacgaggctgggtgtagggatgtggtatgctatggcggaatcatcggaatccttcaccatggcatccagcccggcccagcgtcggcgaggcaatgatcctctcacctccagccctggccgaagctcccggcgtactgatgccctcacctccagccctggccgtgaccttccaccatttgaggatgagtccgaggggctcctaggcacagaggggcccctggaggaagaagaggatggagaggagctcattggagatggcatggaaagggactaccgcgccatcccagagctggacgcctatgaggccgagggactggctctggatgatgaggacgtagaggagctgacggccagtcagagggaggcagcagagcgggccatgcggcagcgtgaccgggaggctggccggggcctgggccgcatgcgccgtgggctcctgtatgacagcgatgaggaggacgaggagcgccctgcccgcaagcgccgccaggtggagcgggccacggaggacggcgaggaggacgaggagatgattgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggagaccatctatcagaactaccagcgtatccgaatccaggagagtccaggcaaagtggcggctggccggctgccccgctccaaggacgccattctcctcgcagatctggtggacagctgcaagccaggagacgagatagagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaagatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggaggcccacgcgcgcatccatctgcgggactatgtgatcgaagacgacgtcaacatggccatccgcgtgatgctggagagcttcatagacacacagaagttcagcgtcatgcgcagcatgcgcaagacttttgcccgctacctttcattccggcgtgacaacaatgagctgttgctcttcatactgaagcagttagtggcagagcaggtgacatatcagcgcaaccgctttggggcccagcaggacactattgaggtccctgagaaggacttggtggataaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcaggtttctgtgcccctgtggtggaagagggcacgacagtgccagcgcagcgttctgggctcctcagtcgcaggggtgggatgtgagtcatgcggattatccactcgccacagttatcagctgccattgctccctgtctgtttccccactctcttatttgtgcattcggtttggtttctgtagttttaatttttaataaagttgaataaaatataaaaaaaaaaa

SEQ ID NO: 21161 - DNA, 3664 bp, Homo sapiens
gtccctttgtctgtatactgtctgttccacatctgagttccagacctctgtttggtggctcttctatgccatctctatcacaataccttgcgcactgtgtgtgctgaaataggtctaatgcttaaggggagataatagacagtaaacaggtaaataggcaaatgacataacctcagtggtttttcatggagaaagcacggtgatgtgggtgaccccgatatttgagctggcttctatttgtttggaagccactgactcagattgctcagctgagagcattccaggaatcatcggaatccttcaccatggcatccagcccggcccagcgtcggcgaggcaatgatcctctcacctccagccctggccgaagctcccggcgtactgatgccctcacctccagccctggccgtgaccttccaccatttgaggatgagtccgaggggctcctaggcacagaggggcccctggaggaagaagaggatggagaggagctcattggagatggcatggaaagggactaccgcgccatcccagagctggacgcctatgaggccgagggactggctctggatgatgaggacgtagaggagctgacggccagtcagagggaggcagcagagcgggccatgcggcagcgtgaccgggaggctggccggggcctgggccgcatgcgccgtgggctcctgtatgacagcgatgaggaggacgaggagcgccctgcccgcaagcgccgccaggtggagcgggccacggaggacggcgaggaggacgaggagatgattgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggagaccatctatcagaactaccagcgtatccgaatccaggagagtccaggcaaagtggcggctggccggctgccccgctccaaggacgccattctcctcgcagatctggtggacagctgcaagccaggagacgagatagagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaagatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggaggcccacgcgcgcatccatctgcgggactatgtgatcgaagacgacgtcaacatggccatccgcgtgatgctggagagcttcatagacacacagaagttcagcgtcatgcgcagcatgcgcaagacttttgcccgctacctttcattccggcgtgacaacaatgagctgttgctcttcatactgaagcagttagtggcagagcaggtgacatatcagcgcaaccgctttggggcccagcaggacactattgaggtccctgagaaggacttggtggataaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcaggtttctgtgcccctgtggtggaagagggcacgacagtgccagcgcagcgttctgggctcctcagtcgcaggggtgggatgtgagtcatgcggattatccactcgccacagttatcagctgccattgctccctgtctgtttccccactctcttatttgtgcattcggtttggtttctgtagttttaatttttaataaagttgaataaaatataaaaaaaaaaa

SEQ ID NO: 21162 - DNA, 3407 bp, Homo sapiens
ggaaatcatggatgctgtattatgtcggaatcatcggaatccttcaccatggcatccagcccggcccagcgtcggcgaggcaatgatcctctcacctccagccctggccgaagctcccggcgtactgatgccctcacctccagccctggccgtgaccttccaccatttgaggatgagtccgaggggctcctaggcacagaggggcccctggaggaagaagaggatggagaggagctcattggagatggcatggaaagggactaccgcgccatcccagagctggacgcctatgaggccgagggactggctctggatgatgaggacgtagaggagctgacggccagtcagagggaggcagcagagcgggccatgcggcagcgtgaccgggaggctggccggggcctgggccgcatgcgccgtgggctcctgtatgacagcgatgaggaggacgaggagcgccctgcccgcaagcgccgccaggtggagcgggccacggaggacggcgaggaggacgaggagatgattgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggagaccatctatcagaactaccagcgtatccgaatccaggagagtccaggcaaagtggcggctggccggctgccccgctccaaggacgccattctcctcgcagatctggtggacagctgcaagccaggagacgagatagagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaagatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggaggcccacgcgcgcatccatctgcgggactatgtgatcgaagacgacgtcaacatggccatccgcgtgatgctggagagcttcatagacacacagaagttcagcgtcatgcgcagcatgcgcaagacttttgcccgctacctttcattccggcgtgacaacaatgagctgttgctcttcatactgaagcagttagtggcagagcaggtgacatatcagcgcaaccgctttggggcccagcaggacactattgaggtccctgagaaggacttggtggataaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcaggtttctgtgcccctgtggtggaagagggcacgacagtgccagcgcagcgttctgggctcctcagtcgcaggggtgggatgtgagtcatgcggattatccactcgccacagttatcagctgccattgctccctgtctgtttccccactctcttatttgtgcattcggtttggtttctgtagttttaatttttaataaagttgaataaaatataaaaaaaaaaa

SEQ ID NO: 21163 - DNA, 3425 bp, Homo sapiens
attaggcgcgttctgcgtggagaggatcgtggtactgctatggcggaatcatcggaatccttcaccatggcatccagcccggcccagcgtcggcgaggcaatgatcctctcacctccagccctggccgaagctcccggcgtactgatgccctcacctccagccctggccgtgaccttccaccatttgaggatgagtccgaggggctcctaggcacagaggggcccctggaggaagaagaggatggagaggagctcattggagatggcatggaaagggactaccgcgccatcccagagctggacgcctatgaggccgagggactggctctggatgatgaggacgtagaggagctgacggccagtcagagggaggcagcagagcgggccatgcggcagcgtgaccgggaggctggccggggcctgggccgcatgcgccgtgggctcctgtatgacagcgatgaggaggacgaggagcgccctgcccgcaagcgccgccaggtggagcgggccacggaggacggcgaggaggacgaggagatgattgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggagaccatctatcagaactaccagcgtatccgaatccaggagagtccaggcaaagtggcggctggccggctgccccgctccaaggacgccattctcctcgcagatctggtggacagctgcaagccaggagacgagatagagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaagatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggaggcccacgcgcgcatccatctgcgggactatgtgatcgaagacgacgtcaacatggccatccgcgtgatgctggagagcttcatagacacacagaagttcagcgtcatgcgcagcatgcgcaagacttttgcccgctacctttcattccggcgtgacaacaatgagctgttgctcttcatactgaagcagttagtggcagagcaggtgacatatcagcgcaaccgctttggggcccagcaggacactattgaggtccctgagaaggacttggtggataaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcaggtttctgtgcccctgtggtggaagagggcacgacagtgccagcgcagcgttctgggctcctcagtcgcaggggtgggatgtgagtcatgcggattatccactcgccacagttatcagctgccattgctccctgtctgtttccccactctcttatttgtgcattcggtttggtttctgtagttttaatttttaataaagttgaataaaatataaaaaaaaaaa

SEQ ID NO: 21164 - DNA, 3930 bp, Homo sapiens
  misc_feature (809)..(809): n is a, c, g, or t
  misc_feature (1372)..(1372): n is a, c, g, or t
ttccgtaccgtcgcggatttcggcggcggaaacatggcggtcgcggccgggccggtaacggagaaagtttacgccgacactggcctgtattagcgcgtatggcctcgggccctcgttccccaaggcgtgccgcctccctgttctcagtcgcaggctgaagccttgtctgctctcctcctttttggtttggttttggaactgactccgagggttgggagagcgcgttggtggcgacggccgagtcagatcactataaacaaaatttccacaagagaaaatgttgaaataggagttgcggatacattggatatactggatgaaatacaagcggttaatttttgtaacgtgagggaaaagcccacattgctggttacatgtgtaaatcactgcgttattgctttagtcattgtctctatttagcaatgacaagactggaagaagtaaatagagaagtgaacatgcattcttcagtgcggtatcttggctatttagccagaatcaatttattggttgctatatgcttaggtctatacgtaagatgggaaaaaacagcaaattccttaattttggtaatttttattcttggtctttttgttcttggaatcgccagcatactctattactatttttcaatggaagcagcaagtttaagtctctccaatctttggtttggattcttgcttggcctcctatgttttcttgataattcatcctttaaaaatgatgtaaaagaagaatcaaccaaatatttgcttctaacatccatagtgttaaggatattgtgctctctggtggagagaatttctggntatgtccgtcatcggcccactttactaaccacagttgaatttctggagcttgttggatttgccattgccagcacaactatgttggtggagaagtctctgagtgtcattttgcttgttgtagctctggctatgctgattattgatctgagaatgaaatctttcttagctattccaaacttagttatttttgcagttttgttatttttttcctcattggaaactcccaaaaatccgattgcttttgcgtgtttttttatttgcctgataactgatcctttccttgacatttattttagtggactttcagtaactgaaagatggaaaccctttttgtaccgtggaagaatttgcagaagactttcagtcgtttttgctggaatgattgagcttacattttttattctttccgcattcaaacttagagacactcacctctggtattttgtaatacctggcttttccatttttggaattttctggatgatttgtcatattatttttcttttaactctttggggattccataccaaattaaatgactgccataaagtatattttactcncaggacagattacaatagccttgatagaatcatggcatccaaagggatgcgccatttttgcttgatttcagagcagttggtgttctttagtcttcttgcaacagcgattttgggagcagtttcctggcagccaacaaatggaattttcttgagcatgtttctaatcgttttgccattggaatccatggctcatgggctcttccatgaattgggtaactgtttaggaggaacatctgttggatatgctattgtgattcccaccaacttctgcagtcctgatggtcagccaacactgcttcccccagaacatgtacaggagttaaatttgaggtctactggcatgctcaatgctatccaaagattttttgcatatcatatgattgagacctatggatgtgactattccacaagtggactgtcatttgatactctgcattccaaactaaaagctttcctcgaacttcggacagtggatggacccagacatgatacgtatattttgtattacagtgggcacacccatggtacaggagagtgggctctagcaggtggagatacactacgccttgacacacttatagaatggtggagagaaaagaatggttccttttgttcccggcttattatcgtattagacagcgaaaattcaaccccttgggtgaaagaagtgaggaaaattaatgaccagtatattgcagtgcaaggagcagagttgataaaaacagtagatattgaagaagctgacccgccacagctaggtgactttacaaaagactgggtagaatataactgcaactccagtaataacatctgctggactgaaaagggacgcacagtgaaagcagtatatggtgtgtcaaaacggtggagtgactacactctgcatttgccaacgggaagcgatgtggccaagcactggatgttacactttcctcgtattacatatcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatattaataagcactcatactaccaattatcactaacttgccattttttgtatgctgtatttttatttgtggaaaataccttgctacttctgtagctgctctcactttgtcttttcttaagtaattatggtatatataaggcgttgggaaaaaacattttataatgaaagtatgtagggagtcaaatgcttactgtaaatgcataagagacgttaaaaataacactgcactttcaggaatgtttgcttatggtcctgattagaaagaaacagttgtctatgctctgcaatggtcaatgatgaattactaatgccttattttctaggcatataataatagtttagagaatgtagaccagataaatttgtttactgttttaagaaaactaccagtttacttacagaagattcttttttccaaacagtaggtttcatccaagaccatttgaagaactgcaaactctttctcttagaaaagaaagagggcagcctaaaataaacgcaaaatttgcttatactccatcacattcagatgtcttggttgtgacttattaccagtgtggcagagaacccaagttacattttagatcaaaatattctttatgtaggtattgttaaaaggctagagcctacaagttgctcttccatgcgttggtcagggggccctgaaaacactggtaatattaagagtctttctcagggtaacttaatgttttcttaatgaacagtgtttccagctacaaattcttccaataaattgtcttcctttttgaaaagtactctcatagaagaaatttagcaatttctcgttgactgactcagtctattttaagtattcagaaaagattttgatccccattgagttaatgctctgccttgaaaattatttttctgatccttgttagtgataacattttttttctactgaaggtcagaggataggaaacaagtatttctcttctggtatacatgtaatgtattctgtaaaaaagtattcatattggcaattttagttaggcataatattgtggttgtaatttttaaaacttagtgttttgtctgattaaagcaggcactgatcagggtatctcctaagaggtaattcacttcttattcctttccaataattattacattctaaattttcatctatgagaaataacaaacaagaagggaatagaattaaattggggtataatctaatcttcattgtttaaatggtttgccttctcaccattgaagccatttttttatagcctcagaaagaggaaataatgcctccaccattttctacctggtgacttgaaaattgaacttttaagttaggaagaagttagagtcagggaacttgtataccactatctatgcagcattgttatagtctgattatttctgtgttttgaatatgattttcctaatgctctaaataaaattttgttaaaaat

SEQ ID NO: 21165 - DNA, 4262 bp, Homo sapiens
  misc_feature (900)..(900): n is a, c, g, or t
  misc_feature (1463)..(1463): n is a, c, g, or t
ttccgtaccgtcgcggatttcggcggcggaaacatggcggtcgcggccgggccggtaacggagaaagtttacgccgacactggcctgtattagcgcgtatggcctcgggccctcgttccccaaggcgtgccgcctccctgttctcagtcgcaggctgaagccttgtctgctctcctcctttttggtttggttttggaactgactccgagggttgggagagcgcgttggtggcgacggccgagtcaggctgtcttttgaagaagatcagaatggggaagagttttgtaaattagccatttaaaaacaatctgccatgttgattttggtccataggaagatcactataaacaaaatttccacaagagaaaatgttgaaataggagttgcggatacattggatatactggatgaaatacaagcggttaatttttgtaacgtgagggaaaagcccacattgctggttacatgtgtaaatcactgcgttattgctttagtcattgtctctatttagcaatgacaagactggaagaagtaaatagagaagtgaacatgcattcttcagtgcggtatcttggctatttagccagaatcaatttattggttgctatatgcttaggtctatacgtaagatgggaaaaaacagcaaattccttaattttggtaatttttattcttggtctttttgttcttggaatcgccagcatactctattactatttttcaatggaagcagcaagtttaagtctctccaatctttggtttggattcttgcttggcctcctatgttttcttgataattcatcctttaaaaatgatgtaaaagaagaatcaaccaaatatttgcttctaacatccatagtgttaaggatattgtgctctctggtggagagaatttctggntatgtccgtcatcggcccactttactaaccacagttgaatttctggagcttgttggatttgccattgccagcacaactatgttggtggagaagtctctgagtgtcattttgcttgttgtagctctggctatgctgattattgatctgagaatgaaatctttcttagctattccaaacttagttatttttgcagttttgttatttttttcctcattggaaactcccaaaaatccgattgcttttgcgtgtttttttatttgcctgataactgatcctttccttgacatttattttagtggactttcagtaactgaaagatggaaaccctttttgtaccgtggaagaatttgcagaagactttcagtcgtttttgctggaatgattgagcttacattttttattctttccgcattcaaacttagagacactcacctctggtattttgtaatacctggcttttccatttttggaattttctggatgatttgtcatattatttttcttttaactctttggggattccataccaaattaaatgactgccataaagtatattttactcncaggacagattacaatagccttgatagaatcatggcatccaaagggatgcgccatttttgcttgatttcagagcagttggtgttctttagtcttcttgcaacagcgattttgggagcagtttcctggcagccaacaaatggaattttcttgagcatgtttctaatcgttttgccattggaatccatggctcatgggctcttccatgaattgggtaactgtttaggaggaacatctgttggatatgctattgtgattcccaccaacttctgcagtcctgatggtcagccaacactgcttcccccagaacatgtacaggagttaaatttgaggtctactggcatgctcaatgctatccaaagattttttgcatatcatatgattgagacctatggatgtgactattccacaagtggactgtcatttgatactctgcattccaaactaaaagctttcctcgaacttcggacagtggatggacccagacatgatacgtatattttgtattacagtgggcacacccatggtacaggagagtgggctctagcaggtggagatacactacgccttgacacacttatagaatggtggagagaaaagaatggttccttttgttcccggcttattatcgtattagacagcgaaaattcaaccccttgggtgaaagaagtgaggaaaattaatgaccagtatattgcagtgcaaggagcagagttgataaaaacagtagatattgaagaagctgacccgccacagctaggtgactttacaaaagactgggtagaatataactgcaactccagtaataacatctgctggactgaaaagggacgcacagtgaaagcagtatatggtgtgtcaaaacggtggagtgactacactctgcatttgccaacgggaagcgatgtggccaagcactggatgttacactttcctcgtattacatatcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatattaataagcactcatactaccaattatcactaacttgccattttttgtatgctgtatttttatttgtggaaaataccttgctacttctgtagctgctctcactttgtcttttcttaagtaattatggtatatataaggcgttgggaaaaaacattttataatgaaagtatgtagggagtcaaatgcttactgtaaatgcataagagacgttaaaaataacactgcactttcaggaatgtttgcttatggtcctgattagaaagaaacagttgtctatgctctgcaatggtcaatgatgaattactaatgccttattttctaggcatataataatagtttagagaatgtagaccagataaatttgtttactgttttaagaaaactaccagtttacttacagaagattcttttttccaaacagtaggtttcatccaagaccatttgaagaactgcaaactctttctcttagaaaagaaagagggcagcctaaaataaacgcaaaatttgcttatactccatcacattcagatgtcttggttgtgacttattaccagtgtggcagagaacccaagttacattttagatcaaaatattctttatgtaggtattgttaaaaggctagagcctacaagttgctcttccatgcgttggtcagggggccctgaaaacactggtaatattaagagtctttctcagggtaacttaatgttttcttaatgaacagtgtttccagctacaaattcttccaataaattgtcttcctttttgaaaagtactctcatagaagaaatttagcaatttctcgttgactgactcagtctattttaagtattcagaaaagattttgatccccattgagttaatgctctgccttgaaaattatttttctgatccttgttagtgataacattttttttctactgaaggtcagaggataggaaacaagtatttctcttctggtatacatgtaatgtattctgtaaaaaagtattcatattggcaattttagttaggcataatattgtggttgtaatttttaaaacttagtgttttgtctgattaaagcaggcactgatcagggtatctcctaagaggtaattcacttcttattcctttccaataattattacattctaaattttcatctatgagaaataacaaacaagaagggaatagaattaaattggggtataatctaatcttcattgtttaaatggtttgccttctcaccattgaagccatttttttatagcctcagaaagaggaaataatgcctccaccattttctacctggtgacttgaaaattgaacttttaagttaggaagaagttagagtcagggaacttgtataccactatctatgcagcattgttatagtctgattatttctgtgttttgaatatgattttcctaatgctctaaataaaattttgttaaaaattaattttttatttaatgatgtgcaaatattgaatattttagtatatttattaaaagtggtagtcattaaaaatgcccatgttttagagttcatgtttggaagtttccattataggttaaggatttatattagtattgtccaaataaaatagtatagttttttttattgctctgttcagcagtagggtagtagaaaagccaaatgtaaaattatgagcttttagcttaaaaaaagttaatgt

SEQ ID NO: 21166 - DNA, 4171 bp, Homo sapiens
  misc_feature (809)..(809): n is a, c, g, or t
  misc_feature (1372)..(1372): n is a, c, g, or t
ttccgtaccgtcgcggatttcggcggcggaaacatggcggtcgcggccgggccggtaacggagaaagtttacgccgacactggcctgtattagcgcgtatggcctcgggccctcgttccccaaggcgtgccgcctccctgttctcagtcgcaggctgaagccttgtctgctctcctcctttttggtttggttttggaactgactccgagggttgggagagcgcgttggtggcgacggccgagtcagatcactataaacaaaatttccacaagagaaaatgttgaaataggagttgcggatacattggatatactggatgaaatacaagcggttaatttttgtaacgtgagggaaaagcccacattgctggttacatgtgtaaatcactgcgttattgctttagtcattgtctctatttagcaatgacaagactggaagaagtaaatagagaagtgaacatgcattcttcagtgcggtatcttggctatttagccagaatcaatttattggttgctatatgcttaggtctatacgtaagatgggaaaaaacagcaaattccttaattttggtaatttttattcttggtctttttgttcttggaatcgccagcatactctattactatttttcaatggaagcagcaagtttaagtctctccaatctttggtttggattcttgcttggcctcctatgttttcttgataattcatcctttaaaaatgatgtaaaagaagaatcaaccaaatatttgcttctaacatccatagtgttaaggatattgtgctctctggtggagagaatttctggntatgtccgtcatcggcccactttactaaccacagttgaatttctggagcttgttggatttgccattgccagcacaactatgttggtggagaagtctctgagtgtcattttgcttgttgtagctctggctatgctgattattgatctgagaatgaaatctttcttagctattccaaacttagttatttttgcagttttgttatttttttcctcattggaaactcccaaaaatccgattgcttttgcgtgtttttttatttgcctgataactgatcctttccttgacatttattttagtggactttcagtaactgaaagatggaaaccctttttgtaccgtggaagaatttgcagaagactttcagtcgtttttgctggaatgattgagcttacattttttattctttccgcattcaaacttagagacactcacctctggtattttgtaatacctggcttttccatttttggaattttctggatgatttgtcatattatttttcttttaactctttggggattccataccaaattaaatgactgccataaagtatattttactcncaggacagattacaatagccttgatagaatcatggcatccaaagggatgcgccatttttgcttgatttcagagcagttggtgttctttagtcttcttgcaacagcgattttgggagcagtttcctggcagccaacaaatggaattttcttgagcatgtttctaatcgttttgccattggaatccatggctcatgggctcttccatgaattgggtaactgtttaggaggaacatctgttggatatgctattgtgattcccaccaacttctgcagtcctgatggtcagccaacactgcttcccccagaacatgtacaggagttaaatttgaggtctactggcatgctcaatgctatccaaagattttttgcatatcatatgattgagacctatggatgtgactattccacaagtggactgtcatttgatactctgcattccaaactaaaagctttcctcgaacttcggacagtggatggacccagacatgatacgtatattttgtattacagtgggcacacccatggtacaggagagtgggctctagcaggtggagatacactacgccttgacacacttatagaatggtggagagaaaagaatggttccttttgttcccggcttattatcgtattagacagcgaaaattcaaccccttgggtgaaagaagtgaggaaaattaatgaccagtatattgcagtgcaaggagcagagttgataaaaacagtagatattgaagaagctgacccgccacagctaggtgactttacaaaagactgggtagaatataactgcaactccagtaataacatctgctggactgaaaagggacgcacagtgaaagcagtatatggtgtgtcaaaacggtggagtgactacactctgcatttgccaacgggaagcgatgtggccaagcactggatgttacactttcctcgtattacatatcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatattaataagcactcatactaccaattatcactaacttgccattttttgtatgctgtatttttatttgtggaaaataccttgctacttctgtagctgctctcactttgtcttttcttaagtaattatggtatatataaggcgttgggaaaaaacattttataatgaaagtatgtagggagtcaaatgcttactgtaaatgcataagagacgttaaaaataacactgcactttcaggaatgtttgcttatggtcctgattagaaagaaacagttgtctatgctctgcaatggtcaatgatgaattactaatgccttattttctaggcatataataatagtttagagaatgtagaccagataaatttgtttactgttttaagaaaactaccagtttacttacagaagattcttttttccaaacagtaggtttcatccaagaccatttgaagaactgcaaactctttctcttagaaaagaaagagggcagcctaaaataaacgcaaaatttgcttatactccatcacattcagatgtcttggttgtgacttattaccagtgtggcagagaacccaagttacattttagatcaaaatattctttatgtaggtattgttaaaaggctagagcctacaagttgctcttccatgcgttggtcagggggccctgaaaacactggtaatattaagagtctttctcagggtaacttaatgttttcttaatgaacagtgtttccagctacaaattcttccaataaattgtcttcctttttgaaaagtactctcatagaagaaatttagcaatttctcgttgactgactcagtctattttaagtattcagaaaagattttgatccccattgagttaatgctctgccttgaaaattatttttctgatccttgttagtgataacattttttttctactgaaggtcagaggataggaaacaagtatttctcttctggtatacatgtaatgtattctgtaaaaaagtattcatattggcaattttagttaggcataatattgtggttgtaatttttaaaacttagtgttttgtctgattaaagcaggcactgatcagggtatctcctaagaggtaattcacttcttattcctttccaataattattacattctaaattttcatctatgagaaataacaaacaagaagggaatagaattaaattggggtataatctaatcttcattgtttaaatggtttgccttctcaccattgaagccatttttttatagcctcagaaagaggaaataatgcctccaccattttctacctggtgacttgaaaattgaacttttaagttaggaagaagttagagtcagggaacttgtataccactatctatgcagcattgttatagtctgattatttctgtgttttgaatatgattttcctaatgctctaaataaaattttgttaaaaattaattttttatttaatgatgtgcaaatattgaatattttagtatatttattaaaagtggtagtcattaaaaatgcccatgttttagagttcatgtttggaagtttccattataggttaaggatttatattagtattgtccaaataaaatagtatagttttttttattgctctgttcagcagtagggtagtagaaaagccaaatgtaaaattatgagcttttagcttaaaaaaagttaatgt

SEQ ID NO: 21167 - DNA, 2915 bp, Homo sapiens
ttccgtaccgtcgcggatttcggcggcggaaacatggcggtcgcggccgggccggtaacggagaaagtttacgccgacactggcctgtattagcgcgtatggcctcgggccctcgttccccaaggcgtgccgcctccctgttctcagtcgcaggctgaagccttgtctgctctcctcctttttggtttggttttggaactgactccgagggttgggagagcgcgttggtggcgacggccgagtcagccaacaaatggaattttcttgagcatgtttctaatcgttttgccattggaatccatggctcatgggctcttccatgaattgggtaactgtttaggaggaacatctgttggatatgctattgtgattcccaccaacttctgcagtcctgatggtcagccaacactgcttcccccagaacatgtacaggagttaaatttgaggtctactggcatgctcaatgctatccaaagattttttgcatatcatatgattgagacctatggatgtgactattccacaagtggactgtcatttgatactctgcattccaaactaaaagctttcctcgaacttcggacagtggatggacccagacatgatacgtatattttgtattacagtgggcacacccatggtacaggagagtgggctctagcaggtggagatacactacgccttgacacacttatagaatggtggagagaaaagaatggttccttttgttcccggcttattatcgtattagacagcgaaaattcaaccccttgggtgaaagaagtgaggaaaattaatgaccagtatattgcagtgcaaggagcagagttgataaaaacagtagatattgaagaagctgacccgccacagctaggtgactttacaaaagactgggtagaatataactgcaactccagtaataacatctgctggactgaaaagggacgcacagtgaaagcagtatatggtgtgtcaaaacggtggagtgactacactctgcatttgccaacgggaagcgatgtggccaagcactggatgttacactttcctcgtattacatatcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatattaataagcactcatactaccaattatcactaacttgccattttttgtatgctgtatttttatttgtggaaaataccttgctacttctgtagctgctctcactttgtcttttcttaagtaattatggtatatataaggcgttgggaaaaaacattttataatgaaagtatgtagggagtcaaatgcttactgtaaatgcataagagacgttaaaaataacactgcactttcaggaatgtttgcttatggtcctgattagaaagaaacagttgtctatgctctgcaatggtcaatgatgaattactaatgccttattttctaggcatataataatagtttagagaatgtagaccagataaatttgtttactgttttaagaaaactaccagtttacttacagaagattcttttttccaaacagtaggtttcatccaagaccatttgaagaactgcaaactctttctcttagaaaagaaagagggcagcctaaaataaacgcaaaatttgcttatactccatcacattcagatgtcttggttgtgacttattaccagtgtggcagagaacccaagttacattttagatcaaaatattctttatgtaggtattgttaaaaggctagagcctacaagttgctcttccatgcgttggtcagggggccctgaaaacactggtaatattaagagtctttctcagggtaacttaatgttttcttaatgaacagtgtttccagctacaaattcttccaataaattgtcttcctttttgaaaagtactctcatagaagaaatttagcaatttctcgttgactgactcagtctattttaagtattcagaaaagattttgatccccattgagttaatgctctgccttgaaaattatttttctgatccttgttagtgataacattttttttctactgaaggtcagaggataggaaacaagtatttctcttctggtatacatgtaatgtattctgtaaaaaagtattcatattggcaattttagttaggcataatattgtggttgtaatttttaaaacttagtgttttgtctgattaaagcaggcactgatcagggtatctcctaagaggtaattcacttcttattcctttccaataattattacattctaaattttcatctatgagaaataacaaacaagaagggaatagaattaaattggggtataatctaatcttcattgtttaaatggtttgccttctcaccattgaagccatttttttatagcctcagaaagaggaaataatgcctccaccattttctacctggtgacttgaaaattgaacttttaagttaggaagaagttagagtcagggaacttgtataccactatctatgcagcattgttatagtctgattatttctgtgttttgaatatgattttcctaatgctctaaataaaattttgttaaaaattaattttttatttaatgatgtgcaaatattgaatattttagtatatttattaaaagtggtagtcattaaaaatgcccatgttttagagttcatgtttggaagtttccattataggttaaggatttatattagtattgtccaaataaaatagtatagttttttttattgctctgttcagcagtagggtagtagaaaagccaaatgtaaaattatgagcttttagcttaaaaaaagttaatgt

SEQ ID NO: 21168 - DNA, 4032 bp, Homo sapiens
  misc_feature (900)..(900): n is a, c, g, or t
  misc_feature (1463)..(1463): n is a, c, g, or t
ttccgtaccgtcgcggatttcggcggcggaaacatggcggtcgcggccgggccggtaacggagaaagtttacgccgacactggcctgtattagcgcgtatggcctcgggccctcgttccccaaggcgtgccgcctccctgttctcagtcgcaggctgaagccttgtctgctctcctcctttttggtttggttttggaactgactccgagggttgggagagcgcgttggtggcgacggccgagtcaggctgtcttttgaagaagatcagaatggggaagagttttgtaaattagccatttaaaaacaatctgccatgttgattttggtccataggaagatcactataaacaaaatttccacaagagaaaatgttgaaataggagttgcggatacattggatatactggatgaaatacaagcggttaatttttgtaacgtgagggaaaagcccacattgctggttacatgtgtaaatcactgcgttattgctttagtcattgtctctatttagcaatgacaagactggaagaagtaaatagagaagtgaacatgcattcttcagtgcggtatcttggctatttagccagaatcaatttattggttgctatatgcttaggtctatacgtaagatgggaaaaaacagcaaattccttaattttggtaatttttattcttggtctttttgttcttggaatcgccagcatactctattactatttttcaatggaagcagcaagtttaagtctctccaatctttggtttggattcttgcttggcctcctatgttttcttgataattcatcctttaaaaatgatgtaaaagaagaatcaaccaaatatttgcttctaacatccatagtgttaaggatattgtgctctctggtggagagaatttctggntatgtccgtcatcggcccactttactaaccacagttgaatttctggagcttgttggatttgccattgccagcacaactatgttggtggagaagtctctgagtgtcattttgcttgttgtagctctggctatgctgattattgatctgagaatgaaatctttcttagctattccaaacttagttatttttgcagttttgttatttttttcctcattggaaactcccaaaaatccgattgcttttgcgtgtttttttatttgcctgataactgatcctttccttgacatttattttagtggactttcagtaactgaaagatggaaaccctttttgtaccgtggaagaatttgcagaagactttcagtcgtttttgctggaatgattgagcttacattttttattctttccgcattcaaacttagagacactcacctctggtattttgtaatacctggcttttccatttttggaattttctggatgatttgtcatattatttttcttttaactctttggggattccataccaaattaaatgactgccataaagtatattttactcncaggacagattacaatagccttgatagaatcatggcatccaaagggatgcgccatttttgcttgatttcagagcagttggtgttctttagtcttcttgcaacagcgattttgggagcagtttcctggcagccaacaaatggaattttcttgagcatgtttctaatcgttttgccattggaatccatggctcatgggctcttccatgaattgggtaactgtttaggaggaacatctgttggatatgctattgtgattcccaccaacttctgcagtcctgatggtcagccaacactgcttcccccagaacatgtacaggagttaaatttgaggtctactggcatgctcaatgctatccaaagattttttgcatatcatatgattgagacctatggatgtgactattccacaagtggactgtcatttgatactctgcattccaaactaaaagctttcctcgaacttcggacagtggatggacccagacatgatacgtatattttgtattacagtgggcacacccatggtacaggagagtgggctctagcaggtggagatacactacgccttgacacacttatagaatggtggagagaaaagaatggttccttttgttcccggcttattatcgtattagacagcgaaaattcaaccccttgggtgaaagaagtgaggaaaattaatgaccagtatattgcagtgcaaggagcagagttgataaaaacagtagatattgaagaagctgacccgccacagctaggtgactttacaaaagactgggtagaatataactgcaactccagtaataacatctgctggactgaaaagggacgcacagtgaaagcagtatatggtgtgtcaaaacggtggagtgactacactctgcatttgccaacgggaagcgatgtggccaagcactggatgttacactttcctcgtattacatatcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatattaataagcactcatactaccaattatcactaacttgccattttttgtatgctgtatttttatttgtggaaaataccttgctacttctgtagctgctctcactttgtcttttcttaagtaattatggtatatataaggcgttgggaaaaaacattttataatgaaagtatgtagggagtcaaatgcttactgtaaatgcataagagacgttaaaaataacactgcactttcaggaatgtttgcttatggtcctgattagaaagaaacagttgtctatgctctgcaatggtcaatgatgaattactaatgccttattttctaggcatataataatagtttagagaatgtagaccagataaatttgtttactgttttaagaaaactaccagtttacttacagaagattcttttttccaaacagtaggtttcatccaagaccatttgaagaactgcaaactctttctcttagaaaagaaagagggcagcctaaaataaacgcaaaatttgcttatactccatcacattcagatgtcttggttgtgacttattaccagtgtggcagagaacccaagttacattttagatcaaaatattctttatgtaggtattgttaaaaggctagagcctacaagttgctcttccatgcgttggtcagggggccctgaaaacactggtaatattaagagtctttctcagggtaacttaatgttttcttaatgaacagtgtttccagctacaaattcttccaataaattgtcttcctttttgaaaagtactctcatagaagaaatttagcaatttctcgttgactgactcagtctattttaagtattcagaaaagattttgatccccattgagttaatgctctgccttgaaaattatttttctgatccttgttagtgataacattttttttctactgaaggtcagaggataggaaacaagtatttctcttctggtatacatgtaatgtattctgtaaaaaagtattcatattggcaattttagttaggcataatattgtggttgtaatttttaaaacttagtgttttgtctgattaaagcaggcactgatcagggtatctcctaagaggtaattcacttcttattcctttccaataattattacattctaaattttcatctatgagaaataacaaacaagaagggaatagaattaaattggggtataatctaatcttcattgtttaaatggtttgccttctcaccattgaagccatttttttatagcctcagaaagaggaaataatgcctccaccattttctacctggtgacttgaaaattgaacttttaagttaggaagaagttagagtcagggaacttgtataccactatctatgcagcattgttatagtctgattgtctaaggcctaacaagctgatctccctaacgctctccatagggttttgttaaaaccttaaaacaaac

SEQ ID NO: 21169 - DNA, 3958 bp, Homo sapiens
  misc_feature (900)..(900): n is a, c, g, or t
  misc_feature (1463)..(1463): n is a, c, g, or t
ttccgtaccgtcgcggatttcggcggcggaaacatggcggtcgcggccgggccggtaacggagaaagtttacgccgacactggcctgtattagcgcgtatggcctcgggccctcgttccccaaggcgtgccgcctccctgttctcagtcgcaggctgaagccttgtctgctctcctcctttttggtttggttttggaactgactccgagggttgggagagcgcgttggtggcgacggccgagtcaggctgtcttttgaagaagatcagaatggggaagagttttgtaaattagccatttaaaaacaatctgccatgttgattttggtccataggaagatcactataaacaaaatttccacaagagaaaatgttgaaataggagttgcggatacattggatatactggatgaaatacaagcggttaatttttgtaacgtgagggaaaagcccacattgctggttacatgtgtaaatcactgcgttattgctttagtcattgtctctatttagcaatgacaagactggaagaagtaaatagagaagtgaacatgcattcttcagtgcggtatcttggctatttagccagaatcaatttattggttgctatatgcttaggtctatacgtaagatgggaaaaaacagcaaattccttaattttggtaatttttattcttggtctttttgttcttggaatcgccagcatactctattactatttttcaatggaagcagcaagtttaagtctctccaatctttggtttggattcttgcttggcctcctatgttttcttgataattcatcctttaaaaatgatgtaaaagaagaatcaaccaaatatttgcttctaacatccatagtgttaaggatattgtgctctctggtggagagaatttctggntatgtccgtcatcggcccactttactaaccacagttgaatttctggagcttgttggatttgccattgccagcacaactatgttggtggagaagtctctgagtgtcattttgcttgttgtagctctggctatgctgattattgatctgagaatgaaatctttcttagctattccaaacttagttatttttgcagttttgttatttttttcctcattggaaactcccaaaaatccgattgcttttgcgtgtttttttatttgcctgataactgatcctttccttgacatttattttagtggactttcagtaactgaaagatggaaaccctttttgtaccgtggaagaatttgcagaagactttcagtcgtttttgctggaatgattgagcttacattttttattctttccgcattcaaacttagagacactcacctctggtattttgtaatacctggcttttccatttttggaattttctggatgatttgtcatattatttttcttttaactctttggggattccataccaaattaaatgactgccataaagtatattttactcncaggacagattacaatagccttgatagaatcatggcatccaaagggatgcgccatttttgcttgatttcagagcagttggtgttctttagtcttcttgcaacagcgattttgggagcagtttcctggcagccaacaaatggaattttcttgagcatgtttctaatcgttttgccattggaatccatggctcatgggctcttccatgaattgggtaactgtttaggaggaacatctgttggatatgctattgtgattcccaccaacttctgcagtcctgatggtcagccaacactgcttcccccagaacatgtacaggagttaaatttgaggtctactggcatgctcaatgctatccaaagattttttgcatatcatatgattgagacctatggatgtgactattccacaagtggactgtcatttgatactctgcattccaaactaaaagctttcctcgaacttcggacagtggatggacccagacatgatacgtatattttgtattacagtgggcacacccatggtacaggagagtgggctctagcaggtggagatacactacgccttgacacacttatagaatggtggagagaaaagaatggttccttttgttcccggcttattatcgtattagacagcgaaaattcaaccccttgggtgaaagaagtgaggaaaattaatgaccagtatattgcagtgcaaggagcagagttgataaaaacagtagatattgaagaagctgacccgccacagctaggtgactttacaaaagactgggtagaatataactgcaactccagtaataacatctgctggactgaaaagggacgcacagtgaaagcagtatatggtgtgtcaaaacggtggagtgactacactctgcatttgccaacgggaagcgatgtggccaagcactggatgttacactttcctcgtattacatatcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatattaataagcactcatactaccaattatcactaacttgccattttttgtatgctgtatttttatttgtggaaaataccttgctacttctgtagctgctctcactttgtcttttcttaagtaattatggtatatataaggcgttgggaaaaaacattttataatgaaagtatgtagggagtcaaatgcttactgtaaatgcataagagacgttaaaaataacactgcactttcaggaatgtttgcttatggtcctgattagaaagaaacagttgtctatgctctgcaatggtcaatgatgaattactaatgccttattttctaggcatataataatagtttagagaatgtagaccagataaatttgtttactgttttaagaaaactaccagtttacttacagaagattcttttttccaaacagtaggtttcatccaagaccatttgaagaactgcaaactctttctcttagaaaagaaagagggcagcctaaaataaacgcaaaatttgcttatactccatcacattcagatgtcttggttgtgacttattaccagtgtggcagagaacccaagttacattttagatcaaaatattctttatgtaggtattgttaaaaggctagagcctacaagttgctcttccatgcgttggtcagggggccctgaaaacactggtaatattaagagtctttctcagggtaacttaatgttttcttaatgaacagtgtttccagctacaaattcttccaataaattgtcttcctttttgaaaagtactctcatagaagaaatttagcaatttctcgttgactgactcagtctattttaagtattcagaaaagattttgatccccattgagttaatgctctgccttgaaaattatttttctgatccttgttagtgataacattttttttctactgaaggtcagaggataggaaacaagtatttctcttctggtatacatgtaatgtattctgtaaaaaagtattcatattggcaattttagttaggcataatattgtggttgtaatttttaaaacttagtgttttgtctgattaaagcaggcactgatcagggtatctcctaagaggtaattcacttcttattcctttccaataattattacattctaaattttcatctatgagaaataacaaacaagaagggaatagaattaaattggggtataatctaatcttcattgtttaaatggtttgccttctcaccattgaagccatttttttatagcctcagaaagaggaaataatgcctccaccagtcaggggttttgcctaagtcagcaacgctatctttaagggaagcgtgcgataacatcgctgaaattgaggactcttgcaccgacgaaagattcag

SEQ ID NO: 21170 - DNA, 3896 bp, Homo sapiens
  misc_feature (809)..(809): n is a, c, g, or t
  misc_feature (1372)..(1372): n is a, c, g, or t
ttccgtaccgtcgcggatttcggcggcggaaacatggcggtcgcggccgggccggtaacggagaaagtttacgccgacactggcctgtattagcgcgtatggcctcgggccctcgttccccaaggcgtgccgcctccctgttctcagtcgcaggctgaagccttgtctgctctcctcctttttggtttggttttggaactgactccgagggttgggagagcgcgttggtggcgacggccgagtcagatcactataaacaaaatttccacaagagaaaatgttgaaataggagttgcggatacattggatatactggatgaaatacaagcggttaatttttgtaacgtgagggaaaagcccacattgctggttacatgtgtaaatcactgcgttattgctttagtcattgtctctatttagcaatgacaagactggaagaagtaaatagagaagtgaacatgcattcttcagtgcggtatcttggctatttagccagaatcaatttattggttgctatatgcttaggtctatacgtaagatgggaaaaaacagcaaattccttaattttggtaatttttattcttggtctttttgttcttggaatcgccagcatactctattactatttttcaatggaagcagcaagtttaagtctctccaatctttggtttggattcttgcttggcctcctatgttttcttgataattcatcctttaaaaatgatgtaaaagaagaatcaaccaaatatttgcttctaacatccatagtgttaaggatattgtgctctctggtggagagaatttctggntatgtccgtcatcggcccactttactaaccacagttgaatttctggagcttgttggatttgccattgccagcacaactatgttggtggagaagtctctgagtgtcattttgcttgttgtagctctggctatgctgattattgatctgagaatgaaatctttcttagctattccaaacttagttatttttgcagttttgttatttttttcctcattggaaactcccaaaaatccgattgcttttgcgtgtttttttatttgcctgataactgatcctttccttgacatttattttagtggactttcagtaactgaaagatggaaaccctttttgtaccgtggaagaatttgcagaagactttcagtcgtttttgctggaatgattgagcttacattttttattctttccgcattcaaacttagagacactcacctctggtattttgtaatacctggcttttccatttttggaattttctggatgatttgtcatattatttttcttttaactctttggggattccataccaaattaaatgactgccataaagtatattttactcncaggacagattacaatagccttgatagaatcatggcatccaaagggatgcgccatttttgcttgatttcagagcagttggtgttctttagtcttcttgcaacagcgattttgggagcagtttcctggcagccaacaaatggaattttcttgagcatgtttctaatcgttttgccattggaatccatggctcatgggctcttccatgaattgggtaactgtttaggaggaacatctgttggatatgctattgtgattcccaccaacttctgcaggtggagatacactacgccttgacacacttatagaatggtggagagaaaagaatggttccttttgttcccggcttattatcgtattagacagcgaaaattcaaccccttgggtgaaagaagtgaggaaaattaatgaccagtatattgcagtgcaaggagcagagttgataaaaacagtagatattgaagaagctgacccgccacagctaggtgactttacaaaagactgggtagaatataactgcaactccagtaataacatctgctggactgaaaagggacgcacagtgaaagcagtatatggtgtgtcaaaacggtggagtgactacactctgcatttgccaacgggaagcgatgtggccaagcactggatgttacactttcctcgtattacatatcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatattaataagcactcatactaccaattatcactaacttgccattttttgtatgctgtatttttatttgtggaaaataccttgctacttctgtagctgctctcactttgtcttttcttaagtaattatggtatatataaggcgttgggaaaaaacattttataatgaaagtatgtagggagtcaaatgcttactgtaaatgcataagagacgttaaaaataacactgcactttcaggaatgtttgcttatggtcctgattagaaagaaacagttgtctatgctctgcaatggtcaatgatgaattactaatgccttattttctaggcatataataatagtttagagaatgtagaccagataaatttgtttactgttttaagaaaactaccagtttacttacagaagattcttttttccaaacagtaggtttcatccaagaccatttgaagaactgcaaactctttctcttagaaaagaaagagggcagcctaaaataaacgcaaaatttgcttatactccatcacattcagatgtcttggttgtgacttattaccagtgtggcagagaacccaagttacattttagatcaaaatattctttatgtaggtattgttaaaaggctagagcctacaagttgctcttccatgcgttggtcagggggccctgaaaacactggtaatattaagagtctttctcagggtaacttaatgttttcttaatgaacagtgtttccagctacaaattcttccaataaattgtcttcctttttgaaaagtactctcatagaagaaatttagcaatttctcgttgactgactcagtctattttaagtattcagaaaagattttgatccccattgagttaatgctctgccttgaaaattatttttctgatccttgttagtgataacattttttttctactgaaggtcagaggataggaaacaagtatttctcttctggtatacatgtaatgtattctgtaaaaaagtattcatattggcaattttagttaggcataatattgtggttgtaatttttaaaacttagtgttttgtctgattaaagcaggcactgatcagggtatctcctaagaggtaattcacttcttattcctttccaataattattacattctaaattttcatctatgagaaataacaaacaagaagggaatagaattaaattggggtataatctaatcttcattgtttaaatggtttgccttctcaccattgaagccatttttttatagcctcagaaagaggaaataatgcctccaccattttctacctggtgacttgaaaattgaacttttaagttaggaagaagttagagtcagggaacttgtataccactatctatgcagcattgttatagtctgattatttctgtgttttgaatatgattttcctaatgctctaaataaaattttgttaaaaattaattttttatttaatgatgtgcaaatattgaatattttagtatatttattaaaagtggtagtcattaaaaatgcccatgttttagagttcatgtttggaagtttccattataggttaaggatttatattagtattgtccaaataaaatagtatagttttttttattgctctgttcagcagtagggtagtagaaaagccaaatgtaaaattatgagcttttagcttaaaaaaagttaatgt

SEQ ID NO: 21171 - DNA, 1841 bp, Homo sapiens
atagtttatgctgtaatagtttatgctgtaatagtttatgctgtaatagtttatgctgtaatagtttatgctgtaatagtttatgctacagcataaactattgacacaggacaaggcttcaaacttgtcaaatcttaatttggaccccaaagcgggatattaataagcactcatactaccaattatcactaacttgccattttttgtatgctgtatttttatttgtggaaaataccttgctacttctgtagctgctctcactttgtcttttcttaagtaattatggtatatataaggcgttgggaaaaaacattttataatgaaagtatgtagggagtcaaatgcttactgtaaatgcataagagacgttaaaaataacactgcactttcaggaatgtttgcttatggtcctgattagaaagaaacagttgtctatgctctgcaatggtcaatgatgaattactaatgccttattttctaggcatataataatagtttagagaatgtagaccagataaatttgtttactgttttaagaaaactaccagtttacttacagaagattcttttttccaaacagtaggtttcatccaagaccatttgaagaactgcaaactctttctcttagaaaagaaagagggcagcctaaaataaacgcaaaatttgcttatactccatcacattcagatgtcttggttgtgacttattaccagtgtggcagagaacccaagttacattttagatcaaaatattctttatgtaggtattgttaaaaggctagagcctacaagttgctcttccatgcgttggtcagggggccctgaaaacactggtaatattaagagtctttctcagggtaacttaatgttttcttaatgaacagtgtttccagctacaaattcttccaataaattgtcttcctttttgaaaagtactctcatagaagaaatttagcaatttctcgttgactgactcagtctattttaagtattcagaaaagattttgatccccattgagttaatgctctgccttgaaaattatttttctgatccttgttagtgataacattttttttctactgaaggtcagaggataggaaacaagtatttctcttctggtatacatgtaatgtattctgtaaaaaagtattcatattggcaattttagttaggcataatattgtggttgtaatttttaaaacttagtgttttgtctgattaaagcaggcactgatcagggtatctcctaagaggtaattcacttcttattcctttccaataattattacattctaaattttcatctatgagaaataacaaacaagaagggaatagaattaaattggggtataatctaatcttcattgtttaaatggtttgccttctcaccattgaagccatttttttatagcctcagaaagaggaaataatgcctccaccattttctacctggtgacttgaaaattgaacttttaagttaggaagaagttagagtcagggaacttgtataccactatctatgcagcattgttatagtctgattatttctgtgttttgaatatgattttcctaatgctctaaataaaattttgttaaaaattaattttttatttaatgatgtgcaaatattgaatattttagtatatttattaaaagtggtagtcattaaaaatgcccatgttttagagttcatgtttggaagtttccattataggttaaggatttatattagtattgtccaaataaaatagtatagttttttttattgctctgttcagcagtagggtagtagaaaagccaaatgtaaaattatgagcttttagcttaaaaaaagttaatgt

SEQ ID NO: 21172 - DNA, 883 bp, Homo sapiens
gtttatttactttagaactttctgggtatatatatttttttaatcccttgttcttcagctataaaactgatttaaatgtaaatctgttcttaaactcattcttgtacaggtaggaacagggtttattttcattcaataggtacctacatatgaggaagagaaggaaacaatgatacagaatggggaggcaaactttttctgtaaagggccagatatttttggctttgtgggtttagatgcctgttgcagctattcagctctgctactttagagcaatagcagccatagacggtataaatgaatgaatgtagttgtgttccaataaacttatttatgaaaataattatatgaaacaaattgcatacagtttttactatcacaaaatattctgattttctttcaaccatgtgaaaatataaaatcaattcttagctttcaggccatacaaaaagaggtggcaggctggatctggcccatgagttgtagttgctgcccctggtgtagaatgttagcttttctgtatagttgttttcactaaatacaactgtgtaaaactatttccttaattttatactagcagattcctttttatgtgagtaataaggattttttttacctcaagttgaaaatctgttgtaaaaaatatcttttcaaaagatactttgaaagtgtcatttaaatactttattttttgcttatttaattctaagaacttaaggaaaatacatgtataacaagagtattttctctctagaagaaaatgattaagagggttttcttaatgagaggctgcagaaattattgctccattgaattttctcttgttcacaggtggagatacactacgccttgacacacttatagaatggtggagagaaaagaa

SEQ ID NO: 21173 - DNA, 461 bp, Homo sapiens
ggcataagaaaatttgaattgctaaaaaactaaattgacaagataagtagaatacaattaatacagctttgattgatacattgttgagaaaataacatttaccaaacaatatgtccatttatatctaatgataagataggagtctcagtgatttttcttagtgtttttcctgtaaatttttaaaaaatctttttgacttctaatttcttgtctgctgcagaaactagttcaaaaggtaagctgctttcgtcaaaagttttgaagtaacatttttttgtgctttatatttaccttcttaactttttatcgaagcatactaaggaatacagataaatgaattttcacaaactcagtgcacacatgtttttagcaaaaagcagaatatttctagctcccagaagcatgccatcctggtgctcccttcctggctgttacacactgcacccctgaaagtaatcaac

SEQ ID NO: 21174 - DNA, 355 bp, Homo sapiens
tttcttttctaacctggtgtttggcacataggtacagaagcaagagataagacggtggaaagtgttgcaagaaagtagaatagggtgattaactccacttggagtggggcagtgtcagaggctgcagagaaaattataattgagctgggatgtgaagagtgaacaggagttcatctacagatggaaaagtaacatttcaaataatgagaacagtttaaaggcctaaagatgtgagctcatgaatgtcgaggtaaggtgtgtggatggagagggatgaagaacaaggttcaagtgagtctctctgttctccccagtacccccatcttcattacctttgcccaccgtggtctctgct

SEQ ID NO: 21175 - DNA, 679 bp, Homo sapiens
agtcacagcaacagatttgcctgatgtcctgggaaaccttcaatacaatcttttaaaaaacacactacaatgtacagcacatctgcctgaagtgaaagaactggtatggggggaagacctggacaaaaactttcccaagtcagctttttactatgattacgtcctagcctcagatgtggtctaccatcactacttcctggacaagctgctcaccaccatggtgtacctttcccagccagggacggtgctgctttgggcaaacaaattcaggttcagcaccgactatgaatttttagataaattcaagcaagtttttgacacaacactgttggctgaatatccagagtcatcagtcaaactttttaaggggatactaaaatgggactaaatccaacaaaatgcctttcacaacgttactgtgtcttttgagcaatgtgttagaaattgctttggtaatagacttctttcacaggattgagaaggtagtgcatagaaacaacttgtatacttggaacaaatgtaacaatactgcagaaactttctaatttctaagataatttaagattatctggttaatctaaatatctaaaaagaacaacataaaaacatgaaagtagctttgttggttccaacgaagttacatgtttaataaatcttacatggataaagtaaaaaaaaa

SEQ ID NO: 21176 - DNA, 400 bp, Homo sapiens
  misc_feature (102)..(102): n is a, c, g, or t
agaaggaggaatttagaagaggtagagaaaagggaacattaacccctacactcggaaaccccgaagcaacactgcccagaagtgtgttttggtatgcacggntcccttaagtggctgtgattattattgaaagtggggtgttgaagaccccaactactattgtagagtggtctatttctcccttcaatcctgtcaatgtttgctttatgtattttggggaactgttgtttgatgtgtatgtgtttataattgttatacatttttaattgagccttttattaacatatattgttatttttgtctcgaaataattttttagttaaaatctattttgtctgatattggtgtgaatgctgtacctttctgacaataaataatattcgaccatgaatgaataaac

SEQ ID NO: 21177 - DNA, 172 bp, Homo sapiens
ggaatacaggagcacggctcatgactacttcttgtcaattgttcccataagagaaactcactcagacttttacagcaaaactggggagctttattggtgactataggttatcccctggaactgtacattcaagagtacagctggataccaggaggtcagatgatgagaaagt

SEQ ID NO: 21178 - DNA, 416 bp, Homo sapiens
ataagaaagagtagtgattttcccttaaatcggaggagacaaacatggaatttttataaaatgtaatatttgctggtatttaagtatactttgggtggtatcttggctggcgttcagagactgttgaaatcatcttgattgtgaaaagtcgctaaatggagctgttaaatttgcttcgcaaattacatttagctgcaaagtattggttcagtctaggcctcctgaatgataacacctattatatagatgttctctgtccacatcccacctgaggaaaaaaaaatcacatcaggtttgaagttcagttgaggcaaattttatattagtaatatcgttcattattgagagagatctcggctgctgacctgcgtatgaagcacttgccccatggaagttgtgcaagccaagtgccagaa

SEQ ID NO: 21179 - DNA, 404 bp, Homo sapiens
gcgtcgacgcctgtagtcccagctgatcgggaggcctaggcaggagaatggtgtgaacccaggaggcggcgtgtgtgagccactgtgcccaattcagttctcagtaaaaacttgatcaggccaaatgaaagtgacatgggccaatttcataatagattgatttggaaaccagatgtcaatttacttactttaagtgagatctgtatcttcagtaaccagacctcttgagtctcccacccagaacactatcttcctctagtcaagatacctggcaaaggccgggcacagtggctcacgcctataattccagcactttgggaggccaaggtgggtgggtcacctgaggttgggagttcgagaccagcctgaccaacagggagaaaccccatctctactgaaaatac

SEQ ID NO: 21180 - DNA, 312 bp, Homo sapiens
ctgggtgacagagcaagatgctgtatcaaaaaaaaaaagaaaagaaaagaaaagggaagaaaaagaaatgcaaattcttactcatacccaccattaaatccaaatctctagggggatggcctaggaatctgagtttcgacaagctctccaggaatttctgatgcctgctcaaattcaagaagcagttttctcacactgtcttctgggcactgctggtcggaaggttctcacctggacccaccaccccaggggcatctactggcatttgggcttgccacccaaaaaggagagaacttgcccatatctcccaac

SEQ ID NO: 21181 - DNA, 509 bp, Homo sapiens
tgttggatccagagcctgtgtgaaccctgtatatgacatgcaggcacctggccaaccaggaagaggtggctggaatattcctccggatctgcctgccaagctgtgtgccccggctcagttctgcagtgcttctgagggccatgcttttctaacacacacaaaggcactctataagctaaaggagctctgggtctgaaggcacatcatgtgggactgtgcaggctagcgacaagggtttgcaatggagggttttaagcaaaagtgacatgaccctatttaagtttaaataagatccctctgggaccagtttcggtggctcacgcctgtaatcccagcactttgggaggccgaggcgggtggatgacctgaggtcaggagtttgtgaccagcctggccaacatggtgaaaccccgtctctattaaaattacaaaaaaattagctgggtgtggtggcgggcgcctgtaatcccagctacttaggaggctgaggtaggagaatcgcttgaacc

SEQ ID NO: 21182 - DNA, 414 bp, Homo sapiens
ctcaaatcaatttctaattctccattctatttctctgcctttccccatctcctagccacctgcatactgataaagctgttaggaattctacttacaccacttcaggctacagcctcaaaccttcctgtaagtcatttactcagattgctacactctcggttaatgattcccaagtctccatctccagacaagatctcattcctgagcagcagaaacttagctgcaaatgtttactgggccttgagcgcatcaaatgtgctatgtcccaggccgtactcactattttgtcctatccctgccaccccaaactgttcatcccccatcccagttaatatgctcccattcactcatttccttccatgttttttctctttttaaaaaaactctaatcccataacagattacacccgcatt

SEQ ID NO: 21183 - DNA, 819 bp, Homo sapiens
tctcccccatgtcctcctcacacaattttctcatctttatagtctgacataaatcacaactgtgttaaactgttactttcttttttgaactcctgtagtctcatgaaatttagaaattgatcatagttgtcttgtatagggctattttgtttgttaatcttacctaatgagaattccttgagggctaagcataattctagacatcagtgttcagtattacttattgattggtgtgaatgattatctcccctttccccattcctttgttttttccctttctttctctgaattagttgatcatacctatctggtatagggctatcttgtttgttaatcatacctaatgagaattccttgtgggctaaacataataattctagacatcatgttcaataatgctcattaattattgtgaatgattatctcccctatttccattctcttgttctttccctttctttctctgaattagttaggactctttcagttgtaagtgatagaacccaacataaatatttgtagacaggctgggcatggtggctcacgcctgtaatcccagcactttgggaggctgaggcaggcagatcacctgaggtcaggagttcaagaccagcctggccaatgtggtgaaaccctgtctctactaaaaatacaaaagttagctgggcatagtggcaggcgcctgtaatcccagccactcgggaggctgagacaggagaattgcttgaacccgggggggcagaggttgcagtgagccaagattgtgccactgcacttcagcctgtgtgacagagtgagactccatctcaaaaaaaaaaa

SEQ ID NO: 21184 - DNA, 1312 bp, Homo sapiens
  misc_feature (6)..(6): n is a, c, g, or t
  misc_feature (8)..(10): n is a, c, g, or t
  misc_feature (17)..(17): n is a, c, g, or t
  misc_feature (21)..(23): n is a, c, g, or t
  misc_feature (25)..(26): n is a, c, g, or t
  misc_feature (40)..(40): n is a, c, g, or t
  misc_feature (73)..(73): n is a, c, g, or t
tcgctntnnncggaatncgtnnngnngtactgtccgcggnctcatggtctccctgtcactgatgatccttgcngttccacttcaccaaggagccgctgatggaggagtacagcatcgccacccaggtgtggaagctcagctcctgcgattatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgatcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggatctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaatg

SEQ ID NO: 21185 - DNA, 408 bp, Homo sapiens
atagaaccagaattgacggaatctgtgtctggctttgtcataggtaaacaaggaagcatctgtgaggctaatgtaagtcctatggggatgggaggtttgtgtggtaagctatttcagaaaacagaaaagtgggaaatttctcaaccattgctgtatcccagaatcacaggactctggtaaactttaacaattccactcttcgggttgtaaacatttttcctgataagaaaatccactgaagtcctgagatataacagtcttcccatgctctctggcatttatgagagcttcctattaataaatgtatcgcacacagtggtatatccactcataaagtctcctaatgcatgtcagggtaggatcagcatttataaaaaaaaagtaaagtcggggaaatttgaacaaatc

SEQ ID NO: 21186 - DNA, 405 bp, Homo sapiens
gccattaaagtaattcacaaagctcttgggcatttttggacataagcacttgcatgccttttggtagaatatcatttctttattaaaattctattaagatgacagagaaaaaaaaagtaagttagttacactcatcttggcaatgacttatcctgagagaaagctcagcatgttaggtcttcagatgctttatgaaattgaaagaaaaaaaatagccctcattgatcttcttactgtaagatatcagatttagtataaagctttccttccttctttatgacaattggcaagaactatctgtatcctactttactgtttacatagctttacacaactggaattagagtcaaaatttataggcagaaaaagtgacaactcttatagataactattcctctatccctc

SEQ ID NO: 21187 - DNA, 325 bp, Homo sapiens
ctttgtgtacatttattatctctccagtgacataaactcctcaggggcagtgtcccataaggggcacactagtcatttggagggaagccattgtaaaccttgataagcatgaagaaatctacaaatgaggagtattccagaaaaagcctcggctttggggaagtaaataataccaggagttactgagctggacacagcacacatacactgagtctttacaacagtcctgcctggaagatgttatcaccaccatttcatggataaggaaattgaaactcaaaaagatgtgaaaattgtctgaaaccactcagacctgtctgatttc

SEQ ID NO: 21188 - DNA, 433 bp, Homo sapiens
tcatcatgtataagctggttatagggcaaatatgtattcattactcattacatcctggacactttgccttggacttcgtgccacaatgatgaatgtggcatgatccctgtcttcaacagaaaatactatgaaagaaacatgtagagcttcactgagagagatccccaagggacttcgggaagctgagttatgtgaactgtattttatcaaatgaatgaaaagttagtcagcagatactatcgtctgaatgtctgtgtcagctcaaaatccatattttgaaatcctaacccccagtgtgaaggcattagaaggtgaggcccttgggaggtgactaggttaccaggaagaaccagcatgaatggaggctgaggcaggagaatggcgtgaacccgggaggcgaagcttgcagtgagccgagatcgcgccactgcgc

SEQ ID NO: 21189 - DNA, 366 bp, Homo sapiens
ctggggatggcctgtatctgctccacattccaagccaacaccatggccatcgggcaggaccaacctcaagctcaaacatggtgagaagccactgcccccaacccatgtggtgattccaaggaggctgagaaggttttggcatctttcctcatccttctgtaccccatggcaccattcccacattccagcaggtcttcagtcctgtagatgaagtctggaatgctctcactgaatagaaaagtcctcaggaaaatcccacattgcagagacgcatgtggtctgatggcaaagctgaaggaatagcctagcacccccacccatgtgcctctcaccgagtgacaggtaaaagatacaaagaaaactttt

SEQ ID NO: 21190 - DNA, 686 bp, Homo sapiens
ggaaaatgtaggctaccagtagaaaatgacattctctattaataagatctgaggtgcgacacacataattgtcccaatttttaagattgatggggagcatgaagcatttttttaatgtgttggcaggccccattaaatgcataaactgcataggactcatgtggtctgaatgtattttagggctttctgggaattgtcttgacagagaacctcagctggacaaagcagccttgatctgagtgagctaactgacacaatgaaactgtcaggcatgtttctgctcctctctctggctcttttctgctttttaacaggtgtcttcagtcagggaggacaggttgactgtggtgagttccaggacaccaaggtctactgcactcgggaatctaacccacactgtggctctgatggccagacatatggcaataaatgtgccttctgtaaggccatagtgaaaagtggtggaaagattagcctaaagcatcctggaaaatgctgagttaaagccaatgtttcttggtgacttgccagcttttgcagccttcttttctcacttctgcttatacttttgctggtggattcctttaattcataaagacatacctactctgcctgggtcttgaggagttcaatgtatgtctatttctcttgattcacttgtcaataaagtacattctgcaaaagca

SEQ ID NO: 21191 - DNA, 514 bp, Homo sapiens
  misc_feature (26)..(26): n is a, c, g, or t
cgcttttccaatcgttttttccccangctaagtatacactcagctggacaaagcagccttgatctgagtgagctaactgacacaatgaaactgtcaggcatgtttctgctcctctctctggctcttttctgctttttaacaggtgtcttcagtcagggaggacaggttgactgtggtgagttccaggacaccaaggtctactgcactcgggaatctaacccacactgtggctctgatggccagacatatggcaataaatgtgccttctgtaaggccatagtgaaaagtggtggaaagattagcctaaagcatcctggaaaatgctgagttaaagccaatgtttcttggtgacttgccagcttttgcagccttcttttctcacttctgcttatacttttgctggtggattcctttaattcataaagacatacctactctgcctgggtcttgaggagttcaatgtatgtctatttctcttgattcacttgtcaataaagtacattctgcaaaagca

SEQ ID NO: 21192 - DNA, 430 bp, Homo sapiens
  misc_feature (53)..(53): n is a, c, g, or t
  misc_feature (58)..(58): n is a, c, g, or t
ggggaggggtggcgacagcaaccaaacacaaaaaaaaaacccttgtgtcttantcagngagccttcagtcagggaggacaggttgactgtggtgagttccaggacaccaaggtctactgcactcgggaatctaacccacactgtggctctgatggccagacatatggcaataaatgtgccttctgtaaggccatagtgaaaagtggtggaaagattagcctaaagcatcctggaaaatgctgagttaaagccaatgtttcttggtgacttgccagcttttgcagccttcttttctcacttctgcttatacttttgctggtggattcctttaattcataaagacatacctactctgcctgggtcttgaggagttcaatgtatgtctatttctcttgattcacttgtcaataaagtacattctgcaaaagca

SEQ ID NO: 21193 - DNA, 416 bp, Homo sapiens
ataaataaccattcaagaaccatgaaccgacatagattaccccccttgcttcagtcagggaggacaggttgactgtggtgagttccaggacaccaaggtctactgcactcgggaatctaacccacactgtggctctgatggccagacatatggcaataaatgtgccttctgtaaggccatagtgaaaagtggtggaaagattagcctaaagcatcctggaaaatgctgagttaaagccaatgtttcttggtgacttgccagcttttgcagccttcttttctcacttctgcttatacttttgctggtggattcctttaattcataaagacatacctactctgcctgggtcttgaggagttcaatgtatgtctatttctcttgattcacttgtcaataaagtacattctgcaaaagca

SEQ ID NO: 21194 - DNA, 726 bp, Homo sapiens
ggaaaatgtaggctaccagtagaaaatgacattctctattaataagatctgaggtgcgacacacataattgtcccaatttttaagattgatggggagcatgaagcatttttttaatgtgttggcaggccccattaaatgcataaactgcataggactcatgtggtctgaatgtattttagggctttctgggaattgtcttgacagagaacctcagctggacaaagcagccttgatctgagtgagctaactgacacaatgaaactgtcaggcatgtttctgctcctctctctggctcttttctgctttttaacaggtgtcttcagtcagggaggacaggttgactgtggtgagttccaggacaccaaggtctactgcactcgggaatctaacccacactgtggctctgatggccagacatatggcaataaatgtgccttctgtaaggccatagtgaaaagtggtggaaagattagcctaaagcatcctggaaaatgctgagttaaagccaatgtttcttggtgacttgccagcttttgcagccttcttttctcacttctgcttatacttttgctggtggattcctttaattcataaagacatacctactctgcctgggtcttgaggagttcaatgtatgtctatttctcttgattcacttgtcaataaagtacattctgcaaaagcagtcaactttaaaaaacacattctggtctatttggactcat

SEQ ID NO: 21195 - DNA, 878 bp, Homo sapiens
  misc_feature (53)..(53): n is a, c, g, or t
  misc_feature (58)..(58): n is a, c, g, or t
ggggaggggtggcgacagcaaccaaacacaaaaaaaaaacccttgtgtcttantcagngagccttcagtcagggaggacaggttgactgtggtgagttccaggacaccaaggtctactgcactcgggaatctaacccacactgtggctctgatggccagacatatggcaataaatgtgccttctgtaaggccatagtgaaaagtggtggaaagattagcctaaagcatcctggaaaatgctgagttaaagccaatgtttcttggtgacttgccagcttttgcagccttcttttctcacttctgcttatacttttgctggtggattcctttaattcataaagacatacctactctgcctgggtcttgaggagttcaatgtatgtctatttctcttgattcacttgtcaataaagtacattctgcaaaagcaaaaaagaaaacaaaaaaaaaacgtaacctataaaaactacactatttatctaaagaggaaaaacagacaaacgccaacttgggccctcgaggccccccaccgggggaacttttgcggccgctcccctttaaggggggtaaatcaatgatccctacttcactaaattcgctgccctcggccgctcggtttgagatgagggggatcattttactcccaggcgtgtatacggttatacaccagttcttgggattttaccgtgaatgaaactttcggaccaatggccgccagaaggtcctggccccgataaagggccgcggtttgggggttttacacctacgcctcgcctcctaaacaatcttacgagatttgagcctaaagcgcaaaggggaaaacccgtccgtattcgaatttcccggcatgtccctttgaaattctctccccccttctg

SEQ ID NO: 21196 - DNA, 330 bp, Homo sapiens
  misc_feature (25)..(25): n is a, c, g, or t
tcatattagaaataattaaaagaanaaaaaaaaaccttcagggctttctgggaattgtcttgacagagaacctcagctggacaaagcagccttgatctgagtgagctaactgacacaatgaaactgtcaggcatgtttctgctcctctctctggctcttttctgctttttaacaggtgtcttcagtcagggaggacaggttgactgtggtgagttccaggacaccaaggtctactgcactcgggaatctaacccacactgtggctctgatggccagacatatggcaataaatgtgccttctgtaaggccatagtgtaagtattatattca

SEQ ID NO: 21197 - DNA, 553 bp, Homo sapiens
tacatctcccccctccccctaccaaatcccacaaaaaaagaaccctgggctttctgggaattgtcttgacagagaacctcagctggacaaagcagccttgatctgagtgagctaactgacacaatgaaactgtcaggcatgtttctgctcctctctctggctcttttctgctttttaacaggtgtcttcagtcagggaggacaggttgactgtggtgagttccaggacaccaaggtctactgcactcgggaatctaacccacactgtggctctgatggccagacatatggcaataaatgtgccttctgtaaggccatagtgaaaagtggtggaaagattagcctaaagcatcctggaaaatgctgagttaaagccaatgtttcttggtgacttgccagcttttgcagccttcttttctcacttctgcttatacttttgctggtggattcctttaattcataaagacatacctactctgcctgggtcttgaggagttcaatgtatgtctatttctcttgattcacttgtcaataaagtacattctgcaaaagca

SEQ ID NO: 21198 - DNA, 535 bp, Homo sapiens
acctatcccaactttttcttccccgttcaggctttctgggaattgtcttgacagagaacctcagctggacaaagcagccttgatctgagtgagctaactgacacaatgaaactgtcaggcatgtttctgctcctctctctggctcttttctgctttttaacaggtgtcttcagtcagggaggacaggttgactgtggtgagttccaggacaccaaggtctactgcactcgggaatctaacccacactgtggctctgatggccagacatatggcaataaatgtgccttctgtaaggccatagtgaaaagtggtggaaagattagcctaaagcatcctggaaaatgctgagttaaagccaatgtttcttggtgacttgccagcttttgcagccttcttttctcacttctgcttatacttttgctggtggattcctttaattcataaagacatacctactctgcctgggtcttgaggagttcaatgtatgtctatttctcttgattcacttgtcaataaagtacattctgcaaaagca

SEQ ID NO: 21199 - DNA, 1001 bp, Homo sapiens
tacatctcccccctccccctaccaaatcccacaaaaaaagaaccctgggctttctgggaattgtcttgacagagaacctcagctggacaaagcagccttgatctgagtgagctaactgacacaatgaaactgtcaggcatgtttctgctcctctctctggctcttttctgctttttaacaggtgtcttcagtcagggaggacaggttgactgtggtgagttccaggacaccaaggtctactgcactcgggaatctaacccacactgtggctctgatggccagacatatggcaataaatgtgccttctgtaaggccatagtgaaaagtggtggaaagattagcctaaagcatcctggaaaatgctgagttaaagccaatgtttcttggtgacttgccagcttttgcagccttcttttctcacttctgcttatacttttgctggtggattcctttaattcataaagacatacctactctgcctgggtcttgaggagttcaatgtatgtctatttctcttgattcacttgtcaataaagtacattctgcaaaagcaaaaaagaaaacaaaaaaaaaacgtaacctataaaaactacactatttatctaaagaggaaaaacagacaaacgccaacttgggccctcgaggccccccaccgggggaacttttgcggccgctcccctttaaggggggtaaatcaatgatccctacttcactaaattcgctgccctcggccgctcggtttgagatgagggggatcattttactcccaggcgtgtatacggttatacaccagttcttgggattttaccgtgaatgaaactttcggaccaatggccgccagaaggtcctggccccgataaagggccgcggtttgggggttttacacctacgcctcgcctcctaaacaatcttacgagatttgagcctaaagcgcaaaggggaaaacccgtccgtattcgaatttcccggcatgtccctttgaaattctctccccccttctg

SEQ ID NO: 21200 - DNA, 473 bp, Homo sapiens
aagacaggtaattttgagaatatcttaggccccccttctatcaaagagagggatcgaatttaaaatttatctggaatgccaactctgattaactccctggagagagtccctggaggactggttgagaagaaccctgaggatgcatcagtgttcatcaggaaagggcgccaacacccagcgtgcccactcatgagcagggaggagatgatgcatgggaatccacaactctatctcaagtttcccagacacacactaaagctctgcagaagattttggtgcccctgagctacttttacacagcaaagaagacttctgatgtgattcctggtggcagtgcgtagtatgcgatgatttccatcagagtggctgggtttgtcaaagctttattagagattcctatgatttgaagaaaaagccagggtcctattttggcaacttttctgatataagtaataaaaacaaaatgccatgaa

SEQ ID NO: 21201 - DNA, 323 bp, Homo sapiens
taaatacctatgttaatgtttattattgtacaattataaaatagaaatataatgtatagttctgcacttaatagaaaaaaaaacgaaaaaagcacttagattactaaaagacaagcagggagaaaaaattaggacaagtttcaacttttgtactttctagtacaaaataagatagaaaagaatccaaatgtatgtaaaacaacaaaatataaatagacaaactgcttgtcttaatagcaaaatttatcagactatatgaaaaatatagtccagctacatttgatttgtaagataaatgtaaaacataagaaaacagaatattg

SEQ ID NO: 21202 - DNA, 123 bp, Homo sapiens
acgcagttcagggaagaggtgggctctggagcccagcagcctgggctcatgtcctggcttagctactaattttaacaagtgaagtgctctatgctccagcttctcacctgttaaaaaaaaaaa

SEQ ID NO: 21203 - DNA, 842 bp, Homo sapiens
gggatataattgggaattagagtaataaaataaatattttaagtacttactacatattactcattaacacaaaagtaactttacgtataaaatgcatgacaagactccattataaagaagtgtctgaaagctatagggcagaaaggtatagaacacagtatagactagaaggagataaagacaatcagaagattttattcattcatttattcaacaaaaatttacagagtacctccaattatcagcagctgtgctgaagattaggtatattacctacacagttacaaattttgctttcatgtagtctgcaggaagagagacattaatcaaagaatggcactattgacacttgtgcaggaaagggttacgtcaacaggcctgggctgctcaaaccttgcgtattcccagagtctcaagactggtcttggcctggctcctgggaagattacttctgagcccttggctgagataggagtttatgccaacagtgtgatttatggcaaacacctgtttttgtatgcctgaggctttggatcatgctgtaccaatttgatctgaggcctgaagactggtagctaaggtgctgcatgcctacatgactgacctccagtaaaaaccctggacacatgcctcaagtgagtttcgttggttggcaacactttacatatgttgtcacacgttgttgctgagaaaattaagtgtactccatgtaatggcactgggagaggacaactggaagctggtgcttaatttctcctctactccacgctatccaccttttcacttcgctgagttttttctgtatcctttcaatgtaataaactttaaccatgagtataaca

SEQ ID NO: 21204 - DNA, 430 bp, Homo sapiens
tcaatttggacttgttcacaattgaacgttaacatagccttatagattagcctgttttcattggtccagagtattctccaaataaagcagggtctgtgcattttaagcaactcccctgaacaatttcatgggcattctcaaatttgagaactacctgaaaagctgtgttggagaaaagaacaaccaatgaatgtggcaggacagaatattgaacattaacttcccttttcctcttctcccatctgttctcttccattatccctacccgtccgctcagtctcgttattcaggcaacagttattttgccattatttcctcaagaaaggaacaaaagtaaacacaattgctttctgattttttttttttttttgcattttaaaatggactttgaaaccataagcaaagaggtgtttaagagtctttccaaagc

SEQ ID NO: 21205 - DNA, 531 bp, Homo sapiens
ttgatctccttctccagaaactcagagagactgtttttagaaccctcatctcccaatataggggtgggagtggtcagagagttataaatatcctgtcttccaaggcatggcttaccacaagtctccagtttgaatagttttagtacaaatctaatagctttgtttcaaacctttcctgaaacatgcttgggaacttagaggtgcggttcataagccaagttttgttgagccaaataatctaaatgattctgggcaaggtaatcaaattcttaacaggcagagaggctccaggacaaataagggtatctatccaatatttggggctttactgggtactaatgtctgtctgtcacctgcatttatcctccaagtactcctttgttctagagaagtgaatcccggtgatttttagcagttcccccaaagagaagatgttaggtattaaaaaaaaaaaagtaacatagacaataattacttttcattccttgtattcccagcatgtataaacaaccttctcccattcatatgatg

SEQ ID NO: 21206 - DNA, 154 bp, Homo sapiens
ttcagttcaggcaccacttcctccaggtaaattagatgcccttttactgtcatctcattctacctatgtttctttttttaaatctatcatctcctttatcatcctggaatggcctgtctgcccctcttgacaatatagttcctaaaagaaaaaa

SEQ ID NO: 21207 - DNA, 907 bp, Homo sapiens
tatctctgaagagcacactgctagcaacctgattgtaaatgaccagaaggacttatatccaacctatgtgacttaaacatacacttaagtactctaaaccactatttaaaaaatacttctagagagattctgaaatcttaatttggttgcactttctggtaatatattttttgaaaactattttgatatttctttcatataacattattggatctgtatcactaagttaattgtctaaaaggtaactgatttcatcaaaccttccagtattaataatttttaagccattttgaaactgaggcctaaaatactgaaatgcttatgtcgttgtacttactcctttctgaaatgatcagatttttaaaaaatggatttctcatataaataatattatcaaaaaaggatttctcatataaataatattatcaaaaaagctgattttaaaagtttctcccaaagtcttattctagtaattatagagacctaggtaatgagtggcagatatatctgcctttcagatatgccgtaatgtgaaaaataacacagtcatgtgatattctttattaactaaaactgtgttgtttttattttggagtagttctcataattcattggtagggaactatccagtatttatattcctatgtatgtatatcagattaattttgaggcttggtattcctaaaagatttggatgtgtgtatttctttaacttgacgtaaacatgtatcacaaacatatcttttaattccaattaaaggggtgctttggcacatgctgaaatctgggatttttttttttgactttgataaatttatcaaaaagattggaaccaaatgttaattagggtaagttgtctttgaaagtaaagtgaactgttttatttaatggaattgtgtgttttttg

SEQ ID NO: 21208 - DNA, 471 bp, Homo sapiens
cacctaaccttgacaatcttcctgtctgcccctcccctcctctgtggtctttggcaggctccgctcttgaggcgatgcaattctgctaactcttttctttattcagaatattgcaaaatatgtatttcttctgtggtctgcaaggaaatttaccttcactgagttaaaaataatccttaggctgggcacggtgactcatgtctataatcccagcactttgggaggccaaggtgggtggatcacttgaggtcaggagttcaagaccagcctggtcaacatagtgaaaccctttctttactgaaaatacaaaaaaattagccgggtgtggtggtacatgcctgtagtctcagctacttgggaggctgaggtgggagaatcgcttgacctgggagggggaggttgcagtgagcagagatggcgccactgcactccagcctgagtgacagagctagactctgtctcaaaaaaaaa

SEQ ID NO: 21209 - DNA, 341 bp, Homo sapiens
gtctccaaatcagatcatttttacttaagttcactgatttagctcatgtgaatttttcattcatctgttgtacttttcagctccagaatttccatttagttctctttgtactttagatttttctgttgagagcctatatatgttcagttgctattagtatatttttattgaattatttcagcatatttagagtaactgctttgaagtcttaggctgctaaattcagtatctggacccattcagaatcagttttagttggctgccttctttcccaagttatgtgtcacactttcctgtttttttatatgtcttactttcttattaaaagctagacattttta

SEQ ID NO: 21210 - DNA, 441 bp, Homo sapiens
aagtagaaatagatcagggatttcctagagctgggatgggggaagggatggagaatgacttgtaatgaatatgggttttttgggatgataacaacattataaaattacaatagtgatgtgatggttgcataactctgagtatgctacaaaccattgaattatacattttaaatgggatacttttatgatatgcaaattatatctcaataatgctgttataaaaactaattctttaatatgagtgacctggagataaccaacttcttgtggatcctggtggtggtgggagaaatattggaagctattgcttctaggtcatttggtgaaccaactaatttgtaccatggttgtgtatgagatgtgtgagaaatagagactgaatagtcttaccatggaatatatagaaagtagttcattatttactatatttaattcaaccac

SEQ ID NO: 21211 - DNA, 343 bp, Homo sapiens
tttgatatagtgtcttgctgtattgcccattctggaatcttgaaagcaatgatacaaatgtgaagtattcatttcctttatattgcttattctgcagatcaaacttatgcaaatagctgagtaaattttgtgtatcaagtcaaattttacagaaaatacagttttcatagccagaactcacaaggtaagaaaaccagaaccctcattgttacctagagaattatggagaaacctaccacatatctctttgaaaaaggtttcagtgtttgacaatgtacaatgtaaaaaatagccgtcgaagagttcaaaatagctagatacacctggtagtggtttctacatg

SEQ ID NO: 21212 - DNA, 388 bp, Homo sapiens
tagctgattatttaaggagtaaaacaatgtctttgtgtatactttattcgaaataatagatgaagggaacatcgctgcctggataaaatgaggaatgctaattctagtatttctagaggatttgtgtttgaattgactattattataatgattagagtttaaaggaatcttaaagatgatcagattcacccccttcctttcatctctcttgttgccctgagagattagctacttgtctgttacggtgctggtccattaggactgtagtccagatctcggtcactaggccagctgcctgtctgctgtgtgatgctgatgcatttcagccttttttcttttttaaaaaccctaattggaagcattttataagaggttttaatatttagtc

SEQ ID NO: 21213 - DNA, 422 bp, Homo sapiens
gacactttgtttctttattattttatttaattcttaaatttaatcctcacaatttatttagtcttcacaattagcctacaaaggaggcgtgattacacacattttacaaacaaaatttattcaaaggaacacagcaggccaggcgcggtggctcatgcctgtaatcccagcactttgggaggctgaggcgggcagatcacaaggtcaggagttcgagaccaacctggccaacatggtgaaaccctgtctctactaaaaatacagaaattagccgggcgtggtggtgcgcacctgtaatcgcagctacttgggaggccaaggcaggagaatcaattgaactcaggaggcggaggttgcagtgagctgattgtgccattgcactccatcctgggtgacagagcgagactgtctcaaaaaaaaaa

SEQ ID NO: 21214 - DNA, 452 bp, Homo sapiens
ggtgtcggcaggatacagtggagatgagggggaagttagtgaattggtggggctggagctcagagccagaccatcacaggagatggaggcctgcgagtcttcaggatctgtcactgaccaaagtcttgctcacggatgagcctatcatctgtggaagaaagtgtggaatgagatgagaacaggcctgggtggaggccagggaatcagcagagacagccaagaaggccagaggctaggaggcaaaccccacagtgtgcccctcctccccaggagccaagaccagagatggtttcaagagagggggccaggcacaatggctcccgcctgtgatcacagcactttaggaggctgaggctaaaggatggcttgaaaccaggagtttaagaccagcctagttaacaaagtgagatcccatctctacaaaacaaaaaatgaactgggtgtagtggtgc

SEQ ID NO: 21215 - DNA, 261 bp, Homo sapiens
ataacaaataagaagattaaatcagtaacaaaaagtctctcaaaaaagaaaagtccaagaccagatggattcactaatgaattctagcaaacttttaaataactaacaccattttttctcaaactacactgtgctcgccatgtatgtgtaccaaaactattgaggattagaattctccctcattcattctgtgagctagcgttacctgatataacgagacaggcacaacaaacaggaactgatggccaattgctgatgaag

SEQ ID NO: 21216 - DNA, 245 bp, Homo sapiens
ggcaggcgcctgtaatcccagctgcttgagaggccaaggtacaagaatcgcctgaacctaggaggtggaggttgcagtgagccaagatagcgccactgcattccagcctgggtaacagagcgagactcttgtctccaaaaaaaaaaatagacagctgtaccctgtgaatgacctgtgcatttgtgcttcttccttgcctgagtttttccctccttctgaaacactgtttcctctcttcctgatga

SEQ ID NO: 21217 - DNA, 441 bp, Homo sapiens
tatctcttaaatgtgagatgggaatgaagaataacctgggtctataaagctaattagtttgtggaagaaaataggaggtaatgggggccaggggagtattgataaaatactgttattttgccctttcaattgatcttgtgagtttttttttttaaagaaaatcttcataagcattcaaataaatttgaatattatgccatgaaatggaaaggatgtgaatgacgggagttcgtaacgccattctttttattcaccacaggaagtttctatcctgcagcccacttcagaatgtaaaggacattaagtaaatgtcagaattggtgccccatgtcccttttttggagatagacacctatgggagacaatcactaactgatttcaggattagataaatagataaataaaaacagcaacattgagatcccatctctactttttaaa

SEQ ID NO: 21218 - DNA, 521 bp, Homo sapiens
tcagctggacacaactgagcaaccctaactgtggccactatggaataaatttgccctgctgaaccatgctagaattattgattaccaaaatgatgagatacaataaattgcttattgtgctaagttttggagtagtttactaagtaacaatagataactggaactaaatttggtatctgaaagtggactttcactataacaaaaactgaaaacaaatggcaatgactttgtacctggttgccacagaagttagaaaggcctcgagaaaaatgttagtgaatactggaaggacatcgaggagactgctggagagactgaaggacagtaaagaaaatactatggggggtggctgaagaaatgacctgtgttatgtaatggcagaaagttttcgtctttgataatgtgggaaaatagaaaaggtgcccaatgaatgggaggatctggctaaggagattttcagcagaatttcaaaactacaaagaggtttcttttagccacattattatcagatattgattaaa

SEQ ID NO: 21219 - DNA, 420 bp, Homo sapiens
gcggccgcctactactactaaattcgcggccgcgtcgaggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaa

SEQ ID NO: 21220 - DNA, 542 bp, Homo sapiens
gaaagggtggccgagcgcgggcggaggactgatagcggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaacgaattttatgtttgcttgttaccacagggtttattctgattttgacacagctccgttatagataataactcgttgtgcctaatttggtccgagcttttttttagcccgtgcgcccgccctctt

SEQ ID NO: 21221 - DNA, 5019 bp, Homo sapiens
  misc_feature (1190)..(1190): n is a, c, g, or t
  misc_feature (1281)..(1281): n is a, c, g, or t
  misc_feature (1680)..(1680): n is a, c, g, or t
  misc_feature (2007)..(2007): n is a, c, g, or t
  misc_feature (2070)..(2070): n is a, c, g, or t
  misc_feature (2089)..(2089): n is a, c, g, or t
gggagggataggacagacagacaaagaaaggggtgcggcagcactgccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccccggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgaggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgaggtgagtgggcaccccgcgtgcgcaagggccgctatggcccccgcggtggggacggggctggggcctggctgcaccctcgcctcccagcccaggacagccgcttgcggcttttgtgtggaagaggctctgcttctagcgccagcagtgagcaagggggtgcagccctcccatactctcccaacccggggtcacagcaccgcagggaggacagcgggacgcgcgtcccgaggaggcngccccttcctggcctcggtttccagcccgtgttccgtgggatggctgagaggagtacatgggaccctgtccccaacagtggtgcagagggnacgctggacgctgggcagtggccccagtgaggccatacgcataccagaaggtgggcttctcggaccccaggccaacctcttcttcctccccagataacgtcctcctctcccagccacccggccaactccttctactacccgcggctgaaggccctgcctcccatcgccagggtgacactggtgcggctgcgacagagccccagggccttcatccctcccgccccagtcctgcccagcagggacaatgagattgtagacagcgcctcaggtaacggacatacaggtcacatgggacacacagcagccccgaaccctgccacagggcgaccaccaaacccgaacctaaggctctgagaaattccaagtagggattcgtagtgcgtactgcaagatggtgcntagaagatttaggattctgttgattcacacactgaagatgtgactcttgcacattatttgcagttgaaagcatcttacagggccacagcccagaggaaagaatgaaaggaggctccagacagtacctgagagactctgtcctgtcagacacgcacccacaggtgacctgtgtgtcacagctgacaaggaagcttgctaggatggccctgtgtggccaccgggtgacagctatgctgcagggcacctgtgggggtctcgggacccagccaccacacagctcggggctctgctcacaggcgccttggcctggggcggggcaggtgctgntgagcattctcctagctcttccaggcacctgctggacagggcaggctgggaacgctggggccnagtggcagttccctccctnctcagctgggtggcagccactggcctcacggagcgcctgtggtctggagcgcattgctgggtcgtgggtcagggcctgttggctctgggtctctgggtctcacctgatatgggtgtgggacagtcagtgtaggccccagacaacagcggacttcagactttcccgaggaggaactggagcccaccaacctggccatgggccccgtcgtcctccaccctccatgttgctggctggagttgaggcaggtacggggccgccccacacctgccccccaagccatgtggtagggacagatgtcgtcttgaggagcagcagtaattacaagcttactgtcagccgtccctggaagcaagggccaggtcaggtcagacaggaggccgcctggctggcgggaaccactccccagacagagactgtgcccagtcctgggtccctcctcatttgggatgaactgggcctccctgtgccagcctcggtgctgcccctgcccagtgcaggcttgggctcctcactcatttgtccacgcggatgccccattccaagcagatgtccccgagccacttacccaacaggcagacgtgccagcactgtccgtggtgtgcaactggtctggcgggaagagcccctcgtgggcagagggtccagagaggtgcggtttgccccacatttgggggcactgggccacagtgggcaggggagcacgtggccagtgccctgggctaggagagggataaagtcagctgtggccaagcagaagcagtattgcaggggaagggtggggagagactgtgctatgagctctgagcaggaggcaggacatggagagaagggtgggagacggacagagccagctgtgccagccgagggaccagagtgggcagtggggacggagcacagaccaccgcccacaagggtctctcctgtgacttctggcttcccgagggcagaggctgggatgggcatgtggcggctggcacccaggaggctccgccaggtccacgccaagccagcctggctcagctctggcttcctgctcacacgctggatgcctgtccccaggcctcctgacagggctctgcagcattggagaggcttgtggtggggccctcgctgtagaacaggcactgccagtgctcactgactcctcattgcagccagggcaggggcgctcccaccacctcggtttcagtcaggaagctggggggtgctgggatctgccagcagctctgtgtgctccccaggtgggctgcccggggccctggctctctggcttctacaccagtgcccctgcgaagcctcagcgcccaaggtctttgcaagccctgttcctgcatctctggagagggctgctccaggtgtgggcctggccagggcttccagaccagtccaggcactgcacctgcacattgacccccttctccactctctctcatccttcagtagccacaaagctggcagcagggtactcgcagatttgtgaggagagccgagcccttgctgactgtcctcccgtgcacggcagagtgaggcggggctcctggcctccttaggggctgcccgctctgggccacacagccagagaaacactgtccatctggctggcttggcctgtggggtgcaaaagaggtgttttcactttgctttggaaacatggaaattaccaagtgacttaaccataacaccaaatgatgatttttaaatttatgaaaattatggaaccagatgggacacagggaaacgagaacgatactgaaaaggtctgagtcctgtggggggtccaggtcccgcaagacagctaatcaggtgcccctgtctgttattcgggtaaatgtagcagctgggtccaggctcgggcagagcagctttctacagcaggggtgtccgccctctcccggggttcccacggggttcccaggggcctcttactctgccacgatgtgggagttccaccaccacagggacttgagcggcagctccggctcttacgtagaaacgcgcaactccagtccctaggttgtgtccgaggttgctatggtgccatcccatcttgccgctcactctgcgactgtgcggagaaacgcaagtgcccccgaagggtgggcgtggcctctgatgaatgcacacgttggtgggaggtggcttccgtttgtacgaagcgcctcttcacgcgagcgttcacctcggtctcccctttgcttggtccagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaa

SEQ ID NO: 21222 - DNA, 1971 bp, Homo sapiens
gggagggataggacagacagacaaagaaaggggtgcggcagcactgccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccccggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgaggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactggtgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaaaaaaaaaatactgaacttttaaaataaagtactaatttagatgtaatgtttaaagtatgtaaaaaaaaaacttcctcgtgccaaatttgggacgagcctttgttgaagcccgtgca

SEQ ID NO: 21223 - DNA, 4310 bp, Homo sapiens
  misc_feature (1261)..(1261): n is a, c, g, or t
  misc_feature (1588)..(1588): n is a, c, g, or t
  misc_feature (1651)..(1651): n is a, c, g, or t
  misc_feature (1670)..(1670): n is a, c, g, or t
gggagggataggacagacagacaaagaaaggggtgcggcagcactgccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccccggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgaggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactggtgcggctgcgacagagccccagggccttcatccctcccgccccagtcctgcccagcagggacaatgagattgtagacagcgcctcaggtaacggacatacaggtcacatgggacacacagcagccccgaaccctgccacagggcgaccaccaaacccgaacctaaggctctgagaaattccaagtagggattcgtagtgcgtactgcaagatggtgcntagaagatttaggattctgttgattcacacactgaagatgtgactcttgcacattatttgcagttgaaagcatcttacagggccacagcccagaggaaagaatgaaaggaggctccagacagtacctgagagactctgtcctgtcagacacgcacccacaggtgacctgtgtgtcacagctgacaaggaagcttgctaggatggccctgtgtggccaccgggtgacagctatgctgcagggcacctgtgggggtctcgggacccagccaccacacagctcggggctctgctcacaggcgccttggcctggggcggggcaggtgctgntgagcattctcctagctcttccaggcacctgctggacagggcaggctgggaacgctggggccnagtggcagttccctccctnctcagctgggtggcagccactggcctcacggagcgcctgtggtctggagcgcattgctgggtcgtgggtcagggcctgttggctctgggtctctgggtctcacctgatatgggtgtgggacagtcagtgtaggccccagacaacagcggacttcagactttcccgaggaggaactggagcccaccaacctggccatgggccccgtcgtcctccaccctccatgttgctggctggagttgaggcaggtacggggccgccccacacctgccccccaagccatgtggtagggacagatgtcgtcttgaggagcagcagtaattacaagcttactgtcagccgtccctggaagcaagggccaggtcaggtcagacaggaggccgcctggctggcgggaaccactccccagacagagactgtgcccagtcctgggtccctcctcatttgggatgaactgggcctccctgtgccagcctcggtgctgcccctgcccagtgcaggcttgggctcctcactcatttgtccacgcggatgccccattccaagcagatgtccccgagccacttacccaacaggcagacgtgccagcactgtccgtggtgtgcaactggtctggcgggaagagcccctcgtgggcagagggtccagagaggtgcggtttgccccacatttgggggcactgggccacagtgggcaggggagcacgtggccagtgccctgggctaggagagggataaagtcagctgtggccaagcagaagcagtattgcaggggaagggtggggagagactgtgctatgagctctgagcaggaggcaggacatggagagaagggtgggagacggacagagccagctgtgccagccgagggaccagagtgggcagtggggacggagcacagaccaccgcccacaagggtctctcctgtgacttctggcttcccgagggcagaggctgggatgggcatgtggcggctggcacccaggaggctccgccaggtccacgccaagccagcctggctcagctctggcttcctgctcacacgctggatgcctgtccccaggcctcctgacagggctctgcagcattggagaggcttgtggtggggccctcgctgtagaacaggcactgccagtgctcactgactcctcattgcagccagggcaggggcgctcccaccacctcggtttcagtcaggaagctggggggtgctgggatctgccagcagctctgtgtgctccccaggtgggctgcccggggccctggctctctggcttctacaccagtgcccctgcgaagcctcagcgcccaaggtctttgcaagccctgttcctgcatctctggagagggctgctccaggtgtgggcctggccagggcttccagaccagtccaggcactgcacctgcacattgacccccttctccactctctctcatccttcagtagccacaaagctggcagcagggtactcgcagatttgtgaggagagccgagcccttgctgactgtcctcccgtgcacggcagagtgaggcggggctcctggcctccttaggggctgcccgctctgggccacacagccagagaaacactgtccatctggctggcttggcctgtggggtgcaaaagaggtgttttcactttgctttggaaacatggaaattaccaagtgacttaaccataacaccaaatgatgatttttaaatttatgaaaattatggaaccagatgggacacagggaaacgagaacgatactgaaaaggtctgagtcctgtggggggtccaggtcccgcaagacagctaatcaggtgcccctgtctgttattcgggtaaatgtagcagctgggtccaggctcgggcagagcagctttctacagcaggggtgtccgccctctcccggggttcccacggggttcccaggggcctcttactctgccacgatgtgggagttccaccaccacagggacttgagcggcagctccggctcttacgtagaaacgcgcaactccagtccctaggttgtgtccgaggttgctatggtgccatcccatcttgccgctcactctgcgactgtgcggagaaacgcaagtgcccccgaagggtgggcgtggcctctgatgaatgcacacgttggtgggaggtggcttccgtttgtacgaagcgcctcttcacgcgagcgttcacctcggtctcccctttgcttggtccagttccagaaacgccgctggactgcgaggtctccctgtggtcgtcctggggactgtgcggaggccactgtgggaggctcgggaccaagagcaggactcgctacgtccgggtccagcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaa

SEQ ID NO: 21224 - DNA, 1246 bp, Homo sapiens
  misc_feature (13)..(13): n is a, c, g, or t
atctcgtgaccgncgattatatctgaatatggaaccagatgggacacagggaaacgagaacgatactgaaaaggtctgagtcctgtggggggtccaggtcccgcaagacagctaatcaggtgcccctgtctgttattcgggtaaatgtagcagctgggtccaggctcgggcagagcagctttctacagcaggggtgtccgccctctcccggggttcccacggggttcccaggggcctcttactctgccacgatgtgggagttccaccaccacagggacttgagcggcagctccggctcttacgtagaaacgcgcaactccagtccctaggttgtgtccgaggttgctatggtgccatcccatcttgccgctcactctgcgactgtgcggagaaacgcaagtgcccccgaagggtgggcgtggcctctgatgaatgcacacgttggtgggaggtggcttccgtttgtacgaagcgcctcttcacgcgagcgttcacctcggtctcccctttgcttggtccagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaa

SEQ ID NO: 21225 - DNA, 1855 bp, Homo sapiens
gggagggataggacagacagacaaagaaaggggtgcggcagcactgccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccccggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgaggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactggtgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaa

SEQ ID NO: 21226 - DNA, 5093 bp, Homo sapiens
  misc_feature (1264)..(1264): n is a, c, g, or t
  misc_feature (1355)..(1355): n is a, c, g, or t
  misc_feature (1754)..(1754): n is a, c, g, or t
  misc_feature (2081)..(2081): n is a, c, g, or t
  misc_feature (2144)..(2144): n is a, c, g, or t
  misc_feature (2163)..(2163): n is a, c, g, or t
cggctgctcccctctgtgctcccaggtgatggaaaaccccagcccggccgccgccctgggcaaggccctctgcgctctcctcctggccactctcggcgccgccggccagcctcttgggggagagtccatctgttccgccagagccccggccaaatacagcatcaccttcacgggcaagtggagccagacggccttccccaagcagtaccccctgttccgcccccctgcgcagtggtcttcgctgctgggtaagtacagccccctcctcgcctcctgctccaccaggagggctgcggcgccggagccccccgcacagctgcacggcggcgcttcccagtctggggcgtgctgacgtcgggagactctaacaccagaatgtttgccgagcgcctgcggtgtgcggttccggggatgcggtgggggcagggggcgctcacggggagggcgcaggtgggtcgcggcaggggcagccacagggtgtcacggtccgacgtgactgggggccatggttccctgcgggcggcggggagggatttcctggggcgccccctggaatccaagcccgaccgcagtgtctgaccatggtccgcggcgcggccgggtggtcctgcaggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgaggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgaggtgagtgggcaccccgcgtgcgcaagggccgctatggcccccgcggtggggacggggctggggcctggctgcaccctcgcctcccagcccaggacagccgcttgcggcttttgtgtggaagaggctctgcttctagcgccagcagtgagcaagggggtgcagccctcccatactctcccaacccggggtcacagcaccgcagggaggacagcgggacgcgcgtcccgaggaggcngccccttcctggcctcggtttccagcccgtgttccgtgggatggctgagaggagtacatgggaccctgtccccaacagtggtgcagagggnacgctggacgctgggcagtggccccagtgaggccatacgcataccagaaggtgggcttctcggaccccaggccaacctcttcttcctccccagataacgtcctcctctcccagccacccggccaactccttctactacccgcggctgaaggccctgcctcccatcgccagggtgacactggtgcggctgcgacagagccccagggccttcatccctcccgccccagtcctgcccagcagggacaatgagattgtagacagcgcctcaggtaacggacatacaggtcacatgggacacacagcagccccgaaccctgccacagggcgaccaccaaacccgaacctaaggctctgagaaattccaagtagggattcgtagtgcgtactgcaagatggtgcntagaagatttaggattctgttgattcacacactgaagatgtgactcttgcacattatttgcagttgaaagcatcttacagggccacagcccagaggaaagaatgaaaggaggctccagacagtacctgagagactctgtcctgtcagacacgcacccacaggtgacctgtgtgtcacagctgacaaggaagcttgctaggatggccctgtgtggccaccgggtgacagctatgctgcagggcacctgtgggggtctcgggacccagccaccacacagctcggggctctgctcacaggcgccttggcctggggcggggcaggtgctgntgagcattctcctagctcttccaggcacctgctggacagggcaggctgggaacgctggggccnagtggcagttccctccctnctcagctgggtggcagccactggcctcacggagcgcctgtggtctggagcgcattgctgggtcgtgggtcagggcctgttggctctgggtctctgggtctcacctgatatgggtgtgggacagtcagtgtaggccccagacaacagcggacttcagactttcccgaggaggaactggagcccaccaacctggccatgggccccgtcgtcctccaccctccatgttgctggctggagttgaggcaggtacggggccgccccacacctgccccccaagccatgtggtagggacagatgtcgtcttgaggagcagcagtaattacaagcttactgtcagccgtccctggaagcaagggccaggtcaggtcagacaggaggccgcctggctggcgggaaccactccccagacagagactgtgcccagtcctgggtccctcctcatttgggatgaactgggcctccctgtgccagcctcggtgctgcccctgcccagtgcaggcttgggctcctcactcatttgtccacgcggatgccccattccaagcagatgtccccgagccacttacccaacaggcagacgtgccagcactgtccgtggtgtgcaactggtctggcgggaagagcccctcgtgggcagagggtccagagaggtgcggtttgccccacatttgggggcactgggccacagtgggcaggggagcacgtggccagtgccctgggctaggagagggataaagtcagctgtggccaagcagaagcagtattgcaggggaagggtggggagagactgtgctatgagctctgagcaggaggcaggacatggagagaagggtgggagacggacagagccagctgtgccagccgagggaccagagtgggcagtggggacggagcacagaccaccgcccacaagggtctctcctgtgacttctggcttcccgagggcagaggctgggatgggcatgtggcggctggcacccaggaggctccgccaggtccacgccaagccagcctggctcagctctggcttcctgctcacacgctggatgcctgtccccaggcctcctgacagggctctgcagcattggagaggcttgtggtggggccctcgctgtagaacaggcactgccagtgctcactgactcctcattgcagccagggcaggggcgctcccaccacctcggtttcagtcaggaagctggggggtgctgggatctgccagcagctctgtgtgctccccaggtgggctgcccggggccctggctctctggcttctacaccagtgcccctgcgaagcctcagcgcccaaggtctttgcaagccctgttcctgcatctctggagagggctgctccaggtgtgggcctggccagggcttccagaccagtccaggcactgcacctgcacattgacccccttctccactctctctcatccttcagtagccacaaagctggcagcagggtactcgcagatttgtgaggagagccgagcccttgctgactgtcctcccgtgcacggcagagtgaggcggggctcctggcctccttaggggctgcccgctctgggccacacagccagagaaacactgtccatctggctggcttggcctgtggggtgcaaaagaggtgttttcactttgctttggaaacatggaaattaccaagtgacttaaccataacaccaaatgatgatttttaaatttatgaaaattatggaaccagatgggacacagggaaacgagaacgatactgaaaaggtctgagtcctgtggggggtccaggtcccgcaagacagctaatcaggtgcccctgtctgttattcgggtaaatgtagcagctgggtccaggctcgggcagagcagctttctacagcaggggtgtccgccctctcccggggttcccacggggttcccaggggcctcttactctgccacgatgtgggagttccaccaccacagggacttgagcggcagctccggctcttacgtagaaacgcgcaactccagtccctaggttgtgtccgaggttgctatggtgccatcccatcttgccgctcactctgcgactgtgcggagaaacgcaagtgcccccgaagggtgggcgtggcctctgatgaatgcacacgttggtgggaggtggcttccgtttgtacgaagcgcctcttcacgcgagcgttcacctcggtctcccctttgcttggtccagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaa

SEQ ID NO: 21227 - DNA, 1766 bp, Homo sapiens
gggagggataggacagacagacaaagaaaggggtgcggcagcactgccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccccggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgaggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactggtgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcgctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaa

SEQ ID NO: 21228 - DNA, 1743 bp, Homo sapiens
aggatttaggtgtaggagttagttataaaataaacaaatggtaagaaagtacctgaattagacaatccagtgcctataactttgcattttttattagagatgcatttctcgtctgtgtgcctaaagggcaatgggttgaaattgctttaactaccacagcgaaatatttgacaaatccttcagcaatggcctatcattcaacatatattagcacagtgctaggtatttgcagtggtattttgttaccttaaaacggccaaatgcatttagttgaaatgtagttgatagtaagggttttatataactttatccaatctctaaagtttatggaagcattgactttcttctttgctgtcttttctgagtgatgaaaatgatgcattccttttttttccttgaaaactcagcaaatgtttgtaaccagatgttccttgtttcacatgtttactgtgtaacactacagcatatttaatattggtaaatactgtatttcagtcattatgcataagtacattcctgaggtatatttgccatcattttgggattcagttattttatcttctgtttgggtcagaaaaacttgaactatctgaggtggtatgcaggccattttctagaagattgttttttgaatctgtagtttatcaaggacttgttccccccctccctttgtttagaagaggaatcagaaaaggggggtggtgtgtagaaaaggcctttgatttgataggtgtaatttctaagattgaaattttaaaaatgcagatcgtaagatagtaacactcaaacttgataaaatcctttgaattgaaattagtatgaaatttttatggaaccaaatgccttcaggtcaccctggaaatagtctttgtatgtgaaagatcaacacaaacattggtcaggaaccctgacagccaatatatgaaggagcctgggatagtaactaggttacactaaagttattttcaactaagatagctagacgagtgtacaaaccaatagctcctattctggaaggttttctttttattaaaaaaaattcaaacaaggttaaaagtcaagcaagaagggaagagagaaactgggttctgagaaaaaaatgtgccagtataaaataaactcctaaatgcgtgcttgtcatcctctagtttttttttaagttgaatttcttttccactgtaacttaagatttgagattgaggtttgcggtccagaacataccctcagcagatacagtgactaactggaaagtgcagttgttcaaggtctgtcatgctcaatcacctaaagctataatttgtttgatatattaagcatgtagacctagtgcagcatgggagccactcaggaagtttatgcaattaataaactttcagcataatttactatgaagtatgcagaatttcaccctcttctccacacttaacatttagttgtatatgtgaactctcctttcttaattggggaatgtagcattatatagaatgttgttaaagttaattttaatcctttttgacattaacctttttttttttttggtaaaccaagtgatctgcctttcagcaactgtcttattttggttctttgaaactgtgatttttatttcatttgtacccaaccattgtaagtattttgttttgtttcctggaaattctgttttgaaacagaaaataaaggctgtgttaaatgagtatgttatcttattaaaatgctgccatagtcactgcaaaaaaatggctaaaa

SEQ ID NO: 21229 - DNA, 1688 bp, Homo sapiens
aggatttaggtgtaggagttagttataaaataaacaaatggtaagaaagtacctgaattagacaatccagtgcctataactttgcattttttattagagatgcatttctcgtctgtgtgcctaaagggcaatgggttgaaattgctttaactaccacagcgaaatatttgacaaatccttcagcaatggcctatcattcaacatatattagcacagtgctaggtatttgcagtggtattttgttaccttaaaacggccaaatgcatttagttgaaatgtagttgatagtaagggttttatataactttatccaatctctaaagtttatggaagcattgactttcttctttgctgtcttttctgagtgatgaaaatgatgcattccttttttttccttgaaaactcagcaaatgtttgtaaccagatgttccttgtttcacatgtttactgtgtaacactacagcatatttaatattggtaaatactgtatttcagtcattatgcataagtacattcctgaggtatatttgccatcattttgggattcagttattttatcttctgtttgggtcagaaaaacttgaactatctgaggtggtatgcaggccattttctagaagattgttttttgaatctgtagtttatcaaggacttgttccccccctccctttgtttagaagaggaatcagaaaaggggggtggtgtgtagaaaaggcctttgatttgataggtgtaatttctaagattgaaattttaaaaatgcagatcgtaagatagtaacactcaaacttgataaaatcctttgaattgaaattagtatgaaatttttatggaaccaaatgccttcaggtcaccctggaaatagtctttgtatgtgaaagatcaacacaaacattggtcaggaaccctgacagccaatatatgaaggagcctgggatagtaactaggttacactaaagttattttcaactaagatagctagacgagtgtacaaaccaatagctcctattctggaaggttttctttttattaaaaaaaattcaaacaaggttaaaagtcaagcaagaagggaagagagaaactgggttctgagaaaaaaatgtgccagtatatcttttccactgtaacttaagatttgagattgaggtttgcggtccagaacataccctcagcagatacagtgactaactggaaagtgcagttgttcaaggtctgtcatgctcaatcacctaaagctataatttgtttgatatattaagcatgtagacctagtgcagcatgggagccactcaggaagtttatgcaattaataaactttcagcataatttactatgaagtatgcagaatttcaccctcttctccacacttaacatttagttgtatatgtgaactctcctttcttaattggggaatgtagcattatatagaatgttgttaaagttaattttaatcctttttgacattaacctttttttttttttggtaaaccaagtgatctgcctttcagcaactgtcttattttggttctttgaaactgtgatttttatttcatttgtacccaaccattgtaagtattttgttttgtttcctggaaattctgttttgaaacagaaaataaaggctgtgttaaatgagtatgttatcttattaaaatgctgccatagtcactgcaaaaaaatggctaaaa

SEQ ID NO: 21230 - DNA, 195 bp, Homo sapiens
tatttgtcgcctacagtcttctgtaaaatctgactttatctttggtagatgatgtggcccggcggtgagagactgtagaagctgtaacttggcacaaagatctgtttaacgttggtccttaggaagcctggctcctctcacacctagttattcagaagggaccattagacattgctgtggctaaagacactggcc

SEQ ID NO: 21231 - DNA, 390 bp, Homo sapiens
gccattatcttccaccatctgcctctccatctatatcaactgccacctgcccatgccctagtgatgtcacttgcagttccacaactggcctgtgctgtttgatgctttgagatcttcaaactttctgccctgaactattcctcccctcctcttagttagcaagttcatgcacatccttcagaacctctcccaagcatgtcctgtgcatccttccctgacataaatatcctctcctctgtttgctaccaacacatagaactatttatcaaaattatcatagccactattttcagctctcatgtgccaggcatagtattgaacacttagcatgtttgctgggtacaaatattgaaccacagacataattaagggagaaatgttactgtttct

SEQ ID NO: 21232 - DNA, 317 bp, Homo sapiens
gtacttgtgataagccaaaaggaaggataaaacatacacatatgctgagtagggcactctaatcactcaagtttttgctattgccacctcagctggttcatgctggtaatatgcagaatttttttagaaatgttttattactattgaaaaatgaaactcctcggaataacattcagagtccaacattattcttctttaacaactgtattgcctacttcacagcataacatagttacagggagtaactgagtaaacaggtgtcaattgctgagaaaaatacctcattgtggtggtgaggtggagttaatctttacaaa

SEQ ID NO: 21233 - DNA, 100 bp, Homo sapiens
cttgccttcaaatctggactcagggggagatagattaagggcctgcctacatggtatgagttgagataggtgagagtaatgttttctcttatacttggat

SEQ ID NO: 21234 - DNA, 1089 bp, Homo sapiens
gaaacttcctgggcctcaagttccttgtatcagaaaggatggcattcagctgcgtacaacagaaaaccaaatcacagtggcttatccaagaaaagttcaatttttctcaaaactacagcgtcctgggctgatgcggcagccccaggacgacctcagcatctcactcctcctttctttactcggccccatcctcaggctgtgactttcatcctcaggtttgtcatcttttggtggtaagatggttgctctacctcaagctcacaaaaagaaatgggggaaagcaggaaagaagaaaatttgcttccccagagactttgaggctgcacttgcacatcttatggatccaaactgtgtcccatggctgcccctagatgcaaggggcctggggaaatgagcggattcatcaggtacactgcaaccgtacatgaaaggaaagttctgtcaataaagaagagcgaaatctacatttggtcaggaaacagcattgcctgcaatatgcctcatatgaaataaagcctttcttgcccccattctgctactcggtcattcttgcactcaacaaatagatgttgagtgcccactctctccaggccatgttctaggtgctgcggatgcaatcctgaatctatgaacacgattggcagaacaataaatattgattgtcttggccactcaccaaataaagtgctcctgggaaggctgagatctaatgcaaagcagcagcttgactttctcactccctggcaacaatgccaagcaagagaaagcgatgggtaaggcctggctcaagagtctcactgcaacctgcactgtagattctacctgctaatttcctcagccttctctggttttgggcttcagaatgccctaactctgggcccggcgcggtggctcacgcctgtaaacccatcactttgggaggccaaggcgggtggatcacaagatcaagaccatcctggccaacatggtgaaaccctgtctctactgaaaatacaaaaattagctgggcatggtggcttgtgcttgtaatccagctacttggaaggctgaggctggaggatcgcttgaacccagaaggcagaggttgca

SEQ ID NO: 21235 - DNA, 322 bp, Homo sapiens
cctgtggaaaaaggtgacttctgagtgagctgtaaggccaggatgatcaaagaaattttaggaggagattcacctcatttgataatacattgattgcttggctataattcacactcccttcattacctcaagtcttcagacaagactttacaaaaggtttggaggtaagaaaagcttagtataaggtttgaggttaggcatggtagctcatgcctataatcctagtgctttgggaagctgaggcaggaagattgcttgaagccaggagttcaagactggcctgggcaacatagcaagatcccatctctacaaaaaaaaattg

SEQ ID NO: 21236 - DNA, 1512 bp, Homo sapiens
actcacttggattattgcaataatttcctaactgggttccatgtttccagcttttctgtctgcagtctgttttgttttcaacatgtggccagagggatcctgttaacatctaagtgaaatatatcatttctctgcagtggctccctagctgctcagagtaaaatctaatgtttttacaatggcctgaaaggctctccataaccttatcccctcccacttacctccctgtctcctctcctccctccgacactcagcccctgtgtattttagctattgaaagaatatgtgggcacactgctaatttattgtctttgtggaggcttggtttgtgcattccttatttcaaacacttatgggtggactctggtaatgggcagtcatatttatgagtccccctccaagtgaggagatgtactaggtggaatgtgcgccctccctcacgtggtatactcttgatacagagccaagcaggtagtaccgttggtcctgctttgtaggtgagggaaagcagacccaaaatgaaggaagttgtccagggttacatgctgggaagtggtggaggtagaattcaaacccggagcgcaggcgttgtctgcacctcggagaggcaccgctcttcctgaaatgctcctccctggttatctatgaggctgaagtcctcacctctttcaggtctttgctgaattagaaccttctccataaggcaaggctgatgctgagcaccccactgaaaattttcctctctcccaagaccctcttctcagtccctctacttggctcatttcaggtgtctagcacgtcacgccctttaatacattttgcaagtatttctccacgagtgtgagaaagtggttttctttggtgggggttgatttttcatggcacataaagggcagcagggtttctttgggtcctgtctggaggcctgaaggtcacgctgggcttctggggagcgggtccccttcctgcagcctccctctccacttgcgtgtttctcactcctctctctccctgggaagtgttgcttgataaagatgcagcttttaattaatgtaactgttcaagattacagccggtcatcagctttctaaccagtgcctcacagctctgctggaagagccttgctccggtgatggttgatttgccattctctgtcccagcccagagaagctcccctcactgtcaacgtgccatctgtcaggtgcatgttataaagctgtcatcatgatcagctcattcacgcaccagctttagctttgaggaactgccggccatggcgttgaagacctgctgaagcctccagccagacatctgatgttcaggtctcagggggtccttgctgcttgtgtagcctgacaggtgtggccacggcaggcacaccatggtttggagtttggaaagaagagaccctgtgttattgtagagtgaccactggattgggcttctggaaatccaattctaatcagacttgggttatgcatttactatttcaataaaacatttatggatgga

SEQ ID NO: 21237 - DNA, 1590 bp, Homo sapiens
actcacttggattattgcaataatttcctaactgggttccatgtttccagcttttctgtctgcagtctgttttgttttcaacatgtggccagagggatcctgttaacatctaagtgaaatatatcatttctctgcagtggctccctagctgctcagagtaaaatctaatgtttttacaatggcctgaaaggctctccataaccttatcccctcccacttacctccctgtctcctctcctccctccgacactcagcccctgtgtattttagctattgaaagaatatgtgggcacactgctaatttattgtctttgtggaggcttggtttgtgcattccttatttcaaacacttatgggtggactctggtaatgggcagtcatatttatgagtccccctccaagtgaggagatgtactaggtggaatgtgcgccctccctcacgtggtatactcttgatacagagccaagcaggtagtaccgttggtcctgctttgtaggtgagggaaagcagacccaaaatgaaggaagttgtccagggttacatgctgggaagtggtggaggtagaattcaaacccggagcgcaggcgttgtctgcacctcggagaggcaccgctcttcctgaaatgctcctccctggttatctatgaggctgaagtcctcacctctttcaggtctttgctgaattagaaccttctccataaggcaaggctgatgctgagcaccccactgaaaattttcctctctcccaagaccctcttctcagtccctctacttggctcatttcaggtgtctagcacgtcacgccctttaatacattttgcaagtatttctccacgagtgtgagaaagtggttttctttggtgggggttgatttttcatggcacataaagggcagcagggtttctttgggtcctgtctggaggcctgaaggtcacgctgggcttctggggagcgggtccccttcctgcagcctccctctccacttgcgtgtttctcactcctctctctccctgggaagtgttgcttgataaagatgcagcttttaattaatgtaactgttcaagattacagccggtcatcagctttctaaccagtgcctcacagctctgctggaagagccttgctccggtgatggttgatttgccattctctgtcccagcccagagaagctcccctcactgtcaacgtgccatctgtcaggtgcatgttataaagctgtcatcatgatcagctcattcacgcaccagctttagctttgaggaactgccggccatggcgttgaagacctgctgaagcctccagccagacatctgatgttcaggtctcagggggtccttgctgcttgtgtagcctgacaggtgtggccacggcaggcacaccatggtttggagtttggaaagaagagaccctgtgttattgtagagtgaccactggattgggcttctggaaatccaattctaatcagacttgggttatgcatttactatttcaataaaacatttatggatggactctggtaatcaacagccatatttttgagtacccactgcaggtgaggaaataaatgtactaggtgcgatatacatcct

SEQ ID NO: 21238 - DNA, 365 bp, Homo sapiens
gtgttgtatacaattactactgctttattttttcagagtacaagcaatgtaaggctcacagaggaaactttggaacaattatatattgttttaacttcaggaataagttcatactacttttatttcctattacaatttttagcaaaattgtataaagttactgggaaggcaaattactgcatgtaagataaaaatatgtttctgagaggacaaaatatcttgaactgaaaagaatgcctctgtgtattttagtcagaaacagtattaataactacatgacacaaaaacatgtgaacactttggaaaaatatttagtatagattaaccatttctatgattgcaatgctaacatataggaactcaat

SEQ ID NO: 21239 - DNA, 770 bp, Homo sapiens
ggtgcgacaagaacaaaacaagatgttaatctgtcataggaaagtcttaaaaggcgccgggaccgttggtaaaactgatggcactcagttgaaagagttagctcttcagtggacgcaagcaaacaggtgactccagcactttgggaggccgaggtgggaagattacttgagcccaggagttcaagacctgcctgagcatagcgagaccctgtctctacaaaaaaatttaaaattacccaggtgtggtggcatgcacctgtagtcccagctactcaggaggctgaggtgggaggatcacttgagcccagaatgtcgaggctgcaatgagccatggtcatgccattgcactccaacctgggcaagagaacgagaccctgtctcaaaaaaagagagaaaaaaaaaaagaaaaaatactccatttgagatgactgcaagttcagtatgtgtagcatggattaggtgtgattgctaatgaaagctaatttggtcttgagtgctggagggaggagtagcctgtttgccaagagatgtgctggtccctgctatgcattggttaacacttagttggggcattgttttctgttcttttatgaaggacattgacaagctggagtatgttcagaaggataaacaaggtattgagtcgtatgaggaattacaaggaggagaaggccagaaaagagaaatcttggtgtaagccagttttaaatgtttgaaaggactatgcaaggaaagggcatgaagtccttgtttttttgtgattctggaag

SEQ ID NO: 21240 - DNA, 428 bp, Homo sapiens
gattattatcctacctcctaagccatccctggagtggtggcttggagaagttttccagagaaaccgatcagttcataaagtttctgtaaaggattaacacagtgtagtccagaaatgtttgttcatgaagtcttggtttttgggtttaagaaagtgttctcctgtctgggcgtggtggctcacgcttgtaatcccagcactttgggaggctgaggtaggcggatcacgtggtcaggagatcgagaccatcctggctaacacggtgaaaccccgtctctactaaaaatacaaaaaattagctgggcatggcggcgggcgcctgtagtcccagctacttgggaggctgaagcaggagaatggcgtgaacgcaggaggtggagcttgcagggagccgagatggcaccactgcactccagcctgggcgacag

SEQ ID NO: 21241 - DNA, 3317 bp, Homo sapiens
cggccggataggcgcgagggggccgcgtgaggcggtgccggcgttctggcccccaaagccggtctagcgcgccgggcgtcttccttacttccgctgccgccgccgccacatcccgggacccgacgggccgcggcgcggaggcctcggggcaaggtggggcgggcctcccgagctcccaggaccccgcgcgcttcgcccacaggcccggcgaagcccgacccgcgcggcgcccccagggccaggggaggagcctaaggacccggacgagcgccgctccagtagggtgagctcggggacgcgcaggcgggtgggtttcagcgcctgggcccctctccccgccgcggggcgcacggaaaaaccggggaacccgcgggttttgtcctggcgagccacatcccgatggagagaggaagaaagggttcagcttgggtccaaggagcatgcagaggaaggcagggaagaaggagcatgtgcagcttcggtgcgaggggagtcaggggtgggaatgcacgttccctgcctgaggggccccggggtgccctgagcctctgatcttcgctgtcaggaggcctgtccgaagttggaggttgaggcatgcagttctgcacttctggctgggaaggtgaaccaggttttccaaaatgtcatttttgctttccaagtctgcaaggcaggaaagggttgggcagtgaatggaaagtagtgcagccaggttctggttagctcagcggcaggactgtcataacgtgacaagaggaaacaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaaatggagcattttcttccattgaggagatccccgaaaacgtggtgcacgaccacgagaagaacggccttcctcggctctcttccttcagtgatgcagaaattcagaagcgattgaaaacatacttcaagttttttattgtaagagatcccttcgaaagacttatttctgcatttaaggataaatttgttcacaatccccggtttgagccttggtacaggcatgagattgctcctggcatcatcagaaaatacaggaggaaccggacagagacccgggggatccagtttgaagatttcgtgcgctacctcggcgatccgaaccacagatggctagaccttcagtttggggaccacatcattcactgggtgacgtatgtagagctctgtgctccctgtgagataatgtacagtgtgattggacaccacgagaccctggaggacgatgccccatacatcttaaaagaggctggcattgaccacctggtgtcatacccgactatccctccgggcattaccgtgtataacagaaccaaggtggagcactatttcctgggcatcagcaaacgagacatccgacgcctgtatgcccgtttcgaaggggactttaagctctttgggtaccagaaaccagactttttgctaaactaatgcataagacctatgaattcaaatatctttattagacctggggctaaccaggtgaagatctgagcccagaaatgacccttcctccaccacacccctcctttgaggacgcccggggtctcccacaggcctgtgagttgcctcggcatatgacgcagaaccccaactgttacaacttagtttggatgtaagatgctctgaggaccctgcccacacccctgcgtgcattaggatgtcgctggcctttgctcacctcagaggggagaaaaggctaaagatttgcagtttgacagcccagcagggaggaagcatcacacagcgttaggagccgtttccttcaggtgttaaggaaggggatgcccctgaggttctcctggctagtcagggtggcttcacccatcactggtgggttgcaggaacagcacccaggactctgaggagggacagagaagcaagggggctgctgaaatcgcagagacttttgcagcatcagatctgaggagtaaaacggcacctctggccttcatcttggtgctgcgacaattgtggaggcaaagcattctttctgtgactattttgttcctgtagacagtcagcgatggccagagggtggtgtggtgtccaggggtccatctttccagaatccatgcctgtgtaatgctggtccatgcttctgaacctgtgtctgccaagcgcctatttcattcagcacaagacatacgattttagaaggtgaggggaggggaggctttttctacctgagaaggggagtgtctttgagggccttaaaaggaccatggcccaggaatgggggcgctggttgggcttggagctcaggctgctgtggatcccggcgcatcagttctgacttgccttacctgggtggacagcagtgaatctccacctgtcttctccagggagctcccatgttggggctgaagacgagcaggggcaacctgccagcatcacagaattcagtgtagtttatacatttcgattcctttcatctcagcaaaatgggcactgccagagccatttctgatcacaccaccatcctggaccatgtgactggaaggtgggtaaccaagttcaccagcaataaaacccagcgcccaggtagcctccagcagtgcggcttcctggcaacaaggtaggccctggtgcagggcaagccgcagcgaccatttcagataccgtccacagccaggaccgctgagaactgggacagtttcctgggatgagtgccagcctgagcctgcatggtgccgccgagcccggggtggaggagggagccaggcttcgcttcaaggcggcctctaccttttctcagaatggtttcctgattgtgtcaatgtgaaagttaaataaaatttatgtgccaaacctgaaaaaaaaaacg

SEQ ID NO: 21242 - DNA, 2808 bp, Homo sapiens
cggccggataggcgcgagggggccgcgtgaggcggtgccggcgttctggcccccaaagccggtctagcgcgccgggcgtcttccttacttccgctgccgccgccgccacatcccgggacccgacgggccgcggcgcggaggcctcggggcaaggtggggcgggcctcccgagctcccaggaccccgcgcgcttcgcccacaggcccggcgaagcccgacccgcgcggcgcccccagggccaggggaggagcctaaggacccggacgagcgccgctccagtaggtgacaagaggaaacaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaaatggagcattttcttccattgaggagatccccgaaaacgtggtgcacgaccacgagaagaacggccttcctcggctctcttccttcagtgatgcagaaattcagaagcgattgaaaacatacttcaagttttttattgtaagagatcccttcgaaagacttatttctgcatttaaggataaatttgttcacaatccccggtttgagccttggtacaggcatgagattgctcctggcatcatcagaaaatacaggaggaaccggacagagacccgggggatccagtttgaagatttcgtgcgctacctcggcgatccgaaccacagatggctagaccttcagtttggggaccacatcattcactgggtgacgtatgtagagctctgtgctccctgtgagataatgtacagtgtgattggacaccacgagaccctggaggacgatgccccatacatcttaaaagaggctggcattgaccacctggtgtcatacccgactatccctccgggcattaccgtgtataacagaaccaaggtggagcactatttcctgggcatcagcaaacgagacatccgacgcctgtatgcccgtttcgaaggggactttaagctctttgggtaccagaaaccagactttttgctaaactaatgcataagacctatgaattcaaatatctttattagacctggggctaaccaggtgaagatctgagcccagaaatgacccttcctccaccacacccctcctttgaggacgcccggggtctcccacaggcctgtgagttgcctcggcatatgacgcagaaccccaactgttacaacttagtttggatgtaagatgctctgaggaccctgcccacacccctgcgtgcattaggatgtcgctggcctttgctcacctcagaggggagaaaaggctaaagatttgcagtttgacagcccagcagggaggaagcatcacacagcgttaggagccgtttccttcaggtgttaaggaaggggatgcccctgaggttctcctggctagtcagggtggcttcacccatcactggtgggttgcaggaacagcacccaggactctgaggagggacagagaagcaagggggctgctgaaatcgcagagacttttgcagcatcagatctgaggagtaaaacggcacctctggccttcatcttggtgctgcgacaattgtggaggcaaagcattctttctgtgactattttgttcctgtagacagtcagcgatggccagagggtggtgtggtgtccaggggtccatctttccagaatccatgcctgtgtaatgctggtccatgcttctgaacctgtgtctgccaagcgcctatttcattcagcacaagacatacgattttagaaggtgaggggaggggaggctttttctacctgagaaggggagtgtctttgagggccttaaaaggaccatggcccaggaatgggggcgctggttgggcttggagctcaggctgctgtggatcccggcgcatcagttctgacttgccttacctgggtggacagcagtgaatctccacctgtcttctccagggagctcccatgttggggctgaagacgagcaggggcaacctgccagcatcacagaattcagtgtagtttatacatttcgattcctttcatctcagcaaaatgggcactgccagagccatttctgatcacaccaccatcctggaccatgtgactggaaggtgggtaaccaagttcaccagcaataaaacccagcgcccaggtagcctccagcagtgcggcttcctggcaacaaggtaggccctggtgcagggcaagccgcagcgaccatttcagataccgtccacagccaggaccgctgagaactgggacagtttcctggaacccgtttcagcatccccctgcatggagcaacaaagcccaggttgtaattttgggccgggcttcacccccagccaacgaaatcaaaatccctggttggttttcaaattcaggcaccc

SEQ ID NO: 21243 - DNA, 1837 bp, Homo sapiens
cggccggataggcgcgagggggccgcgtgaggcggtgccggcgttctggcccccaaagccggtctagcgcgccgggcgtcttccttacttccgctgccgccgccgccacatcccgggacccgacgggccgcggcgcggaggcctcggggcaaggtggggcgggcctcccgagctcccaggaccccgcgcgcttcgcccacaggcccggcgaagcccgacccgcgcggcgcccccagggccaggggaggagcctaaggacccggacgagcgccgctccagtaggtgacaagaggaaacaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaaatggagcattttcttccattgaggagatccccgaaaacgtggtgcacgaccacgagaagaacggccttcctcggctctcttccttcagtgatgcagaaattcagaagcgattgaaaacatacttcaagttttttattgtaagagatcccttcgaaagacttatttctgcatttaaggataaatttgttcacaatccccggtttgagccttggtacaggcatgagattgctcctggcatcatcagaaaatacaggaggaaccggacagagacccgggggatccagtttgaagatttcgtgcgctacctcggcgatccgaaccacagatggctagaccttcagtttggggaccacatcattcactgggtgacgtatgtagagctctgtgctccctgtgagataatgtacagtgtgattggacaccacgagaccctggaggacgatgccccatacatcttaaaagaggctggcattgaccacctggtgtcatacccgactatccctccgggcattaccgtgtataacagaaccaaggtggagcactatttcctgggcatcagcaaacgagacatccgacgcctgtatgcccgtttcgaaggggactttaagctctttgggtaccagaaaccagactttttgctaaactaatgcataagacctatgaattcaaatatctttattagacctggggctaaccaggtgaagatctgagcccagaaatgacccttcctccaccacacccctcctttgaggacgcccggggtctcccacaggcctgtgagttgcctcggcatatgacgcagaaccccaactgttacaacttagtttggatgtaagatgctctgaggaccctgcccacacccctgcgtgcattaggatgtcgctggcctttgctcacctcagaggggagaaaaggctaaagatttgcagtttgacagcccagcagggaggaagcatcacacagcgttaggagccgtttccttcccactgagagccccttccacctctaaataaaatcctctgaatac

SEQ ID NO: 21244 - DNA, 1621 bp, Homo sapiens
cggccggataggcgcgagggggccgcgtgaggcggtgccggcgttctggcccccaaagccggtctagcgcgccgggcgtcttccttacttccgctgccgccgccgccacatcccgggacccgacgggccgcggcgcggaggcctcggggcaaggtggggcgggcctcccgagctcccaggaccccgcgcgcttcgcccacaggcccggcgaagcccgacccgcgcggcgcccccagggccaggggaggagcctaaggacccggacgagcgccgctccagtagggtgagctcggggacgcgcaggcgggtgggtttcagcgcctgggcccctctccccgccgcggggcgcacggaaaaaccggggaacccgcgggttttgtcctggcgagccacatcccgatggagagaggaagaaagggttcagcttgggtccaaggagcatgcagaggaaggcagggaagaaggagcatgtgcagcttcggtgcgaggggagtcaggggtgggaatgcacgttccctgcctgaggggccccggggtgccctgagcctctgatcttcgctgtcaggaggcctgtccgaagttggaggttgaggcatgcagttctgcacttctggctgggaaggtgaaccaggttttccaaaatgtcatttttgctttccaagtctgcaaggcaggaaagggttgggcagtgaatggaaagtagtgcagccaggttctggttagctcagcggcaggactgtcataacgtgacaagaggaaacaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaaggtgggcacagccaggccgtggtccttgtcctcttgaacacggcacccttgtcgcggggagctggccttcccctgtggctggttccgcttgtcatcacgtctgcgttagagccttttcctgtgttacttctccatgttagttcaccttgttaatttccatttgggagaggcacaggtcacgtctatttttgtgcccctcacagagctctgtgcatcagggctgctctgtcactgttggttgtgcagcattcctgaccagctgaacatgagccttgcctggggagccgagagtattgggcagggtcaggaggaaaccagaagtgggagaagacatctcacccagtcatggggttttagagtgaaagggggccctggacagcagaacaactaattcagcctccaaattgtatggatgagagaactgagcctagaaaaaaggtggatcctccacagtcccatggagttcctggcggaccaaaggctgctgactttccacccagcccttgctggcttgacattctggctccatggctctctgcaggcttcttgtgcacctaaattcctgatcattccctagctg

SEQ ID NO: 21245 - DNA, 2853 bp, Homo sapiens
cggccggataggcgcgagggggccgcgtgaggcggtgccggcgttctggcccccaaagccggtctagcgcgccgggcgtcttccttacttccgctgccgccgccgccacatcccgggacccgacgggccgcggcgcggaggcctcggggcaaggtggggcgggcctcccgagctcccaggaccccgcgcgcttcgcccacaggcccggcgaagcccgacccgcgcggcgcccccagggccaggggaggagcctaaggacccggacgagcgccgctccagtaggtgacaagaggaaacaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaaatggagcattttcttccattgaggagatccccgaaaacgtggtgcacgaccacgagaagaacggccttcctcggctctcttccttcagtgatgcagaaattcagaagcgattgaaaacatacttcaagttttttattgtaagagatcccttcgaaagacttatttctgcatttaaggataaatttgttcacaatccccggtttgagccttggtacaggcatgagattgctcctggcatcatcagaaaatacaggaggaaccggacagagacccgggggatccagtttgaagatttcgtgcgctacctcggcgatccgaaccacagatggctagaccttcagtttggggaccacatcattcactgggtgacgtatgtagagctctgtgctccctgtgagataatgtacagtgtgattggacaccacgagaccctggaggacgatgccccatacatcttaaaagaggctggcattgaccacctggtgtcatacccgactatccctccgggcattaccgtgtataacagaaccaaggtggagcactatttcctgggcatcagcaaacgagacatccgacgcctgtatgcccgtttcgaaggggactttaagctctttgggtaccagaaaccagactttttgctaaactaatgcataagacctatgaattcaaatatctttattagacctggggctaaccaggtgaagatctgagcccagaaatgacccttcctccaccacacccctcctttgaggacgcccggggtctcccacaggcctgtgagttgcctcggcatatgacgcagaaccccaactgttacaacttagtttggatgtaagatgctctgaggaccctgcccacacccctgcgtgcattaggatgtcgctggcctttgctcacctcagaggggagaaaaggctaaagatttgcagtttgacagcccagcagggaggaagcatcacacagcgttaggagccgtttccttcaggtgttaaggaaggggatgcccctgaggttctcctggctagtcagggtggcttcacccatcactggtgggttgcaggaacagcacccaggactctgaggagggacagagaagcaagggggctgctgaaatcgcagagacttttgcagcatcagatctgaggagtaaaacggcacctctggccttcatcttggtgctgcgacaattgtggaggcaaagcattctttctgtgactattttgttcctgtagacagtcagcgatggccagagggtggtgtggtgtccaggggtccatctttccagaatccatgcctgtgtaatgctggtccatgcttctgaacctgtgtctgccaagcgcctatttcattcagcacaagacatacgattttagaaggtgaggggaggggaggctttttctacctgagaaggggagtgtctttgagggccttaaaaggaccatggcccaggaatgggggcgctggttgggcttggagctcaggctgctgtggatcccggcgcatcagttctgacttgccttacctgggtggacagcagtgaatctccacctgtcttctccagggagctcccatgttggggctgaagacgagcaggggcaacctgccagcatcacagaattcagtgtagtttatacatttcgattcctttcatctcagcaaaatgggcactgccagagccatttctgatcacaccaccatcctggaccatgtgactggaaggtgggtaaccaagttcaccagcaataaaacccagcgcccaggtagcctccagcagtgcggcttcctggcaacaaggtaggccctggtgcagggcaagccgcagcgaccatttcagataccgtccacagccaggaccgctgagaactgggacagtttcctgggatgagtgccagcctgagcctgcatggtgccgccgagcccggggtggaggagggagccaggcttcgcttcaaggcggcctctaccttttctcagaatggtttcctgattgtgtcaatgtgaaagttaaataaaatttatgtgccaaacctgaaaaaaaaaacg

SEQ ID NO: 21246 - DNA, 2358 bp, Homo sapiens
agaccagcaggagcggctctgcttggcccggtcctgcctcctttaatggtccctgggcctcttctgctctgtgtcacctgcagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaaatggagcattttcttccattgaggagatccccgaaaacgtggtgcacgaccacgagaagaacggccttcctcggctctcttccttcagtgatgcagaaattcagaagcgattgaaaacatacttcaagttttttattgtaagagatcccttcgaaagacttatttctgcatttaaggataaatttgttcacaatccccggtttgagccttggtacaggcatgagattgctcctggcatcatcagaaaatacaggaggaaccggacagagacccgggggatccagtttgaagatttcgtgcgctacctcggcgatccgaaccacagatggctagaccttcagtttggggaccacatcattcactgggtgacgtatgtagagctctgtgctccctgtgagataatgtacagtgtgattggacaccacgagaccctggaggacgatgccccatacatcttaaaagaggctggcattgaccacctggtgtcatacccgactatccctccgggcattaccgtgtataacagaaccaaggtggagcactatttcctgggcatcagcaaacgagacatccgacgcctgtatgcccgtttcgaaggggactttaagctctttgggtaccagaaaccagactttttgctaaactaatgcataagacctatgaattcaaatatctttattagacctggggctaaccaggtgaagatctgagcccagaaatgacccttcctccaccacacccctcctttgaggacgcccggggtctcccacaggcctgtgagttgcctcggcatatgacgcagaaccccaactgttacaacttagtttggatgtaagatgctctgaggaccctgcccacacccctgcgtgcattaggatgtcgctggcctttgctcacctcagaggggagaaaaggctaaagatttgcagtttgacagcccagcagggaggaagcatcacacagcgttaggagccgtttccttcaggtgttaaggaaggggatgcccctgaggttctcctggctagtcagggtggcttcacccatcactggtgggttgcaggaacagcacccaggactctgaggagggacagagaagcaagggggctgctgaaatcgcagagacttttgcagcatcagatctgaggagtaaaacggcacctctggccttcatcttggtgctgcgacaattgtggaggcaaagcattctttctgtgactattttgttcctgtagacagtcagcgatggccagagggtggtgtggtgtccaggggtccatctttccagaatccatgcctgtgtaatgctggtccatgcttctgaacctgtgtctgccaagcgcctatttcattcagcacaagacatacgattttagaaggtgaggggaggggaggctttttctacctgagaaggggagtgtctttgagggccttaaaaggaccatggcccaggaatgggggcgctggttgggcttggagctcaggctgctgtggatcccggcgcatcagttctgacttgccttacctgggtggacagcagtgaatctccacctgtcttctccagggagctcccatgttggggctgaagacgagcaggggcaacctgccagcatcacagaattcagtgtagtttatacatttcgattcctttcatctcagcaaaatgggcactgccagagccatttctgatcacaccaccatcctggaccatgtgactggaaggtgggtaaccaagttcaccagcaataaaacccagcgcccaggtagcctccagcagtgcggcttcctggcaacaaggtaggccctggtgcagggcaagccgcagcgaccatttcagataccgtccacagccaggaccgctgagaactgggacagtttcctgggatgagtgccagcctgagcctgcatggtgccgccgagcccggggtggaggagggagccaggcttcgcttcaaggcggcctctaccttttctcagaatggtttcctgattgtgtcaatgtgaaagttaaataaaatttatgtgccaaacctgaaaaaaaaaacg

SEQ ID NO: 21247 - DNA, 2571 bp, Homo sapiens
cggccggataggcgcgagggggccgcgtgaggcggtgccggcgttctggcccccaaagccggtctagcgcgccgggcgtcttccttacttccgctgccgccgccgccacatcccgggacccgacgggccgcggcgcggaggcctcggggcaaggtggggcgggcctcccgagctcccaggaccccgcgcgcttcgcccacaggcccggcgaagcccgacccgcgcggcgcccccagggccaggggaggagcctaaggacccggacgagcgccgctccagtaggtgacaagaggaaacaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaaatggagcattttcttccattgaggagatccccgaaaacgtggtgcacgaccacgagaagaacggccttcctcggctctcttccttcagtgatgcagaaattcagaagcgattgaaaacatacttcaagttttttattgtaagagatcccttcgaaagacttatttctgcatttaaggataaatttgttcacaatccccggtttgagccttggtacaggcatgagattgctcctggcatcatcagaaaatacaggaggaaccggacagagacccgggggatccagtttgaagatttcgtgcgctacctcggcgatccgaaccacagatggctagaccttcagtttggggaccacatcattcactgggtgacgtatgtagagctctgtgctccctgtgagataatgtacagtgtgattggacaccacgagaccctggaggacgatgccccatacatcttaaaagaggctggcattgaccacctggtgtcatacccgactatccctccgggcattaccgtgtataacagaaccaaggtggagcactatttcctgggcatcagcaaacgagacatccgacgcctgtatgcccgtttcgaaggggactttaagctctttgggtaccagaaaccagactttttgctaaactaatgcataagacctatgaattcaaatatctttattagacctggggctaaccaggtgaagatctgagcccagaaatgacccttcctccaccacacccctcctttgaggacgcccggggtctcccacaggcctgtgagttgcctcggcatatgacgcagaaccccaactgttacaacttagtttggatgtaagatgctctgaggaccctgcccacacccctgcgtgcattaggatgtcgctggcctttgctcacctcagaggggagaaaaggctaaagatttgcagtttgacagcccagcagggaggaagcatcacacagcgttaggagccgtttccttcaggtgttaaggaaggggatgcccctgaggttctcctggctagtcagggtggcttcacccatcactggtgggttgcaggaacagcacccaggactctgaggagggacagagaagcaagggggctgctgaaatcgcagagacttttgcagcatcagatctgaggagtaaaacggcacctctggccttcatcttggtgctgcgacaattgtggaggcaaagcattctttctgtgactattttgttcctgtagacagtcagcgatggccagagggtggtgtggtgtccaggggtccatctttccagaatccatgcctgtgtaatgctggtccatgcttctgaacctgtgtctgccaagcgcctatttcattcagcacaagacatacgattttagaaggtgaggggaggggaggctttttctacctgagaaggggagtgtctttgagggccttaaaaggaccatggcccaggaatgggggcgctggttgggcttggagctcaggctgctgtggatcccggcgcatcagttctgacttgccttacctgggtggacagcagtgaatctccacctgtcttctccagggagctcccatgttggggctgaagacgagcaggggcaacctgccagcatcacagaattcagtgtagtttatacatttcgattcctttcatctcagcaaaatgggcactgccagagccatttctgatcacaccaccatcctggaccatgtgactggaaggtgggtaaccaagcaaccatggtaccgagctgattcactgcc

SEQ ID NO: 21248 - DNA, 776 bp, Homo sapiens
cagaacttaaagtataaatatataaatctacccaaggagaaacagaatgcacattccaggtgaaatggaatcaattactgacaaatatgaaaacataaaatatgccctgtgatgaagatgggtgtcattattgcacacagtttatttgagaatgggaaagaatgacttaacctaggtgggtttcctgcattcctgcaaattgaaataggccataaaatatttgcagtgagagtcagaggaggggtttcagataggttggaatgctctacatggaggtgcagaggtgggtgatgggaaagagtaggtggatggaagagggaaaggaagcctttattgagtgagaacaaaaatgatttgtacagataacagttggaatttagtgtctatcagataaggcgtaaacatcaatgccgttgtcatcgcaccattgttgaaaacgctattttttcccctattgaattgccttggcaaccttgtcaaaatccaattgactataaatgtgtgaaaggtttttttctgtgtgctctcaattgtactccattgatctatatgtctgtcgtaatccctatagtacaccatcttaattactgtagtattgtattaatatcaagttattatatcaaatcaaggagtgtgagtctttgttgttctttttcaatacgttttcactattctgggtcccttgaatcttcatatgaaatttagaatacacttgtcaattttctcaaaggagccaatggggattttgacacgattgcattaaatcagtagatcag

SEQ ID NO: 21249 - DNA, 280 bp, Homo sapiens
gtgccactgcactccagcctgggcgacagagcaagactccgtctcaaaaataaaataaaattaaattaaaaaaaagaactaggagctaagaaattaggtaaaaatactataccatttaaagtgaattagaaatacgaatatggactcatgatttttaaaaatacattaaaaatgtattttttaaatgctctgcaatttaaaatggccttaaaacaatgttacccctgggcaatgagcacacccttgatcttgtctctaataccattctccaataaaagga

SEQ ID NO: 21250 - DNA, 421 bp, Homo sapiens
aatcgagtccaaatggactcctggcaacgttttctctcttttggtcaataatgatgtaattcttccctgaagcagctagagatcctattggatatttgcatggaggaagagactatctaaccctttttccccaactttgaaagtgctagaaatgtgagggtaaatgaatacaaataggaacgtgctgggaagatacagtagggaagccttctgtggctctgcaagctgatacaaatgctggcttaattagaaaatcaatcttgctgtccggctgattgattgcaatcctctgctggaggtacgaaagagagtcgagtcatgacgagataattttttcctattactaaaagaaggcttaatgtacatctctaagcaattcagcgtgaagaacttgttaaaaacacgaccacattttccctct

SEQ ID NO: 21251 - DNA, 313 bp, Homo sapiens
actcaaacttgaaattattgaagttaagtgatagttgcatggggttcattatactatcctttgctggtggttaaagaaaatcatccttttattctttgacctgattgaaccaaattcaatttgctatcatagttcatttgtgttaacaacacagtactaataacccacgtactgtgtatattcatgctgaactcttttaagaattactaaatgttgggaggctgaggcgggcggatcacgaggtcaggagatcgaggccatcctgactaacacggtgaaaccccgtctccactaaaaaatacaaaaaattagc

SEQ ID NO: 21252 - DNA, 1557 bp, Homo sapiens
gccctcgaggcccaggatttgggcactaggggtccaatttttttatttttttttgaacttttttaaaaattaaatttttattttgagatcactgtttgtgttcagttgtaagaaacaagagagattctgtgtaccctttacccattcctccatgttgcaaaactagcacaatatcaccgccacggtagacgcagtgaggccataagacatttccgtcagcaaaagggtcacttcttgtgcccctttagaaccacacccacccctgccttccaactattaatgctggcaggacttagccagaccgcaagggcgcctactccgaacaaggaagagggtcaggcgctgggagggcgactgcaagcggacaggcagcacctgcgaccacggtacttggggacaccacaaaagtccgcagagcaggcaccgcggcacttccgcgagcgccgcaggccctgcccctttcgccgtcgccgaccaattgccgcccgaagaccgagccgcttcagcggagggccggaagtgagccgcagcttttcctttctgccaccgccttgtccaagatggcggacctccaccgccagctgcaggagtacctggcgcaggggaaagctggcggcccggcggccgcggagccgctgctcgccgcggagaaggcggaggagcccggggaccggccggcggaggagtggctgggccgcgcgggcttgcgctggacgtgggcgcggagccctgcggagtcggcagcggccggcctgacgtgcctcccgagcgtgacgcgcgggcagcggctggcggcgggcggcgggtgcctgctgctggctgcactgtgtttcggcctagccgcgctctacgcaccggtgttgctgctgcgcgcgcgcaagttcgcgctgctctggtcactgggctcggcgctggcgttggcgggaagcgcgctgctgcggggcggcgcggcgtgcggacgcctgctgcgctgcgaagaagcgccgtcccggcccgcgctgctctacatggcagcgctgggcgccacgctgttcgccgcgctgggccttcgcagcacgctgctcacggtgctgggcgcgggcgcgcaggtggccgcgctgctggccgcgctggttgggctgctgccctggggcggcggcaccgcgctgcgcctcgcactgggtcgcctgggccgcggcgccggcctcgccaaggtgctgcccgtgtgaggacctcgcgccctcgccgctggggaagtacgcggagccagcgccgtcggagaccgcgccggccgagctgaggactgcacgccgctgtgcggaagccgtggcgaaggccctgccctaacagcctgcgagtctaatccgggagcggctgctgccagcggaggcgacagcagcgttgggagctcctcgatgtcagctttttgtgctggacttggcacacgctctgaaaactgagattttgtcattgaactggtgacaggatgtgagacggttattagaagttgctttcgaagtaactgtggtcttaggttcggctgagtaaagaaaaaggatttttcttcgaaaaaactgc

SEQ ID NO: 21253 - DNA, 213 bp, Homo sapiens
ccgagtcttggacaaggggcgcgaaggagtcaaggatgttgccaggcctgtggccgaaactgagaacagaatagagaagcaggttgagggtgctgggtgtcaacccttcctttatcaaccccatggtaaatgatcaggatggtcactattactacaagtgaggtaactaatcagaacgcaactttccccaaaaaacccacctgagttacacag

SEQ ID NO: 21254 - DNA, 2197 bp, Homo sapiens
tagaagaactcgaccagtgagcaggcgaggaaggggcgggagccggggtcccggtagcttctagtaggttccagaaggcggcgcgtgcggttgggaacgcggagcggacggattcgattcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttataac

SEQ ID NO: 21255 - DNA, 2139 bp, Homo sapiens
  misc_feature (4)..(4): n is a, c, g, or t
aaantaggctagtacgaggcctggtttgaatcggccgagggcggagcggacggattcgattcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttataac

SEQ ID NO: 21256 - DNA, 1496 bp, Homo sapiens
tagaagaactcgaccagtgagcaggcgaggaaggggcgggagccggggtcccggtagcttctagtaggttccagaaggcggcgcgtgcggttgggaacgcggagcggacggattcgattcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttataac

SEQ ID NO: 21257 - DNA, 1968 bp, Homo sapiens
  misc_feature (4)..(4): n is a, c, g, or t
aaantaggctagtacgaggcctggtttgaatcggccgaggagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttataac

SEQ ID NO: 21258 - DNA, 1796 bp, Homo sapiens
gctaggtgaaggcggggtggaatcggacgaggggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttataac

SEQ ID NO: 21259 - DNA, 1024 bp, Homo sapiens
tagaagaactcgaccagtgagcaggcgaggaaggggcgggagccggggtcccggtagcttctagtaggttccagaaggcggcgcgtgcggttgggaacgcggagcggacggattcgattcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttctacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttataac

SEQ ID NO: 21260 - DNA, 1186 bp, Homo sapiens
tcaggatcttctctacgagcgcactgacagattgccaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttataac

SEQ ID NO: 21261 - DNA, 1024 bp, Homo sapiens
  misc_feature (951)..(952): n is a, c, g, or t
tagaagaactcgaccagtgagcaggcgaggaaggggcgggagccggggtcccggtagcttctagtaggttccagaaggcggcgcgtgcggttgggaacgcggagcggacggattcgattcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggcactgaaagaaaaagagctggggaacgatgcctacaagaagaaagactttgacacagccttgaagcattacgacaaagccaaggagctggaccccactaacatgacttacattaccaatcaagcaggggtanntggaaggggggcacatagtgcggggctggggaggcatgaggggggagacgcagagaaagggatgcaagttcg

SEQ ID NO: 21262 - DNA, 2149 bp, Homo sapiens
tacggtctaggtacgaggctgggtgttgagcggcgcgtgcggttgggaacgcggagcggacggattcgattcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttataac

SEQ ID NO: 21263 - DNA, 965 bp, Homo sapiens
  misc_feature (933)..(933): n is a, c, g, or t
  misc_feature (942)..(942): n is a, c, g, or t
tagaagaactcgaccagtgagcaggcgaggaaggggcgggagccggggtcccggtagcttctagtaggttccagaaggcggcgcgtgcggttgggaacgcggagcggacggattcgattcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggcactgaaagaaaaagagctggggaacgatgcctacaagaagaaagactttgacacagccttgaagcattacgacaaagccaaggagctggacccctacttgattacttaccatnaaccgcggntcttgaaaggcgattcataaggc

SEQ ID NO: 21264 - DNA, 957 bp, Homo sapiens
tagaagaactcgaccagtgagcaggcgaggaaggggcgggagccggggtcccggtagcttctagtaggttccagaaggcggcgcgtgcggttgggaacgcggagcggacggattcgattcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttataac

SEQ ID NO: 21265 - DNA, 1444 bp, Homo sapiens
tttatgtaggccagccgctcttgttccttcaggattttctctgcctgctggcatttcttgagcacgcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttataac

SEQ ID NO: 21266 - DNA, 425 bp, Homo sapiens
tagaagaactcgaccagtgagcaggcgaggaaggggcgggagccggggtcccggtagcttctagtaggttccagaaggcggcgcgtgcggttgggaacgcggagcggacggattcgattcaacggggttccggaccgcgctgcgctatggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaaggtcagctgtgggcagtggagggagagaggcccttcagacccttccagaaatgccttttgg

SEQ ID NO: 21267 - DNA, 405 bp, Homo sapiens
ggagatctggttgttggttcttgccatgtgagatgcttgttccccctttgcttccaccatgagcaaaagctccctgaggcctccccagaagcagacgtcagtgttatgcttcttgtacagcttgcagaaccacgagccaattaaacctcttttctttataaatttcccactctcaggtatttctttgtagcagtgcaagaacagcctaataatggttattctgtacaactccaagtccagtagttctgggtgagatccattccttctctaattctgtcccactcctgtctcaatattctgcaacaatgtatacaatagtggattaaagggaaagacaaaatacatttattaaaatatataaatatacccatggcacagcaaggaagaacatacaggctctgtatg

SEQ ID NO: 21268 - DNA, 337 bp, Homo sapiens
aaatgctgggattacaggcatgagccaccgcttccggcccctggctaatttttaaattttttgtagagacaatgtcttgcttcattgcccagcctggtgttgaactcctggtttcaagtgatctgccaaagtgttggaattacaggcatgaaccactgtgcctgacttaccctttgttttttattatggaaaaatgtacataacatcaaatttactttttttgttgttgttgttgagatggagtcttgctctgtcacccaagctagagtgcagtggtgcgctctcggctgactgcaacctctgcctccccagttcaagtgattcttttgcttcagcc

SEQ ID NO: 21269 - DNA, 382 bp, Homo sapiens
aagtcaggtagtgtgatgcccccccagccttgttccttttggccttagtattgaccttggcgatgcgggctcttttttggttcccatatgaactttaaagtagttttttcccaattctgtgaagaaagtcattggtagcttgatggggatggcattgaatctataaattaccttgggcagtatggccattttcatgatattgattcttcctacccgtgagcatggaatgttcttccatttgttgtaaactttactaatttttaagtgctctttctgtattaagaccacaagccttatgtccaatcaaaatttcatgacatttcttttgatgctaggggtaatattataaaactattctaaaactcatctagaacaataccac

SEQ ID NO: 21270 - DNA, 686 bp, Homo sapiens
tgagacggagtctcgctctgtcgcccaggcttgaaagcaatggagtgatcttggctcactgcaacctcggcctcccaggttcaaaagattctcctgctacaggcacacaccaccacgcccagctaatttttgtagttttagtagagatggagtttcaccatgttggcctggctggtcttgaactcctggcctcaagtgatcagcccacctcggcctcccaaagtgctgggatcacaggcatgagccacctcaccaggctcggtttcaaattttaaaattgcatgtttgttttcttactatgcatttccctaattctactcttaaaatgtattattttttgtttgttttttcctatatatttcaaactataaaatcagcttaaaaaccaagggctccccaatgatttgctactgaccaggagatcaggcccagtctctacaatgacctctcctgcactaaagcaaaagcgaggtgcttacttaaggccagctacttattcaatcccggggccaacctttctcagctggaacttaaccagccccagtactcacaaagcccagctcacattcactgcatgtcttcacttacagatataaatgcctgcacacacatgccctttacttacattgtgaccattatgtggagccactttatgggtcgacgcggccgcgaatttagtagtagag

SEQ ID NO: 21271 - DNA, 302 bp, Homo sapiens
attcaatcccggggccaacctttctcagctggaacttaaccagccccagtactcacaaagcccagctcacattcactgcatgtcttcacttacagatataaatgcctgcacacacatgccctttacttacattgtgaccattatgtggagccactttatggatgtaactgcattttgatgttttattttttaagacagggtctcactgttgcccaaggtggagcgcagtagcatgatcataacactgcagccttgacctcctgggctcaagcaatcctcgctccttagcgtcccaagtagct

SEQ ID NO: 21272 - DNA, 497 bp, Homo sapiens
cactacaatttcacaatggacaggttggtgattctcaactaggagctattttgccccccatcccccacccggcagtgtctggagacagttttgattgtcacaactgcgagaagtgggtgctactggaatcactgggtagaggccagcaatgctgctaaacatcctacattgcacaggacacccccacagcaaagaattatctagcccgaaatgttaactgtgctgaggctgagaaaccctgatttaaaaactgtgctcatataataaaaccgtgtatcctcttttgatttaatgtaagtatttccatgtcattataaattttctacaaattatcattttaaaaacaatacaatattcctgctgattgctaacttacccatcttcctgctggtagacaatttaggatattttcaggattttgatctcataaatagatgctaggctttgatttaaagagacttttctaaggtatccaaaagcttattcattcaacaaac

SEQ ID NO: 21273 - DNA, 329 bp, Homo sapiens
gaatgtcttaagccaacactgatacagggggactgtcattcattttataagcaaggaaaatgaagttcaaagagaataagagaattgcccaatgtgagatggagggtgagtgccggagctgagactctaacccaggtgccctgactgcagcttgttttctcgcctggtcttcttacagttaacagttgatttctccagactttctcatgttgaagagagtataatcctgtaaaagttgacttgtgttcaggggtttggccacaaggcatagattttttggagcaagtaaatactatatgttggaataaaatgagagagcccacataata

SEQ ID NO: 21274 - DNA, 796 bp, Homo sapiens
taacaggggcaatccaccaagaagatacaattattctgattgtatgcacttaacactcaaaataggcaaagcaaaaatttactgatgcccaataaattcacaatcataatcagagatcttaaaatatatcccttagtaactgatagaatatcagacaaaaaagagaaaaccaataattatatagaagagttggacagtaatattaacaaacttgacctaattgacatatatagacaaccacatgcaacaattgcagaatacatattcttttctgcacatagaaaaatacgtgatgtgttgagccataaagcaaatctcaaaaactttaaacaattatagtattttttggccacactgacattaagttagaaaacaagaaataaattagaaaatctccctaaaattcgtagtatactttaaaataacctgtgggccaaatttttaaaaattgcaatgtaaaatagaaaatattttgagctgactgagaaatggaaatatagcatcttaaaatttaaagggatactgtttaaccattactgtaagggaaatttgtgtccttaaaatgcatattccacaaaagaggaaaggctaaaaaatcaatgacatatggatccatctcagggaattggaaaaacaatagaaaattaatcctaaagaatgtagaaggaagcaaagataagaacagaatttcctgtaagaaagacatatttgacagacagcattattgaaaccgaaagtttcttttatgaaaagactaataaaattgataataccactagaaatatggataaagaaa

SEQ ID NO: 21275 - DNA, 444 bp, Homo sapiens
tagcaacacacatgtaaatgtccataagataaattgtttataatttatcagaaagaatgtaacaacaactattacaaatcaatgtctaattttattatggcagtgtccaataacctatcaaataactcttaagatgccaaaaaaaaattttaagcaccatttcactaaaaattaacttaaggccaggcacagtggctacccctgtaatcccaacactttgggaggccaaggcagccagaccgcttgagcccaggagttggagaccagtttggccaacatggcgcaaccctgtttctacgaaaaatacaaaagtaagccaggtgtggtggcacatgcctgtaatcccagctactcaggaggctgaggcaggagaatcgcttgaacctgggaggcagaggtcgcagtgagccgagatcatgccattgcactccagcctgggcaaca

SEQ ID NO: 21276 - DNA, 249 bp, Homo sapiens
ctagtatcttctctttggaaggaaacacatgtgggtgtgtgtgcacatacacaatcctaaggtgtaaataagtacataatgaagccttgtcctctatgtttactctttgtttttggtaatgatgttgaaacagtttgtcttgtaagtgccttattaaataattaataggtatatagatgcattttaaaaatatgtattaatctattccccttctagtgcccttctctccctgaaattgacattgaaaca

SEQ ID NO: 21277 - DNA, 1871 bp, Homo sapiens
aaataaaatgatctagatacaaacaagtatagcaaaaatatgctcttctccttaggtttttgagacactacatacacttctcgttgtcttgtgaattcagtagatccttgccaaactactccactaacttgtcctctttatcagaccttgaaacaccagatctcattcttgtctcatctgaggttcccattcttcctttctgactttgcactaaggaacctcatcaggttccatggccttcattaccacctacatgttggtgatggtcctgtgtgtgtcagcggcccagcccactccccgagctccagacccctcacgtttctccatgaggcaccatagttatgattcacaggattcagcatccagcaagaaactactgatgagaccccatattcccaaataggaaaaaagaaaagaaaaaacagaaaaatcttgcatcctgattccccagtctagtaatcacaaagttgaagagaataccatggtctcaccatggaggcagaccagccggctgcagtcccaactccaccacttacagccttgaggggccctggacaagttcatgttcgtgtgctttgattttccccatctgtaaaacgggggtgataatagcacttcctcataaggttgttgactaaatcagttaatatttgtaaagggaacagaaccgtgcttgtcataaagcactatggaagattactttttcataaaatagaacaggtttaggttctaacattatgttgctgatgctcttagcagagtgttcttgtctgcagcctgcctgagcactccacttagctcagagtgcataacgacacaaattattcttccagctgtggagatgttcaaaagttcttcaaatgcattttgtgttctgggactggtgaagccattggtagaacatgatcctcgctgtgaactttctggattgctcatatgatccatttgttaggatgaatgtgtttgtttcctccaaggtctcaggtaacccaggaaagcagggcaccaactgagtcagaccaagtcctgcaaatctgaaaagtgacgtccacagcctgtataccagggacaaggaggagaggaaatgttcctgactctcccttcccatgtatcagctttttccccactacacaaaaagggtcaatgttgacttctggggtctagacttctgagaggtcagaggtgagcatgtgctcaaggggccactcatcaaacaagtatgaattgggcttcagctgctatcaggcactatgctaggtaaggcagaaagcaagagagatcctacctagtcctagggacacacaacctcagagacaaatgcagaaggcagttaccaagcaattacggtccaacatgtctggtccaaccttttcctttactggtgaagaaactgaaactttagagggaatgagcttgtttacatgcaagaagtgaatttgagatcaagttgggactcaaatcctatttcacaattagaattctgtcctaacattcaacccaattcaataaacatttgttgaaaaatctatgatgtgcattaaaaattttcagtgctttatttctgaaactttctctgttcaaaaagcctttatacctccctcattcctactgcatcaagtgcaaacttcttcctggccttcctgaccttctaagatgggccatgaggctatctcatcagtctgggtccccatcactgcccaggggccgccccctctgctgcagtctgtgtgtctcagctccagttcttctcatcctcaggccccacctcactcagtcataccacaggcacactctttgccccttctgatgtgctttgaggcttgggcccaggggcaagacaccagaggactgctctcagctgcccacaggga

SEQ ID NO: 21278 - DNA, 1034 bp, Homo sapiens
agcgggtcttactgctaacctgtgtggatgtttctggtactcagaaaaatcaggaacatcattttcaatctgaagaattaaataagaaattcaataaagcaggataagaaaatggctggcatgttttcccattacctagaatagctctgtggagaccaaccattccatgaaaacaactgcaaaacaggataatccagtaaaaacatctgctgaaaggcatcagaaaactagcaaggcagcaagactgagaagccaagatagcagaaagaagggtgtgcagagaggtcagctcagtattcggtgccacttttccttgaggcatttgtcaactcctaaacagcagcctaaagatgaaggagctgagcagatattctaagagtttcacggggataaggaataacatggaagcttaagacccaataagaagcagacaaaatatcccagcatttcagttggaaccctggatgggattcatttcaggagtaatagggaaccagaaacaaaggacggtcatgaagattcaagcccactgagattagactagctgatctgcctctaccctaactttcaaccagaaagaaaataaacccgctagcagtaacacccatcctagagtctggaattatctctgaaaattttcacatacccatatccctgatttcaataaaaaattatcagtcatattaagaagcaaaataaatgatcaaaagccaagaggaaaaaaatcaagtaaaagaaacgagccaacaggagacaggacacgggtggcacgcctgtaatcccagcaccacaaggtgggtggatcacttgaggtcaagagtttgagatctgcccggccaaaatggtgaaaccccatctctactaaaaatacaaaaattagccgggcatagtggtgggtgcctgtaatcccagctacttgggaagttgaggcatgagaattgcttcaacccgggaggcggaggttccagtgagctgaggttggcctctgcactccagcttggctgacagagcaagactctgtcaaaaaaagaaaa

SEQ ID NO: 21279 - DNA, 1483 bp, Homo sapiens
agaaatggagcaaagcaactatacctcatgggtcagaaaatgattttcatgagttaataaaaaattgtatcttctaaaatttttcaaataacacaaaactagactttcttgcttagggtaaaaggatggattctgataagaaccatctttttgtttcctaatatttaaacatcctcttttgtccctcatgggaattaacaaagaattcttgagtctgtctggtagataaaaacgtcaacagtgaaaacacagtttcaagaaaagtatttctttcttgatggggtgactttcacccatggaagagcatgctctatgaagttgtctatttcacaaatatgataattttatattaaagataattttaaatataaaatatattttaaaatatttaaatatgaaatgctcttagcatattactctacataataaaggttccaaaacatattctttccaacatttatatttttctttctcagatgtttctggtactcagaaaaatcaggaacatcattttcaatctgaagaattaaataagaaattcaataaagcaggataagaaaatggctggcatgttttcccattacctagaatagctctgtggagaccaaccattccatgaaaacaactgcaaaacaggataatccagtaaaaacatctgctgaaaggcatcagaaaactagcaaggcagcaagactgagaagccaagatagcagaaagaagggtgtgcagagaggtcagctcagtattcggtgccacttttccttgaggcatttgtcaactcctaaacagcagcctaaagatgaaggagctgagcagatattctaagagtttcacggggataaggaataacatggaagcttaagacccaataagaagcagacaaaatatcccagcatttcagttggaaccctggatgggattcatttcaggagtaatagggaaccagaaacaaaggacggtcatgaagattcaagcccactgagattagactagctgatctgcctctaccctaactttcaaccagaaagaaaataaacccgctagcagtaacacccatcctagagtctggaattatctctgaaaattttcacatacccatatccctgatttcaataaaaaattatcagtcatattaagaagcaaaataaatgatcaaaagccaagaggaaaaaaatcaagtaaaagaaacgagccaacaggagacaggacacgggtggcacgcctgtaatcccagcaccacaaggtgggtggatcacttgaggtcaagagtttgagatctgcccggccaaaatggtgaaaccccatctctactaaaaatacaaaaattagccgggcatagtggtgggtgcctgtaatcccagctacttgggaagttgaggcatgagaattgcttcaacccgggaggcggaggttccagtgagctgaggttggcctctgcactccagcttggctgacagagcaagactctgtcaaaaaaagaaaa

SEQ ID NO: 21280 - DNA, 702 bp, Homo sapiens
  misc_feature (683)..(683): n is a, c, g, or t
acagtgtccagggagcacaaggcctgggggcccacaaacctgggtctgtatgcccactcttcattagcagctccaggaccaagtgcggtcagttttctggaactcgtttccatatctccactgtgatgtaaggatgtgcatggatcctaaatgtgagaagctggcaatcaccaggtccctggcaagtgctcagagtctgagctaccatcaaaatcaagggcacagggggaggctaactgcttctctgaatactctaagggaggcagatctaggccaggtgaccagggtttacaagtcccaggacagcaggttgggcttggtgcacggaagaactgatgagcagcttcactcatgcagcaggacagatcaggacaaagccatgctggagttggggccacacatctgctgaaaacccccaacactctttttcccagcagcagcttccaagcaattcctgaggccctcccaccggctaaccagaaaggaacccaccattggtctccttagtaacgacttccaaggccccttgcacatctgaaaagcgcacagtgtgatttccagacccaagttagacagcgatttcttcaaagtgcaacgccctcaattaatgaaccctctgggaatgaagtaccttctaacaaaaacattgttcaaaataaagctggaaaaaaacctcaaaaaanaaaaaaaaatctccaggct

SEQ ID NO: 21281 - DNA, 565 bp, Homo sapiens
ttgtactgtttatacaaaagtatgtgggaactggagaactttcactgaaacatagtgtaccctaaaagttaaagaaagaattaaatggtcctttctaacaaatataatcctattttttttttcttttttgagacggagtcttgctctgctgcccaggctggagtgcaggggcgtgatctcagctcactgcaagctctgcctcctgggtttgcaccattctcctgcgtcagcctcctgagtagctgggaatacaggcgcccaccaccacgcccagctaatttttgtatttttagtagagatggggcttctagtttccatgaaagagcttttatttatataagatggaattcatgcttatataaacatgaatgacatctaaaacaagcaataaatatctaaaatgtaagaaagtattataaaacaaataaagagtgaaagaaataaacaggcacagtgtggtggctcatgcctataatcccagcacttgggaggccaaagcaggtggatggcttgagctcacaagttcgagaccagtccgggcaacatggagaaaccctgtctctac

SEQ ID NO: 21282 - DNA, 401 bp, Homo sapiens
catataacgctttgtaaatgttttagactttggctttaatgggaaagaaatggggagccattcgtgggtttttgagcagcaggtggacattgcttttcataatgaccacgccagctgctgtttggagaatagactgtaggggtcactgcgcaaattggaggccgcgatccaggtgagaaccaggtgaaacagagctcgggccatggagtggcgctggaggtaaggagaaacactcagactctgggtatgttttttgaaagtaggataaaaggccgggcgcggtggctcacgcctgtaatcccagcactttgggaggccaaggtgagcggatcaagaggtcaggagatcgagaccatcctggctaacacggtgaaaccccgtctctactaaaaaaaaaaaaa

SEQ ID NO: 21283 - DNA, 197 bp, Homo sapiens
tttttgattttttcaatttttggttgggtgcagtggctcacacctgtaatcccagcactttgggaatcctgacctcaagtgatgcgcccacctcagtttcccaaagtcctgggattacaggtgtgagccaccgcgcctggccgaaacttgtctttttcaattggatcatttttcacatgctgcagtctccttagttt

SEQ ID NO: 21284 - DNA, 1008 bp, Homo sapiens
gcggttctgagctggcattacctgcagcagatggatcactggacagcgagtccggaaatcatccttctccaccaagctttcccacttaatagcttggtaacctttgacagatgatttctttctttcctaatttgtagcatggggacagtgagggatacaacagcagtttctgaaacagcagtgaccaccatttactgcatttaccccaggccaggcactgtgtgtgggcatggcatttaatcccggtaacactctataagataggggctgttatgacctcatttctccgatgaggaagccagggctcagagaagtgaaggcatgagcccgttgttatgaagtcattagatagtagagctgggatttgaacccagagccccactctacctttgagccatgctgctactttgacaaacttttggatgactttgggagatggggaccttggggaaaaatgcactttgaaagaattggatcatttcagtagaaacctgtaaacgtgtgtcttaaaaaaaaatgtcagtgacagtttgcttctcggtgagatgaatgcagataaacctattttgactgttaacttattttgttgcttaaaagccagtgacatgtagtgttgaatttatttttcttcacaacatttaagtgtttgccacttcttgagtgacgtgtgtgaatttgggaattgcctgtactttgggaatggaggccgttgcttgtatgtaaggcttttgccttaagagggacttttgggaaggcttgttctggctcggggccttgctaagaagcgactcgagtgcagcaagggtacctgtgtctgaggatattgatagagctgaagctcactctgaagttggggtcatggtggagagccgatcgcaggagtctttgtgactggaagcctaaatatttattctgttctgtccctaatgaaaacaaattgtcaacagttgttcggtaactgactaaattaaaatctgtaattagtcaattagattaaagagttggcac

SEQ ID NO: 21285 - DNA, 183 bp, Homo sapiens
attataatggctatggctatggatttgggtcagatagatttggaagagacctcaattattgtttttcaggaatgtctgatcacaaatatggggatggtggctctaccttccagagcacaacaggacactgtatatacgtgtggattaccttacagagctactgagaatgacatttgtaatttt

SEQ ID NO: 21286 - DNA, 395 bp, Homo sapiens
tgttagaaaaaaaaactgacagcaggaggaggatgaatgagaggaaggtaagtcaggaggataagggaaacaggaggctttttgtatagtcgtgcaccatatgatgacattttggtcaataacagaacatatcaaccatggtggtcccatacgattataatggagctagaaaattcctttcacttggtgacgtcgtagctgttgtaatgtcatagtgcaaatactttatttttcataaatttagggtagcctaagtgtatagtatttataaagtctacagtaggtacagtaatatcctaggtcttcagattcattcactactcactgactcacccagagcaacgtctagtcttgcaagctctgtttatggtaagtgctctatacgcgactactat

SEQ ID NO: 21287 - DNA, 271 bp, Homo sapiens
aaactgaaaaatgcatcagtgtctcaataacagaatttatcaagcagaagaataaattagtgagtttgaaaacatgaaaatatagaggagaaaaagaaagaagaataaaaaggatgaagtatgcctacaagatctaaaaaataacttcaaaaggacaaatctataacttattggccttgaagaagatgtaaagaaagagatcaggatataaagtttgttcaaagaaataataacagagaacttgcctagcatagagaaagataagaatatc

SEQ ID NO: 21288 - DNA, 442 bp, Homo sapiens
ctagaatgtaaaattaaattttaaaaaattaagaaataaaaaaattgccttctgaaggagagaattgctaagtgagtacaggatttccttttgggttgttgaaaatgggaactagatggaggtagtggttatacagcattgtgcaacaatgtaggtaacgtttactttaagttaaaattgtcaattttttgttatgtgaaattcacctaaataaaaaagttattttccatattatgtgctattatactggggtcagaacaaatttagtcacaccttcacaaaaccatgcaacagtggttgtgataatatttgcaagaggagacatggcaagaatgagcatcattaatgggagataagtatctgtcacactctcctaagatagaaaaaccagctgaaacattttaaatagaagattagtatctgtcacactctcttaagacag

SEQ ID NO: 21289 - DNA, 466 bp, Homo sapiens
tggaggtataattactgtaattagaaataggtgacattttccttgagatatttatatacagagctcaaatccaaaggaaaagcactcgttttgtaccatctctcttctcaatatctctctctgtctttctgtcttgtccaattaggaaattcagtggtagctaaaacacaactttgcctactttagaattctgtctgtgtctaagccccagaatacaacttttaataactccaagcctccttgaaaaggtgacaacaagacagctttgacattttgtgcacattcatccttactgctgggaaaaccacaaaacctggagtctgccaatggagcatcaataatctttgtgtcataggtgaagaccagtaaaattagcacttaagacaattcttcctggctttcctaaacaaattcgtgaaaagaagtggattcgtctttctctactcttagctcgtctatttgagta

SEQ ID NO: 21290 - DNA, 423 bp, Homo sapiens
ccaggctggtctcgaactcctgacatcaggtgatccgcccacctcatcctcccaaaatgctgggattacaggtgtgagccaccacacccggcctctttaacatttttaatgaaacagtatgtttataatattccagattttaacctaaatatctgaaattgtccgaggttaggaaagattccacagccaggtgacacaggaacagataagggcaagagagctgacatttactgcatgctgacaatgtgctgggaggcacatgagttaacccacctcacctcacagcagcctcatggcaactaggactgcggttttacagacgaggatcctgagatacagagaggctgagcaactgcccaaagtcccacagctaaagggggcaaggccagggtcccaacactggcagtcactcacccgcagtgc

SEQ ID NO: 21291 - DNA, 397 bp, Homo sapiens
ggatcctaaacttttgctttcagctggcagtaatgagtcggcacactttcttcctctgccataatggtgccagaaaacacacacacacacacacacacacacacacacacacacagctaaaataaaagatttaaataagattcagagtcttgtaatacaaaaatttccaactttcattagatatcaaactcaataaaaagaactatcaatagatgccaacagcaagattgtagagatgttaaaagtatatcacaaatattttaaagtagccatgataaaaatatttcaatgagaagtacatgcatgcttgaaacaagtaaaatgtctcagcaaaatttcaagccttagtaatgaaataaaagagatgaagacacaaatggaaattttaaaactaaga

SEQ ID NO: 21292 - DNA, 2357 bp, Homo sapiens
atccgggcccttccagaagcaacccaggagccccgagacctgcagggatgtgtgcaccctgacccctgacgcatagccctgcacctgcagccagctggcctcgggcttgaaaacatggcgggtgcgctccaattcacggtggtttccaagcgcattctggaggagaaaacacatgagtgtgtggtcagggttctctgccgacagacctaccgtggggaagaaagagaagttctgaagatggatcatggccgtgactgcatgtcaaggagaatctccatgatgacacggaggcctacgtcgagatagagtaaatatggtccaattaaaaggtgacccgacaatcaacccctgaaaaaggcggtcataaaacccccaggagacgaagatgatggcacgtcgtgaccccaaacctggggcaaagagactggtgagagcccagaccctccagaagcagcggagggccccagttgggccaagggctcccccgcccgatgaagaagatcccaggctcaagtgcaaaaactgtgaggcctttggccacacggccagaagtaccaggtgccccatgaagtgctggaaggcagccctggttccaccgaactttggggaaaaggaagggaaggaaaacctgaaaccatggaagccccaggttgaagcgaaccctgggcccttgaacaaggataagggagagaaggaagagagaccaaggccacaagacccgcagaggaaggctctcctccacatattttccgggaaacctccagagaagccgctgccaaatcaaaaaggatccacggaatcttctgattatctgagggttgcaagcgggccaatgccggtccacacaaccagtaagaggccgcgtgtggaccctgtcctctctgatcgctcagctaccgaaatgtctgacaggggctccgtcttagcttcactgtctcccctcagaaaagccagtctgagctcctcctcaagtcttggaccaaaggaaagacagacaggggctgcggccgacatccctcagactgcagtcaggcaccagggccccgagcctctcctcgtggtgaagccgacacacagcagccctgcgggtggctgtcgagaagttccccaggctgcctccaaaacccacggcctgctccaggccgtcagcccccaggcacaagacaaacgtcctgcggtgacctcacagccctgcccaccagccgccacacacagcttgggcctaggctccaatctcagcttcgggccaggagccaagagatctgccccggctccgattcaggcttgcctgaacttccccaagaaaccgagactgggtcccttccagatccccgaaagcgccatccagggaggtgagctgggggccccggagaatctccaacctccgccagccgcaaccgaacttggaccacgtaccgtgtcaccccagataggcacgaggacacccgcccaggtgcttagcggcgaccggcagcctccgcacagcagaccttgcctgcctactgcccaggcctgcaccatgtcccatcacccagcggccagccatgatggggcccagcctctcagagtgctctttcggagactggaaaacggacgctggagctccagcctgctgacggccccctcatttcactctcctgagaagccgggagccttcctcgctcagagccctcatgtctcagagaagtctgagggtccctgtgttcgtgtcccaccaagcgtcctctatgaggaccttcaggttccctcctcctcagaggacagcgattctgacctggagtgagactgcaggtggcaggggctccttggcctccagctcccgtgacttggaggggactgtgggactgaggagcacagagcagagagcagactctgtgcggtgactccgaagctccccggctgtggcccttctgtggatgtgggagcccaggccaggcagggagcagatgcagggactctgccacgttgaattctggtgagggacattgtagttcgcatggttctctggaaacgcgccaggaaaagcttccgtgccagtgattcgttgcctcagaaactgcatgacgcgcaggagtcagacttccgctgggacgtcaataggaaacgggggaattactgtgtatttgctctctagacgactgaataagggaaaagttagggaaccctgagaggtgcagcccttccgctgtgccccgccctgagagcagtgtttccgacgctgggaagcgcgctgtgcaaagcgctctcggggtctttcctcagcctcgaaaagtgggctctggaatccctttgtaaataggtgtgttgaatttgttttgaagtgaataaaattctcaaaaagatgaaaaaaaaaaaag

SEQ ID NO: 21293 - DNA, 813 bp, Homo sapiens
atccgggcccttccagaagcaacccaggagccccgagacctgcagggatgtgtgcaccctgacccctgacgcatagccctgcacctgcagccagctggcctcgggcttgaaaacatggcgggtgcgctccaattcacggtggtttccaagcgcattctggaggagaaaacacatgagtgtgtggtcagggttctctgccgacagacctaccgtggggaagaaagagaagttctgaagatggatcatggccgtgactgcatgtcaaggagaatctccatgatgacacggaggcctacgtcgagatagagtaaatatggtccaattaaaaggtgaccagaggcagtataaaaggcagcctggaaagcagaggtccctctccgccccttcctccgtcttcctggatgctgcatcgcttccagcggggctgctccagcacctgcccatctcagcgccagccggggaaagaaagtagacgtgtaatttcaggttagtttcactgaacagttgtttgtttcacgcaatccctgaggggtgggggggaaaagagacaaaggaggccgaaagaaagcgatcacactggggcttgctgatgcggtagggtgtgctctcgttactagtaattcttggaacagaaaacgagaaagcatttccgtctccatgtgtgggataagaccaaggtgggaatgcgaaaagaaatgtactgcagcatgctgaattggtgggtaaatggaaaaaggactttggaaaaaagggtggtttgcccttcagccgtgtaagacattgatacgatatggcacttgttcaccgttcgtt

SEQ ID NO: 21294 - DNA, 582 bp, Homo sapiens
aagacatcaatgaagaaacaagaaaaaaaaaaagatgcttggaaactactgaaaaattagaaagcttggtatgtacagattcacatctgggctccctgccctgctgtgaaaccctctgagcttcagtttcccacatgtaaagcagtataagaccctatggcagagagctgcagtggggattaaggagacaagatcgtgggaagcacaaggtaaaggcggcgtgcccctccctggactccaatgcctggagtctcaagaccagctgaaaagggagccaggcactgaaggacaaagcggtgttgactttcttcatctgtgtttcccagtgcgctccaattcacggtggtttccaagcgcattctggaggagaaaacacatgagtgtgtggtcagggttctctgccgacagacctaccgtggggaagaaagagaagttctgaagatggatcatggccgtgactgcatgtcaaggagaatctccatgatgacacggaggcctacgtcgagatagagtaaatatggtccaattaaaaggtgtctattttaccacattttttaaaacaaaacaaaacacaaaaacaaa

SEQ ID NO: 21295 - DNA, 505 bp, Homo sapiens
ttaaaaggtgtctattttaccacattttttaaaacaaaacaaaacacaaaaacaaaaaagatggaaaagaagacaggggtacaggcaccagtgttacatatctgacggggaacatctattcttcaaagcttgcagctgtacacgtaggttttagaatgtctgtcagcagtggacatgatcttagagtgggctgtgcagatagacctttccgagtcatgtaattggattaagttaattgtaattaacctacatgtaactgattaggttagggtacgttccacgtcaggtgaccagaggcagtataaaaggcagcctggaaagcagaggtccctctccgccccttcctccgtcttcctggatgctgcatcgcttccagcggggctgctccagcacctgcccatctcagcgccagccggggaaagaaagtagacgtgtaatttcaggttagtttcactgaacagttgtttgtttcacgcaatccctgaggggtgggggggaaaagaga

SEQ ID NO: 21296 - DNA, 2514 bp, Homo sapiens
atccgggcccttccagaagcaacccaggagccccgagacctgcagggatgtgtgcaccctgacccctgacgcatagccctgcacctgcagccagctggcctcgggcttgaaaacatggcgggtgcgctccaattcacggtggtttccaagcgcattctggaggagaaaacacatgagtgtgtggtcagggttctctgccgacagacctaccgtggggaagaaagagaagttctgaagatggatcatggccgtgactgcatgtcaaggagaatctccatgatgacacggaggcctacgtcgagatagagtaaatatggtccaattaaaaggtgaccagaggcagtataaaaggcagcctggaaagcagaggtccctctccgccccttcctccgtcttcctggatgctgcatcgcttccagcggggctgctccagcacctgcccatctcagcgccagccggggaaagaaagtagacgtgtaatttcaggtgacccgacaatcaacccctgaaaaaggcggtcataaaacccccaggagacgaagatgatggcacgtcgtgaccccaaacctggggcaaagagactggtgagagcccagaccctccagaagcagcggagggccccagttgggccaagggctcccccgcccgatgaagaagatcccaggctcaagtgcaaaaactgtgaggcctttggccacacggccagaagtaccaggtgccccatgaagtgctggaaggcagccctggttccaccgaactttggggaaaaggaagggaaggaaaacctgaaaccatggaagccccaggttgaagcgaaccctgggcccttgaacaaggataagggagagaaggaagagagaccaaggccacaagacccgcagaggaaggctctcctccacatattttccgggaaacctccagagaagccgctgccaaatcaaaaaggatccacggaatcttctgattatctgagggttgcaagcgggccaatgccggtccacacaaccagtaagaggccgcgtgtggaccctgtcctctctgatcgctcagctaccgaaatgtctgacaggggctccgtcttagcttcactgtctcccctcagaaaagccagtctgagctcctcctcaagtcttggaccaaaggaaagacagacaggggctgcggccgacatccctcagactgcagtcaggcaccagggccccgagcctctcctcgtggtgaagccgacacacagcagccctgcgggtggctgtcgagaagttccccaggctgcctccaaaacccacggcctgctccaggccgtcagcccccaggcacaagacaaacgtcctgcggtgacctcacagccctgcccaccagccgccacacacagcttgggcctaggctccaatctcagcttcgggccaggagccaagagatctgccccggctccgattcaggcttgcctgaacttccccaagaaaccgagactgggtcccttccagatccccgaaagcgccatccagggaggtgagctgggggccccggagaatctccaacctccgccagccgcaaccgaacttggaccacgtaccgtgtcaccccagataggcacgaggacacccgcccaggtgcttagcggcgaccggcagcctccgcacagcagaccttgcctgcctactgcccaggcctgcaccatgtcccatcacccagcggccagccatgatggggcccagcctctcagagtgctctttcggagactggaaaacggacgctggagctccagcctgctgacggccccctcatttcactctcctgagaagccgggagccttcctcgctcagagccctcatgtctcagagaagtctgagggtccctgtgttcgtgtcccaccaagcgtcctctatgaggaccttcaggttccctcctcctcagaggacagcgattctgacctggagtgagactgcaggtggcaggggctccttggcctccagctcccgtgacttggaggggactgtgggactgaggagcacagagcagagagcagactctgtgcggtgactccgaagctccccggctgtggcccttctgtggatgtgggagcccaggccaggcagggagcagatgcagggactctgccacgttgaattctggtgagggacattgtagttcgcatggttctctggaaacgcgccaggaaaagcttccgtgccagtgattcgttgcctcagaaactgcatgacgcgcaggagtcagacttccgctgggacgtcaataggaaacgggggaattactgtgtatttgctctctagacgactgaataagggaaaagttagggaaccctgagaggtgcagcccttccgctgtgccccgccctgagagcagtgtttccgacgctgggaagcgcgctgtgcaaagcgctctcggggtctttcctcagcctcgaaaagtgggctctggaatccctttgtaaataggtgtgttgaatttgttttgaagtgaataaaattctcaaaaagatgaaaaaaaaaaaag

SEQ ID NO: 21297 - DNA, 526 bp, Homo sapiens
gcctgtcaccattatttataacaattaaattgattatttgctcctggtcttggtgagaccaactccactaagaacgtcctgctattgaggctagttgtggcaggaatatgcctatgtgacaagcaaagtatgagaaacacctgagatgctatgttggaccctgattccaagatgctgtatacacacatcactggttcttgctctgggtggggatagtgtgtccagccacagcccttacaaaagggaggattgtgggagactgcgcctagttctccagagcctttgctctgaaataccggttggccgggacacatattcttaatttaatgccattgctgtattgaatccttttcttgtaataaacgaggtttgtaagcattgtcattttgggtcttgtgacactcctttaggcactgaaccctgttgaaactgccactgttaatgcacatattgtaaaaaacaaaaaaagatgaaaaaaatatatatattgtctgcctctggtcctttatccaggataattttaata

SEQ ID NO: 21298 - DNA, 395 bp, Homo sapiens
catgttatataagtacttcactgatttagttctttctactaggtgatcacattttcctttttctgagtctaccgatttctgcaatttatggactgagcatctcacactactctctgggtggtttatgtaaataacaataataaaagcccctgaagctgcatccctgttcccagtggtttcccactgacctctttcagcttgaaaaggttctatctattgctgatttttttttccttcctactggcaattttcagcctactgtgcttcttcatctcatttcttgactctttcttgacttaagaattaattattgaaatgtatcagatgcactctgaaaatgtcagtgtatttagttggatttacaaaaaagcacagcttttcagccaacatgatat

SEQ ID NO: 21299 - DNA, 378 bp, Homo sapiens
ggacctgttggatagatatgagactgcagggcaatcatatgaagcaaactgtgatatgtttgcttaagatacttaaagttttatgatttagatgatagtacattaggatagtttctgagtcagctttgcaagataagactgttcacattactagtgtggaaaacaaattcactagtagtgaacctggtgatagctggtttctccattgaccaaacctaagcagagaaagccagaatatgtgggagctcactgtaataatccctataagtcatcttcttagggcacagagcaagaagtggagagggtcaggaatgggtctggaaggtcaagtggaagatattcatcatagaaggacccagggagggctgactcaggcag

SEQ ID NO: 21300 - DNA, 608 bp, Homo sapiens
cagcagatgcagtgattgcaaatcctccttgtacaaatggaacaggcacgtgcatttgtggcacactcagagctgctggccactagtgtgctttggagaatcagttgtctcccaggcggggaaggtccctcagacataaaatactcacccatttagaggaatgacaacagcaaaggaaactatattctgctaatttactggtaagagaggaaaaactctgtcatgcatacacagacagaggctctgccaaaagagagaggcagcagatacagatattagcaaatgactcctctccagaagaaacacaccagccaggaacggcactcacacctgtaatcccagcactttcggaggccaggcggtaggatggcttcagaccaggagtttgagactagcctgggcaacatggcagactccatctctacaaaaaatgaaacaaacaaacaaacaaacaaaagatcagtgtggtgacacacacctgtagtcccagatattccagaggctaggcaggaggatctcttgagcccaggagatggaggctgcagtgagctatgatcctaccactacactccagccggggcaacaaagcaagaccccatctctttttt

SEQ ID NO: 21301 - DNA, 413 bp, Homo sapiens
gaaatgccagccctgagagatgcaactgatgtatgacttttttcctctctggatcaaaccatgacaaccgtaaaaggcaggccttgctgttaaggcgctgcagcctctgaagcacagttggcctcagggagctctgactcagtctacttattctggggatctggagaaagtcagaaatcatgtgtggtagatagtttgcataactttgggattttccagagagaggatgaaaacggtggccctccttgtaatgtctaggcacatgggacatccagtggaactgttgagggaggagatgggagggagaccactcaccacaccacttgatgtacgtctcatagactcaccactcaactcgtgcttcggagaaagctgcttcaaatcttcttgatacatctacaaagataaataaa

SEQ ID NO: 21302 - DNA, 406 bp, Homo sapiens
accttggcctcccaaagtgctgggataacaggcatgagccactgtgcccagcctcattatatctaagaaacagtgacacatggctaaagtctatagatggccacactgaagcattataaaatgttttgttcaaaatcacagaataaaagaacatataaagccaccatttttcaacagtaaaatttatattatgcttttttaagttactttggatcttgctttgttaattcatgacacatgcttgatagaatgtattcaacagatactgattgagtgcctgctatatacaaggctgtgtctgaggtactggagatacagtagtgaaacaaaaaatttctgtcttcatggtgcttacactgtagtggaaggagacagatagtaaacaaataagtaaacatgcaatgtc

SEQ ID NO: 21303 - DNA, 368 bp, Homo sapiens
attccctaccatgtatcatgaaaagtcatctttataatcgtgacaagaagcacaatcacattttacacagggcagcctggagtatgcatggtccctatctagaagtgtaatgttcatttttttcttgttttaaatgagagatattctgaaggaggagacttatttttgtaatgtgtctgtcaactcgtttctgcacacaaatgctctttctctttccctttatgtgtctgccctactaaataaaaggattgatgtaggtgataaatctgacctacttcctagatttaacgctgcgtctgtcggtaccttgctaaagagtctgatctctgatgagctaatcaaggcttacactgtcaccccaatagggc

SEQ ID NO: 21304 - DNA, 546 bp, Homo sapiens
agcgtggagtcgccaggaaggagagatgcggccggactggatgccacattccaccacccaggccggctcacctctgcgcggccgcgttccaaatcattgttcacacagaatttggctgcagcgggtgtccttgagtctctcacacttgagtaatcatccaggtctcctcctccggcttcctttgaggccctggccccccaggggctccggcgtgtgtccccagcagacactgcctggcctgcctggctcagccttgcatctacccccagggtgtgtttgcccctcctccacgagatgcgctcttgtcctccctctcctcccctccagggaccctccagaggctcgttcactgcctggagacacagcgacagccctcgccactagctggaggctggtgctggtgtggggcctcagacccctagaaacaccgggaagtcaggtggagctgcgggagctgagacctggagcaggtggctggccgagccggcactgccctcacttggcatggaccagtcttactgtgccttggagcaccccccgcagagc

SEQ ID NO: 21305 - DNA, 328 bp, Homo sapiens
tagatttttaaaagtgaaatttgaaagtactgggctggtaaatgttttttaataaggggccacttaaaagtggctcattttttgggaggccaaggcacgcggatcacctgtcaggagtttgagactagcctggccaacatggcaaacccccgtctctactaaaaatacaaaaattagctgggtgtggtggtgcatgcctgtaatcccaactacttgggaggctgaggtaagacaattgcttcaactcaggaggtggagattgcagtgagtcaagattgcaccactgcactccagcctaggtggcagaacaagactccttctcaaagaa

SEQ ID NO: 21306 - DNA, 707 bp, Homo sapiens
cccgccaccacatccagctaatttttgtgtttttagtagagacggagtttctccatgttggccaggctggtctcgaactcctgacctcaaccgatctgcctaccttggcctcccaaagtgctaggattacaggcatgatcctctgtgcctggccgaggcttggcatttttaatttgaattggtagagagtgggtgccatcatcgttttgatgatcattcaaccccaggaatatgcatccctttcctgagaggcactctcatcctctacgcagagcagccagtgagctgctggagggaccttgggtcccagcacagtatcccaggctggctccctttaaatactcgttgtttttataaaagggatatgtaagtatggttggcgtgtgaactacaaatgtccctgcatcctgcgaccctgaaatggcctgtcttggtgttggcgctcctggtcgccgcggtgtcacgcgtagatctttgcttctcagtggctctgcagtcctttattttggtacagatatgtgtaatttacttacccattctcctactaatgagcacttacttttctctctctctttctttctttttagacagtgtctcgctctgtcgcccaggctggcctgcagtggtgtgatctcagctcaccgcagcctcctcctcccagttcaagtgattctcctgcctcagactcctgagtagctgggattaca

SEQ ID NO: 21307 - DNA, 2353 bp, Homo sapiens
tgagatgaagtcttactctgttgcccaggctggagtgtagtggtgtgatctcggctcgctgcagccactgcctcctgggttcaggtgattctcctgacttagcctcctgagtggctgggactgcaggagcatgccatcatgcccagctgatttttgtatttttagtagagatggggtttcaccgtgttggccagaatggtttgcattcctgacctcaagtgatctgcctgcctcagcctcccaaaatgttgggtacaggggtgagccaccgtgccttgctattaatgccatctatttcactgaagattccgcctctcatttcttgagtcattttttttaaatttccttaaattggacttcacattttctgatgcctccttgtttagcttaataactgaccttctgaattcttttttaggaaaatcaggaatttcttcttggtttggagccattgctggacatcctttgccattcaacctctgatttgcacaaggtgactaaaggaccagcagcaaacaaaagcaaaggtcttctagagtgcactaaagcagaagataacgtaacatttttatcttaccatgaaagtattatctgaaggacagttaaagctttgtgttgttcaaccagtacatctcacttcatggctccttatattttttattctaaagtctatctcttgtctaaaacctgctcgacttccaatttatcaaaggaaaccttttatagctgcttggaatgctccaacagatcagtgtttgataaaatataatttaagactaaatttgaaaatgtttcctgtgattggaagcccactggccaaggccagggggcaaaatgtcactatattttatgtcaacagattgggatactatccgtggtatacatcacagggggtccccattaatggaggtctcccacagaacataagtttacaagtacatctggaaaaagctgaccaagatattaattattacatccctgctgaagatttcagtggacttgctgttatagattgggaatattggagaccacagtgggcccggaactggaactcaaaagatgtttacagacagaagtcaagaaagcttatttccgatatgggaaagaatgtatcagctaccgatattgaatatttagccaaagtgacctttgaagaaagtgcaaaagctttcatgaaggaaaccatcaaattgggaattaagagccgacccaaaggcctttggggttattatttatatcctgattgccacaattataacgtttatgccccaaactactctgggtcatgcccagaagacgaagtcttgaggaacaatgagctctcttggctctggaacagcagtgctgctttatatccttctatctgtgtctggaaatcccttggagacagtgaaaacattttgcgcttctccaaatttcgggtgcatgaatccatgaggatctccaccatgacatctcatgattatgctctgcctgtatttgtctacacaaggctagggtacagagatgaacctttatttttcctttctaagcaagatctagtcagcaccataggagaaagtgctgccttgggagctgcaggcattgttatttggggagacatgaatttaactgcatccaaggccaactgtacaaaggtgaagcagtttgtgagttctgatttagggagctacatagccaatgtgaccagagctgctgaggtatgcagccttcacctctgcaggaacaatggcaggtgcataaggaagatgtggaacgcgcccagttaccttcacttgaaccctgcaagttaccacatagaggcctctgaggacggggagtttactgtgaaaggaaaagcatctgatacagacctggcagtgatggcagatacattttcctgtcattgttatcagggatatgaaggagctgattgcagagaaataaagacggctgatggctgctctggggtttccccttctcctggttcactaatgacactttgtctactgcttttagcaagttatcgaagcattcagttgtgagataattgagtttaaagggaattgtgtggcctctagcctagtcatttaaagaaggatgtaacttataacattttttttctcttatgaattctattgagagatattataagtagacattatgtatgtcacttaacataaacagaaacattattttatttgcctccagtctggctaggaaaccagatctggggtaaagtcaatgtacacttcctccttattggaatatttaagttgcatttaaactaaaactagtataatttagtcttttcatgaatgtacatacataaaattatacataaaaatattaaattattcatttcaaagactgt

SEQ ID NO: 21308 - DNA, 465 bp, Homo sapiens
tcctccattccaggctgggctgtagctgctcccataaagggatcacagtttgtgttccacgcagaaggagcacagaacacttccaggcatatccttggagctcaagacaggttgctcagctaggccagagaagagagggatctgttcatttccagccctgcaggcctgttggctgttttgtgcatttatgtagcttttaagtgcagactaatagctatcatttattgcatgcccactatgtgccaggcactgtgccaggcattctatgtgagctttcttatttactcctcccaacaatcctatacattaggtatcattattgtcctcattttacctgagaatggaagtgaggcacagagatgaaccacagagtttgttctgggtccatggtcctgttgtttctatgttctgtctgctctactacactgcctttcagaggcaggtctggaagttcagagaccaagt

SEQ ID NO: 21309 - DNA, 330 bp, Homo sapiens
acaaagaatagttaggttttaagataagggctggaggttgaacctacttcagataatcatcattaattattgttctttgaaatggtgattcacatgttcatagctattcatctatgctttgaggtaactacattttctagtccatatggaaggtgcttttttggagacacaataatagtaaccagagcagttctaccctgagaaacaaatataccttttcacattctacctcctatccttacatttattcactttagatcattcatccatccatttgtttattcatgcattcagtaattattgacagtaaattaactgctagttgtcgga

SEQ ID NO: 21310 - DNA, 900 bp, Homo sapiens
gaggaacctggaccaaacactggcctggtaacgtcatgcagcctcctgcctggatgctgccaaagcagcccctgtgggccccagggagagcaggggctgtggacaggggaggtcagctggaggggaggctggcaccttccaagcccctctccttgtgcacctgctctgggggacactaaggctcccaatcagcccctgcctggggggtctcaccctgacatttaggtctgaaggccttgagggccacctccccactgttatctgctgctgctgtccccgtcacagctgcctggcccccgtacactgtcattttgccccaggcaggctcgcacagggccggcgctctgggagggtggaaggattgctgggcccatgactggacacctctgtcacccaacttctgatctatctgcacattgagaccagcctggccaacacagcaagatccctgtctcaacagaataaaaacaaaaataaaatgatcttctgtctgcacactggggacaaaaacacccacctcagaaagctgagggttaccagcggcgccaggccggagccgccccagtgccaggctcactgcttgccataggcagccctgccctctggatctcatatctgcagttctgaccttgcctgtggagggaaagtgtaggggaaagaaagagatcagactgctactgtgtctatgtagaaagaagtggacataagaaactccattttgttctgtactaagaaaaattcttctgccttgagatgctgttaatctgtaaccctagccccaaccctgtgctcgcagaaacatgtgctgtgttgactcaaggtttaatgggtttagggctgtgcaggacgtgctgtgttaaaatgtgtttgcaggcagtgtgcttggtgaaagccatcgcc

SEQ ID NO: 21311 - DNA, 933 bp, Homo sapiens
ccactctcttttccttgctccgacctctgctccagtcccgcttcttcccccgtctcctctttctagtcctctatatgctatcagccctttttcctggtccatccctgtcgttccttctctctctgtctctggttctactgtcaagggccctagttccctttgttttactgcttccccaaccctccctcaagtcccttctctggcacctgggactttgtagccttcactcctctgagcccaccagccctaatggaggggggctcaaacctaggaagtggacagaaaagccacagcctttattttgtattttttttgtaataacaaaccctaaaaaaccctccatgaactgtcctctcccgtcgatccccgcagcatattgtctggaaatctgttttctttctcagagcccagtggccgccgggcttctcttcccttctgagatgatgtcaccccaaagaagactggggtaggagtagggagcacaggggttgttggtgttttcagtgcttagaaaactgggttgtcctgcaggtgtctcctcccacccctccactcgcaacacttgctagggaatccgaccagtggtaaacacatcagcactttttggtgttcaggggtcagcacatttgttaatttaaaccacagactgcttccaggtacaaaggttcatttggacttctggtttgcaagggatgagggttaaaaaaaacaaaacaaaacaaacaacaacaacaacaaaaacaacccagaaagtatcttctagagccagccgcaagagctgtgagctgcttccaagttaggcgagctggtggtggtaccctggacataatgcaattctgtagtcagagcaatatccctggcgagagcctgacatcgcctgttaaaggtggctgcctctgaataaaggaaagcgtctgaaaggtgaaaaaaaaa

SEQ ID NO: 21312 - DNA, 965 bp, Homo sapiens
ccactctcttttccttgctccgacctctgctccagtcccgcttcttcccccgtctcctctttctagtcctctatatgctatcagccctttttcctggtccatccctgtcgttccttctctctctgtctctggttctactgtcaagggccctagttccctttgttttactgcttccccaaccctccctcagtccctgagagccctagagccatctcggtgacagtcccttctctggcacctgggactttgtagccttcactcctctgagcccaccagccctaatggaggggggctcaaacctaggaagtggacagaaaagccacagcctttattttgtattttttttgtaataacaaaccctaaaaaaccctccatgaactgtcctctcccgtcgatccccgcagcatattgtctggaaatctgttttctttctcagagcccagtggccgccgggcttctcttcccttctgagatgatgtcaccccaaagaagactggggtaggagtagggagcacaggggttgttggtgttttcagtgcttagaaaactgggttgtcctgcaggtgtctcctcccacccctccactcgcaacacttgctagggaatccgaccagtggtaaacacatcagcactttttggtgttcaggggtcagcacatttgttaatttaaaccacagactgcttccaggtacaaaggttcatttggacttctggtttgcaagggatgagggttaaaaaaaacaaaacaaaacaaacaacaacaacaacaaaaacaacccagaaagtatcttctagagccagccgcaagagctgtgagctgcttccaagttaggcgagctggtggtggtaccctggacataatgcaattctgtagtcagagcaatatccctggcgagagcctgacatcgcctgttaaaggtggctgcctctgaataaaggaaagcgtctgaaaggtgaaaaaaaaa

SEQ ID NO: 21313 - DNA, 448 bp, Homo sapiens
acacctggtgccattttactcataatatgtaaaaggaagagctgctagaaaaacttacgtcacctgtgttaagtttatagatatacacttgaattaacaatatttttggccaagattcataaatacactttatgttttatgaagcccaattcagttagaacttgaggtcaagcaaagaaatcaagtgtaagagctgacataaaaacaggtttccttttcaatacactttcagctatcttagaaattaactgttcggagtgtttttctattcatactccagaacctctcgcccaataaaattatctcctcccagggctttcactagtgtcaattcactaaagatgcccgtgtcaacatttcaaggtcgcgcctcctcaagagtttaaatattcatctagatatccaccttgaattcaaaaaccccacaacagaattccttctcttgttc

SEQ ID NO: 21314 - DNA, 397 bp, Homo sapiens
gatgcaaaaatcctcagctaaatatcatcaaattcaattccataatgtagaaagagaattacacaccaagaccacatgggacttaccccaggtgtgcaaatctggttcaacatttggaaatgaataatgtaatccatcacgtcaacattcttgggaagaaaaattgcattatcgcatcaagagatgcagaaaaatcacttgacaaaaaaccagcacccatccatgataaaaactcagtgaactaggaatatagaacttcttcaacttgccatagaatatctacaataataatggtgagatactcaaagctttcctaccaagatcaggaacaaggcaaggatgtcctctctcacctcttttcaatatcacacgagaaatcctaactaatgcaataaga

SEQ ID NO: 21315 - DNA, 2172 bp, Homo sapiens
  misc_feature (830)..(830): n is a, c, g, or t
gtaacatggctactggtcactcagtgtctgtgagaccctgagggccagaggcaaggctggcggggtggagctgctgtgtgagcccaggcaaagcccttccttctttggactttggcccctggcagaagaaaatgattctcagcccctgggatccttagagatggtgggtcatgattcccctcctccctccactcactcagcttggtattgaggcctcactgctagaagaagaggaacagatgacctgttctgggaactgaggcttcacaagaagaacaaagctccagagattgagccatagtccctgacaggaagcctcgggggtgctggctgctccctgctggccgggatgccagtggtgtctgaaaccaggggtagagtttacaggaggccgggctgctcaggagagctagaatgaagttctctgtcctcatggtctcagatctgagctcttccccaaagggtggtgacttccatcaccctgcttctttggggtcacagtctggtctgggtaatgtgaaccccccaggctttggacctgggactaagaggctctaggaggctccagcctcatctgcctcctatcccctgccttgttcagaggcccagagctggggccggaagtgatcatgaagatggaaactgtggtctggctcatgatggtgcatcactgctgtgtctgtttgcagtcgttgtgcactctgtgccccacacccccacaccctcctgtctggaggagggctgaaaaaaagctgagtttgcagctggtggaggaggagccaaaagaagcttccctgcccccaagactcaggctggggaggagagggganggtgggatcaaccttgcttctattagcccagatgcccctcagtaatcaagcatagtcatctcctctgagacctgaggtttaggattattgtcccatttcatgggtgagaaacctgagattcaaagataggaagtcacttgcctatggtacccattaggtggagctgggactagaactcagggctttgggtcccagaccttctgctggagggacgaagccctgtctcttacattctggttaggaaactaagacccagagtgggcaaaggcacagcccaagttgcactccgggtgctggcctcctccccgctgcctctctgcctgtctcccacagtgatgtttgcttcgtggttggtcaagaacggcaggaggtatttgcccatcggtgcttgttggcctgtagatgcaacttcttccagcgacttctgggcacagagccaggccccggggtgcccagtcctgtggtgctaagcactgtgccaactgaggccttcctggcagtgctggagttcctatataccaacagtgtcaagctgtaccgccactctgtgagcctgctgaccaggggcctgggtgggagaggtggggggtgccagaggcaggagtttgcccattacactgtgggcacagggcaggggaaactcccttccactcccccaaccacccactctacaggtgctggaagtgctgacagcggctgtggagtatgggctggaggaactgagagaggtgggtttttgtgccaggtccctgtctcatttcccttgcttctcacgggctcacttcccgccctgcctcacacacactctggcctggagaggaacgtgtgcccacacagagagaagtatgtatatctctcccaagtaagtagggcatgtatgtgtgcctgtgtgcaaaaggatccatgcatgcctgccctgtgtgtgctgtgggaagagggggtgattatggctggtgctgtagatacaaagatatcagccttgatccgtgttctccagagagggagaggagacagacacatgaaaatgcttacctgggtggcataagaagtgtgatagaggccgggcgcagtggctcacgcctgtaatcccagcactttgggaagctgaagcaggtggatcacttgagcccagaagttccagaccagcctgggcaacatggtgacaccccatctctactaaaagcacaaaaattagccaggcatggtggcacacacctgttaattgcagctacttgagaggctgaggcacaagaatcgcttgaacctgggaggcagaggttgcagtgagctgaaatcgtgccactgcattccagcctgggtgacagagcaagacttgccctca

SEQ ID NO: 21316 - DNA, 739 bp, Homo sapiens
  misc_feature (738)..(738): n is a, c, g, or t
gcgaattcactagtgattgtgagctgagccctggagatcgctccctgaatgcccctcagacaccacaggctcggcgagaaattgatctccccagcttttccccagctctgcccccatcgtgtttctcatttccgtggacacccacgccagaaacctggatctcatccttgccttatcgctcttcacacctgccttaggtctctttttaccttgtaagagaccttaagagacctttccagttggttcagttctctcagccccaggttcaacctgtcctgtctgacacgtctcacagccttcctgccttcactccagcgccccctcaatccatttcccacagtgcagccagacctgtttttgattgtcagtcctatggggcttaagtcctggaacatcccattgacctccaggacaaaattcaatctatttcactttcagggcactcaaaactactagtgagtggttcctcacctcttctctcaaatacaatctttgtataaattcatttatcctggaggtattagtcctctagctccataccttactcagttactgcagacccctctgctacctccttcattcactatacatcttgttttcccgaggatgtgaatctccctcaagaaagatccctggggcctggagtggtgtcttactcgtttctgcttcctcagtctctgtcagataatcagtgctatgtaaatgttaagtaaatgactttatttatttaaaaaaaana

SEQ ID NO: 21317 - DNA, 1011 bp, Homo sapiens
  misc_feature (1010)..(1010): n is a, c, g, or t
gctctgtcgtcgaggctggagtgtagtggtgcgatttcggctcacttcaaactccgcctcccgggttcaagcgattctcgtgcctcagcctcctgagtagctgggattacagacatgcaccacaacgcccggctaattgttgtatttttagtagagacgggggtttcaccatgttggccaggttggtctcgaactcctgacttcatgtgatccgccagcctcggcctcccaaagtgctgggattacaggtgtgcgccaccatgcccggcctcagctccttctttcattccagacctgcccccctggagatcgctccctgaatgcccctcagacaccacaggctcggcgagaaattgatctccccagcttttccccagctctgcccccatcgtgtttctcatttccgtggacacccacgccagaaacctggatctcatccttgccttatcgctcttcacacctgccttaggtctctttttaccttgtaagagaccttaagagacctttccagttggttcagttctctcagccccaggttcaacctgtcctgtctgacacgtctcacagccttcctgccttcactccagcgccccctcaatccatttcccacagtgcagccagacctgtttttgattgtcagtcctatggggcttaagtcctggaacatcccattgacctccaggacaaaattcaatctatttcactttcagggcactcaaaactactagtgagtggttcctcacctcttctctcaaatacaatctttgtataaattcatttatcctggaggtattagtcctctagctccataccttactcagttactgcagacccctctgctacctccttcattcactatacatcttgttttcccgaggatgtgaatctccctcaagaaagatccctggggcctggagtggtgtcttactcgtttctgcttcctcagtctctgtcagataatcagtgctatgtaaatgttaagtaaatgactttatttatttaaaaaaaana

SEQ ID NO: 21318 - DNA, 934 bp, Homo sapiens
  misc_feature (933)..(933): n is a, c, g, or t
gctctgtcgtcgaggctggagtgtagtggtgcgatttcggctcacttcaaactccgcctcccgggttcaagcgattctcgtgcctcagcctcctgagtagctgggattacagacatgcaccacaacgcccggctaattgttgtatttttagtagagacgggggtttcaccatgttggccaggttggtctcgaactcctgacttcatgtgatccgccagcctcggcctcccaaagtgctgggattacaggtgtgcgccaccatgcccggcctcagctccttctttcattccagacctgcccctctgcccccatcgtgtttctcatttccgtggacacccacgccagaaacctggatctcatccttgccttatcgctcttcacacctgccttaggtctctttttaccttgtaagagaccttaagagacctttccagttggttcagttctctcagccccaggttcaacctgtcctgtctgacacgtctcacagccttcctgccttcactccagcgccccctcaatccatttcccacagtgcagccagacctgtttttgattgtcagtcctatggggcttaagtcctggaacatcccattgacctccaggacaaaattcaatctatttcactttcagggcactcaaaactactagtgagtggttcctcacctcttctctcaaatacaatctttgtataaattcatttatcctggaggtattagtcctctagctccataccttactcagttactgcagacccctctgctacctccttcattcactatacatcttgttttcccgaggatgtgaatctccctcaagaaagatccctggggcctggagtggtgtcttactcgtttctgcttcctcagtctctgtcagataatcagtgctatgtaaatgttaagtaaatgactttatttatttaaaaaaaana

SEQ ID NO: 21319 - DNA, 2773 bp, Homo sapiens
  misc_feature (830)..(830): n is a, c, g, or t
  misc_feature (2772)..(2772): n is a, c, g, or t
gtaacatggctactggtcactcagtgtctgtgagaccctgagggccagaggcaaggctggcggggtggagctgctgtgtgagcccaggcaaagcccttccttctttggactttggcccctggcagaagaaaatgattctcagcccctgggatccttagagatggtgggtcatgattcccctcctccctccactcactcagcttggtattgaggcctcactgctagaagaagaggaacagatgacctgttctgggaactgaggcttcacaagaagaacaaagctccagagattgagccatagtccctgacaggaagcctcgggggtgctggctgctccctgctggccgggatgccagtggtgtctgaaaccaggggtagagtttacaggaggccgggctgctcaggagagctagaatgaagttctctgtcctcatggtctcagatctgagctcttccccaaagggtggtgacttccatcaccctgcttctttggggtcacagtctggtctgggtaatgtgaaccccccaggctttggacctgggactaagaggctctaggaggctccagcctcatctgcctcctatcccctgccttgttcagaggcccagagctggggccggaagtgatcatgaagatggaaactgtggtctggctcatgatggtgcatcactgctgtgtctgtttgcagtcgttgtgcactctgtgccccacacccccacaccctcctgtctggaggagggctgaaaaaaagctgagtttgcagctggtggaggaggagccaaaagaagcttccctgcccccaagactcaggctggggaggagagggganggtgggatcaaccttgcttctattagcccagatgcccctcagtaatcaagcatagtcatctcctctgagacctgaggtttaggattattgtcccatttcatgggtgagaaacctgagattcaaagataggaagtcacttgcctatggtacccattaggtggagctgggactagaactcagggctttgggtcccagaccttctgctggagggacgaagccctgtctcttacattctggttaggaaactaagacccagagtgggcaaaggcacagcccaagttgcactccgggtgctggcctcctccccgctgcctctctgcctgtctcccacagtgatgtttgcttcgtggttggtcaagaacggcaggaggtatttgcccatcggtgcttgttggcctgtagatgcaacttcttccagcgacttctgggcacagagccaggccccggggtgcccagtcctgtggtgctaagcactgtgccaactgaggccttcctggcagtgctggagttcctatataccaacagtgtcaagctgtaccgccactctgtgagcctgctgaccaggggcctgggtgggagaggtggggggtgccagaggcaggagtttgcccattacactgtgggcacagggcaggggaaactcccttccactcccccaaccacccactctacaggtgctggaagtgctgacagcggctgtggagtatgggctggaggaactgagagaggtgggtttttgtgccaggtccctgtctcatttcccttgcttctcacgggctcacttcccgccctgcctcacacacactctggcctggagaggaacgtgtgcccacacagagagaagtatgtatatctctcccaagtaagtagggcatgtatgtgtgcctgtgtgcaaaaggatccatgcatgcctgccctgtgtgtgctgtgggaagagggggtgattatggctggtgctgtagatacaaagatatcagccttgatccgtgttctccagagagggagaggagacagacacatgaaaatgcttacctgggtggcataagaagtgtgatagaggccgggcgcagtggctcacgcctgtaatcccagcactttgggaagctgaagcaggtggatcacttgagcccagaagttccagaccagcctgggcaacatggtgacaccccatctctactaaaagcacaaaaattagcccggcctcagctccttctttcattccagacctgcccccctggagatcgctccctgaatgcccctcagacaccacaggctcggcgagaaattgatctccccagcttttccccagctctgcccccatcgtgtttctcatttccgtggacacccacgccagaaacctggatctcatccttgccttatcgctcttcacacctgccttaggtctctttttaccttgtaagagaccttaagagacctttccagttggttcagttctctcagccccaggttcaacctgtcctgtctgacacgtctcacagccttcctgccttcactccagcgccccctcaatccatttcccacagtgcagccagacctgtttttgattgtcagtcctatggggcttaagtcctggaacatcccattgacctccaggacaaaattcaatctatttcactttcagggcactcaaaactactagtgagtggttcctcacctcttctctcaaatacaatctttgtataaattcatttatcctggaggtattagtcctctagctccataccttactcagttactgcagacccctctgctacctccttcattcactatacatcttgttttcccgaggatgtgaatctccctcaagaaagatccctggggcctggagtggtgtcttactcgtttctgcttcctcagtctctgtcagataatcagtgctatgtaaatgttaagtaaatgactttatttatttaaaaaaaana

SEQ ID NO: 21320 - DNA, 2246 bp, Homo sapiens
  misc_feature (830)..(830): n is a, c, g, or t
gtaacatggctactggtcactcagtgtctgtgagaccctgagggccagaggcaaggctggcggggtggagctgctgtgtgagcccaggcaaagcccttccttctttggactttggcccctggcagaagaaaatgattctcagcccctgggatccttagagatggtgggtcatgattcccctcctccctccactcactcagcttggtattgaggcctcactgctagaagaagaggaacagatgacctgttctgggaactgaggcttcacaagaagaacaaagctccagagattgagccatagtccctgacaggaagcctcgggggtgctggctgctccctgctggccgggatgccagtggtgtctgaaaccaggggtagagtttacaggaggccgggctgctcaggagagctagaatgaagttctctgtcctcatggtctcagatctgagctcttccccaaagggtggtgacttccatcaccctgcttctttggggtcacagtctggtctgggtaatgtgaaccccccaggctttggacctgggactaagaggctctaggaggctccagcctcatctgcctcctatcccctgccttgttcagaggcccagagctggggccggaagtgatcatgaagatggaaactgtggtctggctcatgatggtgcatcactgctgtgtctgtttgcagtcgttgtgcactctgtgccccacacccccacaccctcctgtctggaggagggctgaaaaaaagctgagtttgcagctggtggaggaggagccaaaagaagcttccctgcccccaagactcaggctggggaggagagggganggtgggatcaaccttgcttctattagcccagatgcccctcagtaatcaagcatagtcatctcctctgagacctgaggtttaggattattgtcccatttcatgggtgagaaacctgagattcaaagataggaagtcacttgcctatggtacccattaggtggagctgggactagaactcagggctttgggtcccagaccttctgctggagggacgaagccctgtctcttacattctggttaggaaactaagacccagagtgggcaaaggcacagcccaagttgcactccgggtgctggcctcctccccgctgcctctctgcctgtctcccacagtgatgtttgcttcgtggttggtcaagaacggcaggaggtatttgcccatcggtgcttgttggcctgtagatgcaacttcttccagcgacttctgggcacagagccaggccccggggtgcccagtcctgtggtgctaagcactgtgccaactgaggccttcctggcagtgctggagttcctatataccaacagtgtcaagctgtaccgccactctgtgagcctgctgaccaggggcctgggtgggagaggtggggggtgccagaggcaggagtttgcccattacactgtgggcacagggcaggggaaactcccttccactcccccaaccacccactctacaggtgctggaagtgctgacagcggctgtggagtatgggctggaggaactgagagaggtgggtttttgtgccaggtccctgtctcatttcccttgcttctcacgggctcacttcccgccctgcctcacacacactctggcctggagaggaacgtgtgcccacacagagagaagtatgtatatctctcccaagtaagtagggcatgtatgtgtgcctgtgtgcaaaaggatccatgcatgcctgccctgtgtgtgctgtgggaagagggggtgattatggctggtgctgtagatacaaagatatcagccttgatccgtgttctccagagagggagaggagacagacacatgaaaatgcttacctgggtggcataagaagtgtgatagaggccgggcgcagtggctcacgcctgtaatcccagcactttgggaagctgaagcaggtggatcacttgagcccagaagttccagaccagcctgggcaacatggtgacaccccatctctactaaaagcacaaaaattagcccggcctcagctccttctttcattccagacctgcccccctggagatcgctccctgaatgcccctcagacaccacaggctcggcgagaaattgatctccccagcttttccccagctctgcccccatcgtgtttctcatttccgtggacacccacgccagaaacctggatctcatccttgccttattcaaatgcaggtggaccttcagggaggctgaggcag

SEQ ID NO: 21321 - DNA, 483 bp, Homo sapiens
tcacagtactgggaaatgggagcacagtattcggaaatgggagcacagtactgggaaatgggagctcacagcactgggaaatggagcatagcattgggaaatgggagcacagtactgggaaatggaagctcacagtcctgggaaatgggagcatagtgctgggaaatgggagcacagtactgagaaatgggagcacagtactgggaaatgggagcccagtactgagaaatgggagcacacagtactgtgaaatgggagcacagtactgggaaatgggagcatagtactgagaaaccccagacctggattctgagtttttcagtctagcccagacttcttatcttagtagacaaaaagagtcaataccagagaaccagaggcatcctctgtattttaatgaactctgcgttttagtctgtttagtagtcatattttaaaagataatcagttttctaaatatatctataagttactacatgcatt

SEQ ID NO: 21322 - DNA, 255 bp, Homo sapiens
gtcagagataaagacagaagcaaagtcccacaaggtcatggacctggctgagtacaaacctgggacaggtgtcagaaagaggaggcctctgggcatctgactgtgcactctgggcaccatttggccaccagtcctaacaaaggcagtcactgaggactcccgtggcaagcggcacctcctgctcaggctcctcggagttatttgttaaatgaatgtgcaatgcagagacaatcccctgactaattcactgctgat

SEQ ID NO: 21323 - DNA, 726 bp, Homo sapiens
taccatgtcagcgataagttgagccttgtgttttttgtttgtttcacatattgataatggtctatcaccttctaacagttcaaatagatgttgtttttagccactaagttttggtagcaagctgttagccagcaaaagttaactgatatactggcaaatagcagatccttcagaagtcattctgtttttcatcctcaaaagaatggaagctcagctcatttggcatggaaattgggaaatatagattgtcagccattaatgggaataatggcttataaaagtgggtaagagttaaagttattattgtcctgaattcagattaatttgtgattcaagacattctgtcactccttttaaaacctaattatagatgtcttaagtgtttctggaaaaatctgttaaattccttcagtggacttgacttttcctcttaaaatactaaagatgttggtgctgacattgtgaaggcacatactctcacgtaactgcaaaataatttctgagaagctggtatctgtaaggtaacttttaaaggctctgatttatttctgtggttaagaaaagaggaattattaagaaattgttggaaatgtgccgtggctaggtttttcctcctcatatttgtaggctttcatgtgaagctcccttagctcagcattggtcaaaacatgtttgttccatagtatcttgtgctaattttctagaagaacagtacattaaaaaaaa

SEQ ID NO: 21324 - DNA, 673 bp, Homo sapiens
ctaaggactacacgcctcccttgatgccatgttggcacatgaaccccaaacatagatgctaccttatagtgaaggaagggcaggggacaatccccaatgactgaacctatgacgactacttataagagaacatctggtatttgacttataaatgagaacacatggtatttgactttctgtttatgagttgtctcacttaagatagcagcctccaattccatccatattgctgcaaaagacatgaattgattctttttatggctgaatagtactgcatttgtatatgcaatactattgcatattttattaatctaatcatctgttgatgaacacttaggttgattttatatctttactatttttcacagaattagaaaaaaatcataaaattaatatggaaccaataaagagcctgaatagccaaagcaatcctaagcaaaaagaacaagctggaggcatcatattacccaacttcaaattacactacaacactatagtaaccaaaacagaatggtactagtacaaaaatagatacatagatcaagggaacggaacagagaatctgaaataaagccacatatctacagccaactgatctttgacaaggtcaacaaaaacatacactggggaaaggatacccttttcaataaactgtgctgggaaaattagattg

SEQ ID NO: 21325 - DNA, 585 bp, Homo sapiens
taccatgtcagcgataagttgagccttgtgttttttgtttgtttcacatattgataatggtctatcaccttctaacagttcaaatagatgttgtttttagccactaagttttggtagcaagctgttagccagcaaaagttaactgatatactggcaaatagcagatccttcagaagtcattctgtttttcatcctcaaaagaatggaagctcagctcatttggcatggaaattgggaaatatagattgtcagccattaatgggaataatggcttataaaaaattagaaaaaaatcataaaattaatatggaaccaataaagagcctgaatagccaaagcaatcctaagcaaaaagaacaagctggaggcatcatattacccaacttcaaattacactacaacactatagtaaccaaaacagaatggtactagtacaaaaatagatacatagatcaagggaacggaacagagaatctgaaataaagccacatatctacagccaactgatctttgacaaggtcaacaaaaacatacactggggaaaggatacccttttcaataaactgtgctgggaaaattagattg

SEQ ID NO: 21326 - DNA, 3989 bp, Homo sapiens
cgctctttgtgacgtggaagacagggcgggacaagcggcttcgtggctgcattgggaccttctcagccatgaatcttcattcaggactcagggaatacacgttaaccagtgcacttaaggacagccgatttccccccctgacccgagaggagctgcctaaacttttctgctctgtctccctccttactaactttgaggatgccagtgattacctggactgggaggtaggggtccatgggattcgaattgaattcattaatgaaaaaggtgtcaaacgcacagccacatatttacctgaggttgctaaggaacaagactgggatcagatccagacaatagactccttgctcaggaaaggtggctttaaagctccaattaccagtgaattcagaaaaacgatcaaactcaccaggtaccgaagtgagaaggtgacaatcagttacgcagagtatattgcttcccgacagcactgtttccagaacggcactcttcatgccccgcccctctacaatcattactcctgacacacggctgcatgaccagtcccacccccccgtggccaccaatggctatgacatcattggagcagatgcctcctcttcctggtccagttacttctattactgcaccattttatgatgctagcttccgttgccaagtctgcctcccgctgactgagggagggtagggttaccttgaacgaaacagaacttgaggggcccaagccttatctcagcctttcctcaatatggggttccgttggattggggctcctccatgactagtgggaattactgtgggttcagaagacccttgtctggtatttgccacatggggtattggccacacgctggaagctgaaattgatgatccctgaaggttgaacccacacacacccctgcagcctccccagatgaagtaggtgtattcccctggcagtctgggcaacggagaccaagaaacatttttaggttgttttaaattcctttttttaaacttccagtttattgcgtaccaagagttgattacaacctccatgcttcataagcggacgccacgttagggttggacgtgggcaccacgagtcctttgaggctcctggacagagacccacatcaagatcggaagccctttgggtggcgttgcagatctcattgctcagtaggccgtgaagattttcatcctcatcccactctcagttggattttctggcactcttcctgcattgagtctcctgattactgaacagagctccgtcatgtagcctgctgaggaatggaatggaatggagatgcccacaggaggtcctgatgtcatcactgcacgcaggtgtgagaggagagacctcttctgcaccgcctggctacctcactcctctgctggtagcagtgcctatagctggacctaagttctcagaagcgtagatgtgcaaacaagcgattgagttgggctttaggaggacacatcataggagagaatccagggtctgtaagctggttttcttttcaggtgacatcctgaggggcctgtaagcaggggagctcctttttctagtttgcctgtagaggtgggaagactgttggtgtttctgtcctttacaggacattaggaaacagttgtgtaattacacaaggtggacctttatcttgcctgacatgctgggaatcttcaccccaccagggcaaatttccaaatagctcattttattctaggtctttcaaactttcatgtgacatatttccctttcccattgttgctgatttccaaatcgctgtcagcaattttttcctctctccttgcctattcttcactcatttggtggcaaagttcatagaactaggggacttggaagatgctttgaaaatattgttacaaaggcactgctaaaatgattcacagggagagtggccagttggaagaaggatcctaaggatgtgacactggttttcaacaacatgcttagagaactcatgaagtggattgggtgtcaacccagtgaacatgtttttatttaatttattttttgaagtttatgtggtgatggtgtggctttccgaaatgggcaaatattcagaagatcttttgcattttcttctgtcaggaatggggaaggggagtgggggcacaatctgagaaaggacacctgtgctgttctaggcatcgctggcaagtttgtgggaagggatgggcaagggtgagtgggtttgctccacaccgtcctgtgctgctcgagaggacctgggacgtgcgagggaaacgtgggtgacggtgcctaggctgcggcccttcactgctgtgctgggttcctgcagcctgctacgtttcccttggcaatgtaaatgaagatggaggggtcgtttcgtgatttcctgctgctgagaataaatgtcttgttaaaaacgtggcaacggttactcttaggtgccatggatcgatgtcagggtggtcagctctggactaagccacccacctccaatttgtacaacagtattgatacatagggctacactcattactgttcaagtgttctatgttaagagttgtgtttaatttctaaagattaaaaaaagcaaaaaaattggtgctaaaccttcacccctgagcacgctcagtgagactggtcatgcaagcatttacagtgccatgctcctcaagccgattttttcttgtagaaatgttgccctatttgtcttctccaatgtatggtatgttattttattttattattttattttattttattttattttatcgagggggggtacgatacctgccatttaagaaaatgaatagaaaattttaaaacccgagaaatggggaaaaaaaaaatcagtgcacaagaattgggctggttaggcccagcaccacactgaagtgggctcagtggtttttggagtgaagaagccttactccctgcacattccctcatgctcccacacaagtccagcaatggaaatgcttgggttcctcttgctttgtcaggggactcaggagtcgaccaagggaaaccatttggccccgtgaggaatgggcattgtcagtatccgtcctgaacggggcctagtcaggaagcggtctagaagtgtacggtcacggtcgcctcatgaaagtgtgtagcaggtggctctcaggaaaaataccaagtctggatcatccatgtggcagctttgcatagggagaggatagctccgaactggaactgaactgccttctctgcacgcttgaccaaagcagtgatgagggcggccagtacctgcggtgtgcgtggtaggtttaaagaaaagggaatgttttctgctgagtgtttcctttgtccttgggctgctcgagctggacagtaggtaaccactgttttcaaggaccagcccaatttctctggcttggttcggagttcgtttcatccctagctgtgagtgccttttggtctggaaagttggcttgtctcataatacccacagctaggacattctctctgtaattatgaattgtccttgttttacattaaaagagaatgtctttgatcactagagtctgtcggtgttggattatttccactgtgagattcttaaaacttttttgcttcataataataaaacaactcatgttagagaccctttcaacatgaaaggtttgtagttgagacattacatatattttattgtttataataaaaatcatctatacaaaagaagtcctgggtgttaatattttgcacaagatctgttttccatgatgtgttgacatctacaatttcactaactgttgacgttattttctattgagattctggagcctagggagctatgtgttctttttgttcatttcgttcttacttccctgaagcaagagactatatggccttcagtgcaaagacttcagaccaattctttgtattacacttggttgcctcttggctatataacttctgagtgcaaatcattgaacactttaacgaagtattgtagagaataaatcataatggataaaaa

SEQ ID NO: 21327 - DNA, 4461 bp, Homo sapiens
cgctctttgtgacgtggaagacagggcgggacaagcggcttcgtggctgcattgggaccttctcagccatgaatcttcattcaggactcagggaatacacgttaaccagtgcacttaaggacagccgatttccccccctgacccgagaggagctgcctaaacttttctgctctgtctccctccttactaactttgaggatgccagtgattacctggactgggaggtaggggtccatgggattcgaattgaattcattaatgaaaaaggtgtcaaacgcacagccacatatttacctgaggttgctaaggaacaagataattatactggggtaacatctgacaggaaggacgcaggagcagggagcctggggacagccattatggcatgtgtcgggctatcatctcatgtctcagagtctccacgggactggcagacagactgggcgccagactgggatcagatccagacaatagactccttgctcaggaaaggtggctttaaagctccaattaccagtgaattcagaaaaacgatcaaactcaccaggtaccgaagtgagaaggtgacaatcagttacgcagagtatattgcttcccgacagcactgtttccagaacggcactcttcatgccccgcccctctacaatcattactcctgacacacggctgcatgaccagtcccacccccccgtggccaccaatggctatgacatcattggagcagatgcctcctcttcctggtccagttacttctattactgcaccattttatgatgctagcttccgttgccaagtctgcctcccgctgactgagggagggtagggttaccttgaacgaaacagaacttgaggggcccaagccttatctcagcctttcctcaatatggggttccgttggattggggctcctccatgactagtgggaattactgtgggttcagaagacccttgtctggtatttgccacatggggtattggccacacgctggaagctgaaattgatgatccctgaaggttgaacccacacacacccctgcagcctccccagatgaagtaggtgtattcccctggcagtctgggcaacggagaccaagaaacatttttaggttgttttaaattcctttttttaaacttccagtttattgcgtaccaagagttgattacaacctccatgcttcataagcggacgccacgttagggttggacgtgggcaccacgagtcctttgaggctcctggacagagacccacatcaagatcggaagccctttgggtggcgttgcagatctcattgctcagtaggccgtgaagattttcatcctcatcccactctcagttggattttctggcactcttcctgcattgagtctcctgattactgaacagagctccgtcatgtagcctgctgaggaatggaatggaatggagatgcccacaggaggtcctgatgtcatcactgcacgcaggtgtgagaggagagacctcttctgcaccgcctggctacctcactcctctgctggtagcagtgcctatagctggacctaagttctcagaagcgtagatgtgcaaacaagcgattgagttgggctttaggaggacacatcataggagagaatccagggtctgtaagctggttttcttttcaggtgacatcctgaggggcctgtaagcaggggagctcctttttctagtttgcctgtagaggtgggaagactgttggtgtttctgtcctttacaggacattaggaaacagttgtgtaattacacaaggtggacctttatcttgcctgacatgctgggaatcttcaccccaccagggcaaatttccaaatagctcattttattctaggtctttcaaactttcatgtgacatatttccctttcccattgttgctgatttccaaatcgctgtcagcaattttttcctctctccttgcctattcttcactcatttggtggcaaagttcatagaactaggggacttggaagatgctttgaaaatattgttacaaaggcactgctaaaatgattcacagggagagtggccagttggaagaaggatcctaaggatgtgacactggttttcaacaacatgcttagagaactcatgaagtggattgggtgtcaacccagtgaacatgtttttatttaatttattttttgaagtttatgtggtgatggtgtggctttccgaaatgggcaaatattcagaagatcttttgcattttcttctgtcaggaatggggaaggggagtgggggcacaatctgagaaaggacacctgtgctgttctaggcatcgctggcaagtttgtgggaagggatgggcaagggtgagtgggtttgctccacaccgtcctgtgctgctcgagaggacctgggacgtgcgagggaaacgtgggtgacggtgcctaggctgcggcccttcactgctgtgctgggttcctgcagcctgctacgtttcccttggcaatgtaaatgaagatggaggggtcgtttcgtgatttcctgctgctgagaataaatgtcttgttaaaaacgtggcaacggttactcttaggtgccatggatcgatgtcagggtggtcagctctggactaagccacccacctccaatttgtacaacagtattgatacatagggctacactcattactgttcaagtgttctatgttaagagttgtgtttaatttctaaagattaaaaaaagcaaaaaaattggtgctaaaccttcacccctgagcacgctcagtgagactggtcatgcaagcatttacagtgccatgctcctcaagccgattttttcttgtagaaatgttgccctatttgtcttctccaatgtatggtatgttattttattttattattttattttattttattttattttatcgagggggggtacgatacctgccatttaagaaaatgaatagaaaattttaaaacccgagaaatggggaaaaaaaaaatcagtgcacaagaattgggctggttaggcccagcaccacactgaagtgggctcagtggtttttggagtgaagaagccttactccctgcacattccctcatgctcccacacaagtccagcaatggaaatgcttgggttcctcttgctttgtcaggggactcaggagtcgaccaagggaaaccatttggccccgtgaggaatgggcattgtcagtatccgtcctgaacggggcctagtcaggaagcggtctagaagtgtacggtcacggtcgcctcatgaaagtgtgtagcaggtggctctcaggaaaaataccaagtctggatcatccatgtggcagctttgcatagggagaggatagctccgaactggaactgaactgccttctctgcacgcttgaccaaagcagtgatgagggcggccagtacctgcggtgtgcgtggtaggtttaaagaaaagggaatgttttctgctgagtgtttcctttgtccttgggctgctcgagctggacagtaggtaaccactgttttcaaggaccagcccaatttctctggcttggttcggagttcgtttcatccctagctgtgagtgccttttggtctggaaagttggcttgtctcataatacccacagctaggacattctctctgtaattatgaattgtccttgttttacattaaaagagaatgtctttgatcactagagtctgtcggtgttggattatttccactgtgagattcttaaaacttttttgcttcataataataaaacaactcatgttagagaccctttcaacatgaaaggtttgtagttgagacattacatatattttattgtttataataaaaatcatctatacaaaagaagtcctgggtgttaatattttgcacaagatctgttttccatgatgtgttgacatctacaatttcactaactgttgacgttattttctattgagattctggagcctagggagctatgtgttctttttgttcatttcgttcttacttccctgaagcaagagactatatggccttcagtgcaaagacttcagaccaattctttgtattacacttggttgcctcttggctatataacttctgagtgcaaatcattgaacactttaacgaagtattgtagagaataaatcataatggataaaaaaaaaaaaaaaaaaaaaaaaaaaaaaaaaaaaaaaaaaaaaaaaaaagaaaaaaaaaagaaaaaaaaaaaaaaaaaaggaggaagtaagccaacgaagagaaaacacgaaagacggggggagcagtactaataaccgagaaaaagacaaaggaaaagagagcacaaaacgcgaaaaggagacgagcagagataaagtaaaaaaagagcagggaaaaaaataaaaagaaagaaaaacgggactcgttggaccagaaacatacgcggctagatgaacaaaaccacaaacaaagcaggcgaaaaaaacggagggaccaacaggggagaagggaaataaaag

SEQ ID NO: 21328 - DNA, 4124 bp, Homo sapiens
cgctctttgtgacgtggaagacagggcgggacaagcggcttcgtggctgcattgggaccttctcagccatgaatcttcattcaggactcagggaatacacgttaaccagtgcacttaaggacagccgatttccccccctgacccgagaggagctgcctaaacttttctgctctgtctccctccttactaactttgaggatgccagtgattacctggactgggaggtaggggtccatgggattcgaattgaattcattaatgaaaaaggtgtcaaacgcacagccacatatttacctgaggttgctaaggaacaagataattatactggggtaacatctgacaggaaggacgcaggagcagggagcctggggacagccattatggcatgtgtcgggctatcatctcatgtctcagagtctccacgggactggcagacagactgggcgccagactgggatcagatccagacaatagactccttgctcaggaaaggtggctttaaagctccaattaccagtgaattcagaaaaacgatcaaactcaccaggtaccgaagtgagaaggtgacaatcagttacgcagagtatattgcttcccgacagcactgtttccagaacggcactcttcatgccccgcccctctacaatcattactcctgacacacggctgcatgaccagtcccacccccccgtggccaccaatggctatgacatcattggagcagatgcctcctcttcctggtccagttacttctattactgcaccattttatgatgctagcttccgttgccaagtctgcctcccgctgactgagggagggtagggttaccttgaacgaaacagaacttgaggggcccaagccttatctcagcctttcctcaatatggggttccgttggattggggctcctccatgactagtgggaattactgtgggttcagaagacccttgtctggtatttgccacatggggtattggccacacgctggaagctgaaattgatgatccctgaaggttgaacccacacacacccctgcagcctccccagatgaagtaggtgtattcccctggcagtctgggcaacggagaccaagaaacatttttaggttgttttaaattcctttttttaaacttccagtttattgcgtaccaagagttgattacaacctccatgcttcataagcggacgccacgttagggttggacgtgggcaccacgagtcctttgaggctcctggacagagacccacatcaagatcggaagccctttgggtggcgttgcagatctcattgctcagtaggccgtgaagattttcatcctcatcccactctcagttggattttctggcactcttcctgcattgagtctcctgattactgaacagagctccgtcatgtagcctgctgaggaatggaatggaatggagatgcccacaggaggtcctgatgtcatcactgcacgcaggtgtgagaggagagacctcttctgcaccgcctggctacctcactcctctgctggtagcagtgcctatagctggacctaagttctcagaagcgtagatgtgcaaacaagcgattgagttgggctttaggaggacacatcataggagagaatccagggtctgtaagctggttttcttttcaggtgacatcctgaggggcctgtaagcaggggagctcctttttctagtttgcctgtagaggtgggaagactgttggtgtttctgtcctttacaggacattaggaaacagttgtgtaattacacaaggtggacctttatcttgcctgacatgctgggaatcttcaccccaccagggcaaatttccaaatagctcattttattctaggtctttcaaactttcatgtgacatatttccctttcccattgttgctgatttccaaatcgctgtcagcaattttttcctctctccttgcctattcttcactcatttggtggcaaagttcatagaactaggggacttggaagatgctttgaaaatattgttacaaaggcactgctaaaatgattcacagggagagtggccagttggaagaaggatcctaaggatgtgacactggttttcaacaacatgcttagagaactcatgaagtggattgggtgtcaacccagtgaacatgtttttatttaatttattttttgaagtttatgtggtgatggtgtggctttccgaaatgggcaaatattcagaagatcttttgcattttcttctgtcaggaatggggaaggggagtgggggcacaatctgagaaaggacacctgtgctgttctaggcatcgctggcaagtttgtgggaagggatgggcaagggtgagtgggtttgctccacaccgtcctgtgctgctcgagaggacctgggacgtgcgagggaaacgtgggtgacggtgcctaggctgcggcccttcactgctgtgctgggttcctgcagcctgctacgtttcccttggcaatgtaaatgaagatggaggggtcgtttcgtgatttcctgctgctgagaataaatgtcttgttaaaaacgtggcaacggttactcttaggtgccatggatcgatgtcagggtggtcagctctggactaagccacccacctccaatttgtacaacagtattgatacatagggctacactcattactgttcaagtgttctatgttaagagttgtgtttaatttctaaagattaaaaaaagcaaaaaaattggtgctaaaccttcacccctgagcacgctcagtgagactggtcatgcaagcatttacagtgccatgctcctcaagccgattttttcttgtagaaatgttgccctatttgtcttctccaatgtatggtatgttattttattttattattttattttattttattttattttatcgagggggggtacgatacctgccatttaagaaaatgaatagaaaattttaaaacccgagaaatggggaaaaaaaaaatcagtgcacaagaattgggctggttaggcccagcaccacactgaagtgggctcagtggtttttggagtgaagaagccttactccctgcacattccctcatgctcccacacaagtccagcaatggaaatgcttgggttcctcttgctttgtcaggggactcaggagtcgaccaagggaaaccatttggccccgtgaggaatgggcattgtcagtatccgtcctgaacggggcctagtcaggaagcggtctagaagtgtacggtcacggtcgcctcatgaaagtgtgtagcaggtggctctcaggaaaaataccaagtctggatcatccatgtggcagctttgcatagggagaggatagctccgaactggaactgaactgccttctctgcacgcttgaccaaagcagtgatgagggcggccagtacctgcggtgtgcgtggtaggtttaaagaaaagggaatgttttctgctgagtgtttcctttgtccttgggctgctcgagctggacagtaggtaaccactgttttcaaggaccagcccaatttctctggcttggttcggagttcgtttcatccctagctgtgagtgccttttggtctggaaagttggcttgtctcataatacccacagctaggacattctctctgtaattatgaattgtccttgttttacattaaaagagaatgtctttgatcactagagtctgtcggtgttggattatttccactgtgagattcttaaaacttttttgcttcataataataaaacaactcatgttagagaccctttcaacatgaaaggtttgtagttgagacattacatatattttattgtttataataaaaatcatctatacaaaagaagtcctgggtgttaatattttgcacaagatctgttttccatgatgtgttgacatctacaatttcactaactgttgacgttattttctattgagattctggagcctagggagctatgtgttctttttgttcatttcgttcttacttccctgaagcaagagactatatggccttcagtgcaaagacttcagaccaattctttgtattacacttggttgcctcttggctatataacttctgagtgcaaatcattgaacactttaacgaagtattgtagagaataaatcataatggataaaaa

SEQ ID NO: 21329 - DNA, 3819 bp, Homo sapiens
cgctctttgtgacgtggaagacagggcgggacaagcggcttcgtggctgcattgggaccttctcagccatgaatcttcattcaggactcagggaatacacgttaaccagtgcacttaaggacagccgatttccccccctgacccgagaggagctgcctaaacttttctgctctgtctccctccttactaactttgaggatgccagtgattacctggactgggaggtaggggtccatgggattcgaattgaattcattaatgaaaaaggtgtcaaacgcacagccacatatttacctgaggttgctaaggaacaagataattatactggggtaacatctgacaggaaggacgcaggagcagggagcctggggacagccattatggcatgtgtcgggctatcatctcatgtctcagagtctccacgggactggcagacagactgggcgccagactgggatcagatccagacaatagactccttgctcaggaaaggtggctttaaagctccaattaccagtgaattcagaaaaacgatcaaactcaccaggtaccgaagtgagaaggtgacaatcagttacgcagagtatattgcttcccgacagcactgtttccagaacggcactcttcatgccccgcccctctacaatcattactcctgacacacggctgcatgaccagtcccacccccccgtggccaccaatggctatgacatcattggagcagatgcctcctcttcctggtccagttacttctattactgcaccattttatgatgctagcttccgttgccaagtctgcctcccgctgactgagggagggtagggttaccttgaacgaaacagaacttgaggggcccaagccttatctcagcctttcctcaatatggggttccgttggattggggctcctccatgactagtgggaattactgtgggttcagaagacccttgtctggtatttgccacatggggtattggccacacgctggaagctgaaattgatgatccctgaaggttgaacccacacacacccctgcagcctccccagatgaagtaggtgtattcccctggcagtctgggcaacggagaccaagaaacatttttaggttgttttaaattcctttttttaaacttccagtttattgcgtaccaagagttgattacaacctccatgcttcataagcggacgccacgttagggttggacgtgggcaccacgagtcctttgaggctcctggacagagacccacatcaagatcggaagccctttgggtggcgttgcagatctcattgctcagtaggccgtgaagattttcatcctcatcccactctcagttggattttctggcactcttcctgcattgagtctcctgattactgaacagagctccgtcatgtagcctgctgaggaatggaatggaatggagatgcccacaggaggtcctgatgtcatcactgcacgcaggtgtgagaggagagacctcttctgcaccgcctggctacctcactcctctgctggtagcagtgcctatagctggacctaagttctcagaagcgtagatgtgcaaacaagcgattgagttgggctttaggaggacacatcataggagagaatccagggtctgtaagctggttttcttttcaggtgacatcctgaggggcctgtaagcaggggagctcctttttctagtttgcctgtagaggtgggaagactgttggtgtttctgtcctttacaggacattaggaaacagttgtgtaattacacaaggtggacctttatcttgcctgacatgctgggaatcttcaccccaccagggcaaatttccaaatagctcattttattctaggtctttcaaactttcatgtgacatatttccctttcccattgttgctgatttccaaatcgctgtcagcaattttttcctctctccttgcctattcttcactcatttggtggcaaagttcatagaactaggggacttggaagatgctttgaaaatattgttacaaaggcactgctaaaatgattcacagggagagtggccagttggaagaaggatcctaaggatgtgacactggttttcaacaacatgcttagagaactcatgaagtggattgggtgtcaacccagtgaacatgtttttatttaatttattttttgaagtttatgtggtgatggtgtggctttccgaaatgggcaaatattcagaagatcttttgcattttcttctgtcaggaatggggaaggggagtgggggcacaatctgagaaaggacacctgtgctgttctaggcatcgctggcaagtttgtgggaagggatgggcaagggtgagtgggtttgctccacaccgtcctgtgctgctcgagaggacctgggacgtgcgagggaaacgtgggtgacggtgcctaggctgcggcccttcactgctgtgctgggttcctgcagcctgctacgtttcccttggcaatgtaaatgaagatggaggggtcgtttcgtgatttcctgctgctgagaataaatgtcttgttaaaaacgtggcaacggttactcttaggtgccatggatcgatgtcagggtggtcagctctggactaagccacccacctccaatttgtacaacagtattgatacatagggctacactcattactgttcaagtgttctatgttaagagttgtgtttaatttctaaagattaaaaaaagcaaaaaaattggtgctaaaccttcacccctgagcacgctcagtgagactggtcatgcaagcatttacagtgccatgctcctcaagccgattttttcttgtagaaatgttgccctatttgtcttctccaatgtatggtatgttattttattttattattttattttattttattttattttatcgagggggggtacgatacctgccatttaagaaaatgaatagaaaattttaaaacccgagaaatggggaaaaaaaaaatcagtgcacaagaattgggctggttaggcccagcaccacactgaagtgggctcagtggtttttggagtgaagaagccttactccctgcacattccctcatgctcccacacaagtccagcaatggaaatgcttgggttcctcttgctttgtcaggggactcaggagtcgaccaagggaaaccatttggccccgtgaggaatgggcattgtcagtatccgtcctgaacggggcctagtcaggaagcggtctagaagtgtacggtcacggtcgcctcatgaaagtgtgtagcaggtggctctcaggaaaaataccaagtctggatcatccatgtggcagctttgcatagggagaggatagctccgaactggaactgaactgccttctctgcacgcttgaccaaagcagtgatgagggcggccagtacctgcggtgtgcgtggtaggtttaaagaaaagggaatgttttctgctgagtgtttcctttgtccttgggctgctcgagctggacagtaggtaaccactgttttcaaggaccagcccaatttctctggcttggttcggagttcgtttcatccctagctgtgagtgccttttggtctggaaagttggcttgtctcataatacccacagctaggacattctctctgtaattatgaattgtccttgttttacattaaaagagaatgtctttgatcactagagtctgtcggtgttggattatttccactgtgagattcttaaaacttttttgcttcataataataaaacaactcatgttagagaccctttcaacatgaaaggtttgtagttgagacattacatatattttattgtttataataaaaatcatctatac

SEQ ID NO: 21330 - DNA, 651 bp, Homo sapiens
cgctctttgtgacgtggaagacagggcgggacaagcggcttcgtggctgcattgggaccttctcagccatgaatcttcattcaggactcagggaatacacgttaaccagtgcacttaaggacagccgatttccccccctgacccgagaggagctgcctaaacttttctgctctgtctccctccttactaactttgaggatgccagtgattacctggactgggaggtaggggtccatgggattcgaattgaattcattaatgaaaaaggtgtcaaacgcacagccacatatttacctgaggttgctaaggaacaaggtgagttggatgaatgggattttaatgacaagtatcattcacagtggtgccagttaaagggcaagaaagtgaagtgtgtcatcttgcagcccaactgcagctgagaatgagggcctttctgcctcttaatacctgtcaaattcctatagaaccaagggtaaacttccaaaaaggtttaggagctgggaaaagcaaaagggtaaatcgttcacttactcgcctgatatttcaaacacttcttttcaatgaatagttttatttcttagccccttaaactacagtggcaattgtagcaaaataccaccaatcaacctgaccatattgtagaattcagta

SEQ ID NO: 21331 - DNA, 1815 bp, Homo sapiens
gtccaaaccaaactcacagctgcccctgtgcagccttcagagttgagctggggtctcagtctccaacctgtcctttctgaccctcccatggctgcccagggaggcggggttcactgtgccacgtgctgggtgcccccctctgcagacagccagtccaggagatggaccaacagaggtcaaggggcagctggccaggccgcaccggggtccccgagttctgagctgtgctatgcaaacaagaatgctcctgtgtgggggggcatggccgttggaggtatagctgggcgggtagtggaaggactggaaatctctgttgttgtttggggaagtccatgcttcagtccttcggagtatgcgtggattgttcgaagtgtgactatggcccgggagccagggcagcatgaactcctttctctgaaatttcgaggcctccttgggttccctgaactccgggctgatgttcccaggacccagcaccaggagaccccagtcccgccagcagccgccgctacccaggagggctgggcgacattggccgcctcccaccagctccccctcctcgcccacagcctcttgtcactgccaagcccccgttccttttgcccaaatcacgcaggcggaagctgcagtgccagctggagggatgttcatagggcttcctgtgcccatccctgctccaaacagctggacagcttcccctctacccccaccctggtgagcccctgggggccagagaaagatggggttcctgcaccttcccagctccacctctgaacttgagttagcgttagctaagcatacaatcagtgtcgaacgtctctcttccttaagcttgtagatacgactgcctataatcaggggactcccactggaggccgggaggccaatgctggccaggtgcgagggcatggtttggttcctttagggaatttttgttttgcaaacaggagaaacctgtgctgcaggttggagtggcaggaacgactggccttggtcagcaggcagcccccagcctagggccacagtcctcttcagggcctgggcagccccaatttctggcccagcaggtttctctttgtagtgtctttcagcacatccaaaatgctaggcctcctgccaccaacgtgtcagagcaatgtccaactgtcaggctctcagagatgcctcagtttccctagcatgagcaccagccgacacacacagtccactgagatgataattctgttctctccaaagcaaaaagctgggcgaggggtagtctcaatttctgtcagtgctcaaaggaataacaccaaaagaatcaacacagaatctcccagacacacgtgacccagctcgtggcgccgtgggtccgtaggagggacagtacctcacaacaggcccagcgggggaccacctctctgtacaattggaacgcgttttacttttcttttctctccttttttcattccgattttttttgcatgtttctttttgaaatgggcaaaatgtgtagcagcctgcatgagcacagttgttttggggaaagatactggagtatgatgtactcacacctgcaaatctgagcatcgcgaggttaaacgttccacctttttttgtaatcgtcaacagcacaactattttgtattgttgtttgtatcattttgtaccaaaaaaaaaaaggaaaaaaaaagggaagagagttgatgttttcagtgtgtttccagtgccagacagtcttggtcctgaactcagtagacccttgcggagcggttgtgcgcgggcaggcggggcgcgctgctccagagaatgaataaagtcccccttttccgtagt

SEQ ID NO: 21332 - DNA, 453 bp, Homo sapiens
gatggtgcaaagcattgtggctggaggcctccaagccaaggaagggccacagggagccctgaggtgggctggttcctgtccagccggctccctgggcagctccccaaatgggtaaaactgtgcagctggccagcccctaaccctccttccacccttcccccacccgccctctccagcacacactctcctctttaaccccacaaagagcctggctctgccaggttaatcattcttacaaatgcagacgctgggggacacgggtgcagccttcacatatctgtggggctgtcatgtggaagagggagctgcgccgtggggggcaggccagggaagctgtgggggcaggtgcagctctgtttggaccacctcagagagaaccagctatgctggggggatgttaatctccctgagcctaaaagtggacaatcccatgaataaaacatttgccaatgc

SEQ ID NO: 21333 - DNA, 412 bp, Homo sapiens
agtggtgcgatctcagctcactgcaacctccgcctccctggttcaatcaagtctcctgcctcagcctcccgagtagctgggattacaggctcctgccaccatacccagctaatttttgtatttttaatagagatggggtttcaccatgttgcccaggctggtctcaaacttctgacttcaagtaattcgcccacccgggcctcccaaagtgctgggattgcaggtataagccaccgcgcctggcctgtgttctaatgagaacggtaatagttctcaagcctacagaaccagaaccacttgagaagcttttaaaaagaaaacaaaactgaagcctgcgctccacgtaatactaactgaatcagaatctctggaggggaggtctaggctttggcactttaaaaaaacaaacaaa

SEQ ID NO: 21334 - DNA, 358 bp, Homo sapiens
ctgcctagtcttggagcaattcctgacccaggtggacaaatatcagttggctcagtacctacatgttggggtctagaattagtctggcttccctgagcccagagtccacatgccagggatgaactcttggcatctcacagccatcactgtgcaatcacctgcccttcccaagccatgtcccaggccatacacctgagcctcttctgccttggtttcctgaactgcattttgttttccttcttggggtttaattatgctgttaatgtaagccatcttggcatgtgacatagctattcactgtcatcctctgagggaataggcttgtacccaatattccagcccctgactggtgtcctgc

SEQ ID NO: 21335 - DNA, 583 bp, Homo sapiens
gaaaggtaaagaaaaattttaggatagttttggtttggtttggttttcctttctgaacaggaaaagggattatataggggacacccaggaggcctcagagcacaggtaaatttgtatttcttaaactagttagtaagtggacagatatttgttttgttattttgtctacactagatgtaatgaatgttatttatatctatttattattccgtaacaactatgtgtgtgcgtcctttgacccagcaaattctatttctaaaattttggttcacggaaataaaagcactcgtacatagactaaatgtacaaattaatggtataatttgtggtgggagaaatgaagtgaatgctcataaataagggaatgggtgaatatattttggaacatccatacagaggagtattatactgtcattaaaaagaattgagtttgccagacatggtggctgacaactgtaatcccagaactttgggaggctgatgtaggaggatcacttgagctcaggagttcaaagttacggtgagcaatgatcttgccactgtacaccagcctagatcacaaagcaagactgtctctttaaaa

SEQ ID NO: 21336 - DNA, 193 bp, Homo sapiens
gaccatgcatagactgatctctaaggagttttctaacggccgtatataaaggaaatgcttgataacaagataatattttctgttaagtaaaaggatttaatttgccgcatctttataagccatgcttaacattaagcaacattagctaccatttatgagcacctgctatataccagtaacagtgctttttgta

SEQ ID NO: 21337 - DNA, 168 bp, Homo sapiens
agaggaggggagaacaggaggaagaagggaagcaggcagggaggaagaacgcaggtaatgagaagaatgcaagtcatgctccaggctgacaagcttccaaagtaacaaaaaacccaactgtaatttgatatggacaaaaattattttaatcttctgttcataaatttt

SEQ ID NO: 21338 - DNA, 260 bp, Homo sapiens
ccaagatgtgctagatcaactgtgtatggtgctgctaatgagttcacagaaacctagaggtttttacttgcccaaggtcacaccactagctggggacacaaccaaaactggaaaattatagtggtaattcatagtttgttgccttgattatttaggtcaagttctgtaaactttttctgtgaagggccagattgtaaacattttaggctttgcaggccatatggtccctgttgcaactactcaactctactaacatagta

SEQ ID NO: 21339 - DNA, 229 bp, Homo sapiens
gagaaggaattgaatacattaaatggtgcatatcatggagaactttaatttttggcatgaagctttgtttggatttgatgcaacaaatgacaagaagccatttgtggtcaccgagtaagagaagaatggaggaaactgttttagtaagacagattgggcagtgtatggaaaatggaacagagaaagaagagactggaggatgaaatagtaatttggaaaaaggtaacat

SEQ ID NO: 21340 - DNA, 841 bp, Homo sapiens
tgcggaagggaaagtcgaggagggcagagccagccccggggcttggcaaggcctcctttctgccacgtaccttgtctctgcggaactccatcagcaggatcatgtcggaggcgggcagtgggaccctggaggacgagtggcaggccatctcggagattgcctctacttgcaacaccattctggagtcgctgtcccgagagggacagcccatcccagagagtggagaccctaagggaactccaaaatctgatgctgagccagagcctgggaacctctcagagaaggtctctcacttggagtccatgctcaggaagctgcaggaggacctgcagaaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtggagaaaagaggacttcagggagtaaaaaagccactgatgtctgtgtctgaaaaacaaaaaaaaaaaagtcagaggacaacaatgacggggaggggaaaaagggcatgaagcgccatggtcaaccaggtccgtgaccagttctgccaaggggaaccagcgggaccaagggagagaaaagaaagcacgtacggtaga

SEQ ID NO: 21341 - DNA, 336 bp, Homo sapiens
  misc_feature (8)..(8): n is a, c, g, or t
ggaggcgnctggagccattactgcccacactggggatctggccgaggagaggactgagttcctgcacagccagaactcgctgtcaccacgcagctctctgtcggatgaggccccagtcctgcccaacaccaccccggacctcctcctggccaccacagccaagccatcagtacccagtgctgacagtgagacacccctgacccaggacaggccaggcagtcccagtggctctgaggacaagggcaacccggcgccggagctgagggcctcctttctgccacgtaccttgtctctgcggaactccatcagcaggagtgagtctggacccaggagagc

SEQ ID NO: 21342 - DNA, 3638 bp, Homo sapiens
cgggagagcggcagcgggaccccagcgcgggcggcggcggctgggcgggagccccagagggcaggaactgctgccacaacctcaggctgggcaccaaacacccgtgcccgccaatgcggcccagcccccggagagtcaggcccacagagcatgcccatgtgggccggcggtgtggggagccctcggcggggcatggcccctgcgtccacagatgacctctttgcccgcaagctgcgccagccagcaaggcccccgctgacaccgcacaccttcgagccgaggccagtccggggcccactcctgcgcagcggcagcgatgcaggcgaggccaggccccccacgccagccagcccccgtgcccgtgcccacagccacgaagaggccagccgacctgcagccacttccacccggctcttcactgacccgctggcactgctggggctgccagcagaggaaccagagcctgccttcccaccagtgcttgagcctcgatggtttgcccactatgacgtgcaaagcctgctctttgattgggctccgaggtctcaggggatggggagccactcagaggccagctctgggaccctggcttcagccgaggaccaggctgccagctcggacctgctgcatggggcacctggctttgtgtgtgagctcgggggtgagggtgagctaggcctgggtggaccagcatccccacctgtgccccctgcactgcccaacgcggccgtgtccatcctggaggagccacagaaccgaacctcggcctacagcctggagcacgcagacctgggtgctggctactaccgcaaatacttctatggcaaagaacatcagaacttcttcgggatggacgagtcgctgggcccggtggcagtgagcctgcggcgggaggagaaggagggcagcggagggggcaccctgcacagctaccgcgtcatcgtgcggaccacgcagctccggacactccgtggcaccatctcggaggacgcgctgccgccggggcccccacggggtctgtccccaaggaaacttctggagcacgtggcgccgcagctgagccccagctgcctgcgcctgggctcagcttcacccaaggtaccacggacgctgctcacactggatgagcaagtgctgagcttccaacgcaaggtgggcatcctgtactgccgggcgggccagggctcggaggaggagatgtacaacaaccaggaggcgggaccggccttcatgcagtttctcaccttgctgggcgatgtggtgcggctcaaaggctttgagagttaccgggcccagctagacaccaaaacggattccacaggcacgcactccctctacaccacataccaggaccacgagatcatgttccacgtgtccacgatgctgccttacacccctaataaccagcagcagctcctccggaagcgccacattggcaacgacattgtgaccatcgtgttccaggagcctggcagcaagcccttctgccccaccaccatccgctcgcacttccagcacgtgttcctagtggtgcgggcacacacaccctgcacgccacacaccacctacagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctgcaagacctggccaccaacgaggtgaccactacgtcgctggactcggcttcacgcttcggcctgccctccctgggtgggaggcgccgggcggcccctcggggcccaggcgccgagctgcaggcagcgggctcactggtgtggggagtgcgcgcggcgcccggggcgcgggtcgccgccggggctcaggcgagcggccccgaaggcatcgaggtgccctgcctgctgggcatctcggccgaggctctggtgctggtggcgccgcgcgacggccgcgtagtgttcaattgcgcctgtcgcgacgtgctggcctggaccttctccgagcagcagctggacctgtaccacggccgcggggaggcgatcacgctgcgcttcgacgggtcccccggccaagccgtgggcgaggtggtggcgcgcctgcagctggtgagccgtggctgcgagacccgcgagctggcgctgccccgcgacggtcaaggccgcctgggcttcgaggtggacgccgagggattcgtcacgcacgtggagcgcttcacattcgccgagacggcggggctgcggcccggggcgcgcctcctgcgcgtgtgcggccagacgctgcccagcctccggcccgaggccgctgcccagctcctgcgctcggcgcccaaggtctgcgtcaccgtcctgccccccgacgagagcggccggccccgcaggagtttttcggagctgtacacgctgtcgctgcaggagcctagccggcggggggccccagatcctgtgcaggatgaggtccagggggtgaccctgctgcccaccacaaagcagctgctgcacctgtgcctgcaagatggtggcagtcctccagggcctggggatctggccgaggagaggactgagttcctgcacagccagaactcgctgtcaccacgcagctctctgtcggatgaggccccagtcctgcccaacaccaccccggacctcctcctggccaccacagccaagccatcagtacccagtgctgacagtgagacacccctgacccaggacaggccaggcagtcccagtggctctgaggacaagggcaacccggcgccggagctgagggcctcctttctgccacgtaccttgtctctgcggaactccatcagcaggatcatgtcggaggcgggcagtgggaccctggaggacgagtggcaggccatctcggagattgcctctacttgcaacaccattctggagtcgctgtcccgagagggacagcccatcccagagagtggagaccctaagggaactccaaaatctgatgctgagccagagcctgggaacctctcagagaaggtctctcacttggagtccatgctcaggaagctgcaggaggacctgcagaaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtggagaaaagaggacttcagggagtaaaaaagccactgatgtctgtgtctgaaaaacaaaaaaaaaaaagtcagaggacaacaatgacggggaggggaaaaagggcatgaagcgccatggtcaaccaggtccgtgaccagttctgccaaggggaaccagcgggaccaagggagagaaaagaaagcacgtacggtaga

SEQ ID NO: 21343 - DNA, 4775 bp, Homo sapiens
cgggagagcggcagcgggaccccagcgcgggcggcggcggctgggcgggagccccagagggcaggaactgctgccacaacctcaggctgggcaccaaacacccgtgcccgccaatgcggcccagcccccggagagtcaggcccacagagcatgcccatgtgggccggcggtgtggggagccctcggcggggcatggcccctgcgtccacagatgacctctttgcccgcaagctgcgccagccagcaaggcccccgctgacaccgcacaccttcgagccgaggccagtccggggcccactcctgcgcagcggcagcgatgcaggcgaggccaggccccccacgccagccagcccccgtgcccgtgcccacagccacgaagaggccagccgacctgcagccacttccacccggctcttcactgacccgctggcactgctggggctgccagcagaggaaccagagcctgccttcccaccagtgcttgagcctcgatggtttgcccactatgacgtgcaaagcctgctctttgattgggctccgaggtctcaggggatggggagccactcagaggccagctctgggaccctggcttcagccgaggaccaggctgccagctcggacctgctgcatggggcacctggctttgtgtgtgagctcgggggtgagggtgagctaggcctgggtggaccagcatccccacctgtgccccctgcactgcccaacgcggccgtgtccatcctggaggagccacagaaccgaacctcggcctacagcctggagcacgcagacctgggtgctggctactaccgcaaatacttctatggcaaagaacatcagaacttcttcgggatggacgagtcgctgggcccggtggcagtgagcctgcggcgggaggagaaggagggcagcggagggggcaccctgcacagctaccgcgtcatcgtgcggaccacgcagctccggacactccgtggcaccatctcggaggacgcgctgccgccggggcccccacggggtctgtccccaaggaaacttctggagcacgtggcgccgcagctgagccccagctgcctgcgcctgggctcagcttcacccaaggtaccacggacgctgctcacactggatgagcaagtgctgagcttccaacgcaaggtgggcatcctgtactgccgggcgggccagggctcggaggaggagatgtacaacaaccaggaggcgggaccggccttcatgcagtttctcaccttgctgggcgatgtggtgcggctcaaaggctttgagagttaccgggcccagctagacaccaaaacggattccacaggcacgcactccctctacaccacataccaggaccacgagatcatgttccacgtgtccacgatgctgccttacacccctaataaccagcagcagctcctccggaagcgccacattggcaacgacattgtgaccatcgtgttccaggagcctggcagcaagcccttctgccccaccaccatccgctcgcacttccagcacgtgttcctagtggtgcgggcacacacaccctgcacgccacacaccacctacagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctgcaagacctggccaccaacgaggtgaccactacgtcgctggactcggcttcacgcttcggcctgccctccctgggtgggaggcgccgggcggcccctcggggcccaggcgccgagctgcaggcagcgggctcactggtgtggggagtgcgcgcggcgcccggggcgcgggtcgccgccggggctcaggcgagcggccccgaaggcatcgaggtgccctgcctgctgggcatctcggccgaggctctggtgctggtggcgccgcgcgacggccgcgtagtgttcaattgcgcctgtcgcgacgtgctggcctggaccttctccgagcagcagctggacctgtaccacggccgcggggaggcgatcacgctgcgcttcgacgggtcccccggccaagccgtgggcgaggtggtggcgcgcctgcagctggtgagccgtggctgcgagacccgcgagctggcgctgccccgcgacggtcaaggccgcctgggcttcgaggtggacgccgagggattcgtcacgcacgtggagcgcttcacattcgccgagacggcggggctgcggcccggggcgcgcctcctgcgcgtgtgcggccagacgctgcccagcctccggcccgaggccgctgcccagctcctgcgctcggcgcccaaggtctgcgtcaccgtcctgccccccgacgagagcggccggccccgcaggagtttttcggagctgtacacgctgtcgctgcaggagcctagccggcggggggccccagatcctgtgcaggatgaggtccagggggtgaccctgctgcccaccacaaagcagctgctgcacctgtgcctgcaagatggtggcagtcctccagggcctggggatctggccgaggagaggactgagttcctgcacagccagaactcgctgtcaccacgcagctctctgtcggatgaggccccagtcctgcccaacaccaccccggacctcctcctggccaccacagccaagccatcagtacccagtgctgacagtgagacacccctgacccaggacaggccaggcagtcccagtggctctgaggacaagggcaacccggcgccggagctgagggcctcctttctgccacgtaccttgtctctgcggaactccatcagcaggatcatgtcggaggcgggcagtgggaccctggaggacgagtggcaggccatctcggagattgcctctacttgcaacaccattctggagtcgctgtcccgagagggacagcccatcccagagagtggagaccctaagggaactccaaaatctgatgctgagccagagcctgggaacctctcagagaaggtctctcacttggagtccatgctcaggaagctgcaggaggacctgcagaaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtggagaaaagaggacttcagggagtaaaaaagccaaaaaaaaaaaaaaaaaaaaaaaaaaaaaaaaaaaaaaaaaaaaaaaaaaaaaacacaaacccaaaaaacaaaaaaagaaagaaccaaaaaaaaaaaaaaaaaaaaaaaaaaaaaaaaacaccggagcgggagcggcaaccaccacacacccaccgcacccaccacgacgagggcggagggaacacgggctcagacgacgcggaggccggcggccagccgcacgcccggcagccctagcgcaaccaggggagccgggccaccggaccaccggcgacacgaagcggacgacgagaggagcaaggaagaggaagaggaggcagggaggacaaagaaataaggaagagaaaacaacacaccatccccccgatgggggcaaagcgaaggcagccagggcgcgacgacgcagtccacagaacacacaaaagcagagaccgaaaccgatgaaggcgcggacagcagcacaacagccacgcaagcgaaacacacacaccaagaggggagaggagagaagaaaagaatcgagggaaccgcccgggagacacgcggcggcggcaggagggagcaggacacgaagaagagaagagagaaggaagcgacagaaaatcagaacgaggaggggacgggaacaccagcaaagcaggagagcggagcagccagaggccgcgcacagacgcgggcacaaaaccggagggcaaaccaaaccacagagaagccacacgaaggaagcgacagaacagcgcgcggagagaagggaggagggacaagaggagagaagaacggcgggggggacggggaaaaggagacgccgacgagagagggcggagcgggcgaagagacgaagaaaggggagagaaaggagggaggcagggggagcgagaagagagagcaagcgagaaaggcacaacggacgaacgaccgaagagaggaagaaggcggagggaagaacaggcgaacggcgaacacggaggcagcagagccacgaggagaggacgcagacggcagaacagagcagacacggagaggagggtcgagagaggcgacgtgaacagaacgggcgagacagaaggcagaagagacgccgagccaaaccggagaagaagcgggagcaccaaaagagccaccggcgcagaccgcagcagagcgccacaaacacgaagagggagccgaggcccaggcggcagaaggagacacacaggacagaggagccaccagccgaccaggcagcgcggacagccgaccatgcacgaacgacggggaggaagcagaaggacagcagaagcagcaggcacaccacaagaa

SEQ ID NO: 21344 - DNA, 4050 bp, Homo sapiens
cagcagtgggcaggtgcagccctgcttagggcctggagatgggcagacccaggctcacatcctagctctgacacggaattgcttcaggcaagagcatctcctctggacctcatctgaccatctgtcacatggggttcagacctccctgtctgcatcagtgagaccaggtaggcagaggtccctatgggtccctgtcattgtgactcctcttgcccccaagcctgggcacagtagcctgcaagaaggtgagttggcctgtccttcagggcagggtgactggggtcccatgacagctgctgtgaccccagcaccttcctcaggatgtgggggcctggcagagggctgggcccacagttggggctacttcctgtgctgaaggaagtcctcttgccattcctgctgccctgccgctgcctccctgggaacccatgtgtccttgtggcccctctgagcagccccctcctccttcagggcaggaactgctgccacaacctcaggctgggcaccaaacacccgtgcccgccaatgcggcccagcccccggagagtcaggcccacagagcatgcccatgtgggccggcggtgtggggagccctcggcggggcatggcccctgcgtccacagatgacctctttgcccgcaagctgcgccagccagcaaggcccccgctgacaccgcacaccttcgagccgaggccagtccggggcccactcctgcgcagcggcagcgatgcaggcgaggccaggccccccacgccagccagcccccgtgcccgtgcccacagccacgaagaggccagccgacctgcagccacttccacccggctcttcactgacccgctggcactgctggggctgccagcagaggaaccagagcctgccttcccaccagtgcttgagcctcgatggtttgcccactatgacgtgcaaagcctgctctttgattgggctccgaggtctcaggggatggggagccactcagaggccagctctgggaccctggcttcagccgaggaccaggctgccagctcggacctgctgcatggggcacctggctttgtgtgtgagctcgggggtgagggtgagctaggcctgggtggaccagcatccccacctgtgccccctgcactgcccaacgcggccgtgtccatcctggaggagccacagaaccgaacctcggcctacagcctggagcacgcagacctgggtgctggctactaccgcaaatacttctatggcaaagaacatcagaacttcttcgggatggacgagtcgctgggcccggtggcagtgagcctgcggcgggaggagaaggagggcagcggagggggcaccctgcacagctaccgcgtcatcgtgcggaccacgcagctccggacactccgtggcaccatctcggaggacgcgctgccgccggggcccccacggggtctgtccccaaggaaacttctggagcacgtggcgccgcagctgagccccagctgcctgcgcctgggctcagcttcacccaaggtaccacggacgctgctcacactggatgagcaagtgctgagcttccaacgcaaggtgggcatcctgtactgccgggcgggccagggctcggaggaggagatgtacaacaaccaggaggcgggaccggccttcatgcagtttctcaccttgctgggcgatgtggtgcggctcaaaggctttgagagttaccgggcccagctagacaccaaaacggattccacaggcacgcactccctctacaccacataccaggaccacgagatcatgttccacgtgtccacgatgctgccttacacccctaataaccagcagcagctcctccggaagcgccacattggcaacgacattgtgaccatcgtgttccaggagcctggcagcaagcccttctgccccaccaccatccgctcgcacttccagcacgtgttcctagtggtgcgggcacacacaccctgcacgccacacaccacctacagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctgcaagacctggccaccaacgaggtgaccactacgtcgctggactcggcttcacgcttcggcctgccctccctgggtgggaggcgccgggcggcccctcggggcccaggcgccgagctgcaggcagcgggctcactggtgtggggagtgcgcgcggcgcccggggcgcgggtcgccgccggggctcaggcgagcggccccgaaggcatcgaggtgccctgcctgctgggcatctcggccgaggctctggtgctggtggcgccgcgcgacggccgcgtagtgttcaattgcgcctgtcgcgacgtgctggcctggaccttctccgagcagcagctggacctgtaccacggccgcggggaggcgatcacgctgcgcttcgacgggtcccccggccaagccgtgggcgaggtggtggcgcgcctgcagctggtgagccgtggctgcgagacccgcgagctggcgctgccccgcgacggtcaaggccgcctgggcttcgaggtggacgccgagggattcgtcacgcacgtggagcgcttcacattcgccgagacggcggggctgcggcccggggcgcgcctcctgcgcgtgtgcggccagacgctgcccagcctccggcccgaggccgctgcccagctcctgcgctcggcgcccaaggtctgcgtcaccgtcctgccccccgacgagagcggccggccccgcaggagtttttcggagctgtacacgctgtcgctgcaggagcctagccggcggggggccccagatcctgtgcaggatgaggtccagggggtgaccctgctgcccaccacaaagcagctgctgcacctgtgcctgcaagatggtggcagtcctccagggcctggggatctggccgaggagaggactgagttcctgcacagccagaactcgctgtcaccacgcagctctctgtcggatgaggccccagtcctgcccaacaccaccccggacctcctcctggccaccacagccaagccatcagtacccagtgctgacagtgagacacccctgacccaggacaggccaggcagtcccagtggctctgaggacaagggcaacccggcgccggagctgagggcctcctttctgccacgtaccttgtctctgcggaactccatcagcaggatcatgtcggaggcgggcagtgggaccctggaggacgagtggcaggccatctcggagattgcctctacttgcaacaccattctggagtcgctgtcccgagagggacagcccatcccagagagtggagaccctaagggaactccaaaatctgatgctgagccagagcctgggaacctctcagagaaggtctctcacttggagtccatgctcaggaagctgcaggaggacctgcagaaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtggagaaaagaggacttcagggagtaaaaaagccactgatgtctgtgtctgaaaaacaaaaaaaaaaaagtcagaggacaacaatgacggggaggggaaaaagggcatgaagcgccatggtcaaccaggtccgtgaccagttctgccaaggggaaccagcgggaccaagggagagaaaagaaagcacgtacggtaga

SEQ ID NO: 21345 - DNA, 3869 bp, Homo sapiens
ctaaggtgtgtgggtggcgactgggggaccctgcagtcccagggctgcccaggctccaggaccctcaggaccaagacccaacagcccagcctctagccttgcccagctaagctggggagggggctggaaactttagccctaggcagacaaggaagtggcctggaaagcggaagcagctttgatggtctcggagggggccggaagccaacacgggtggtggaggaccaggctgggggcctgggttcctgttttctgcccaggcccctctgagcagccccctcctccttcagggcaggaactgctgccacaacctcaggctgggcaccaaacacccgtgcccgccaatgcggcccagcccccggagagtcaggcccacagagcatgcccatgtgggccggcggtgtggggagccctcggcggggcatggcccctgcgtccacagatgacctctttgcccgcaagctgcgccagccagcaaggcccccgctgacaccgcacaccttcgagccgaggccagtccggggcccactcctgcgcagcggcagcgatgcaggcgaggccaggccccccacgccagccagcccccgtgcccgtgcccacagccacgaagaggccagccgacctgcagccacttccacccggctcttcactgacccgctggcactgctggggctgccagcagaggaaccagagcctgccttcccaccagtgcttgagcctcgatggtttgcccactatgacgtgcaaagcctgctctttgattgggctccgaggtctcaggggatggggagccactcagaggccagctctgggaccctggcttcagccgaggaccaggctgccagctcggacctgctgcatggggcacctggctttgtgtgtgagctcgggggtgagggtgagctaggcctgggtggaccagcatccccacctgtgccccctgcactgcccaacgcggccgtgtccatcctggaggagccacagaaccgaacctcggcctacagcctggagcacgcagacctgggtgctggctactaccgcaaatacttctatggcaaagaacatcagaacttcttcgggatggacgagtcgctgggcccggtggcagtgagcctgcggcgggaggagaaggagggcagcggagggggcaccctgcacagctaccgcgtcatcgtgcggaccacgcagctccggacactccgtggcaccatctcggaggacgcgctgccgccggggcccccacggggtctgtccccaaggaaacttctggagcacgtggcgccgcagctgagccccagctgcctgcgcctgggctcagcttcacccaaggtaccacggacgctgctcacactggatgagcaagtgctgagcttccaacgcaaggtgggcatcctgtactgccgggcgggccagggctcggaggaggagatgtacaacaaccaggaggcgggaccggccttcatgcagtttctcaccttgctgggcgatgtggtgcggctcaaaggctttgagagttaccgggcccagctagacaccaaaacggattccacaggcacgcactccctctacaccacataccaggaccacgagatcatgttccacgtgtccacgatgctgccttacacccctaataaccagcagcagctcctccggaagcgccacattggcaacgacattgtgaccatcgtgttccaggagcctggcagcaagcccttctgccccaccaccatccgctcgcacttccagcacgtgttcctagtggtgcgggcacacacaccctgcacgccacacaccacctacagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctgcaagacctggccaccaacgaggtgaccactacgtcgctggactcggcttcacgcttcggcctgccctccctgggtgggaggcgccgggcggcccctcggggcccaggcgccgagctgcaggcagcgggctcactggtgtggggagtgcgcgcggcgcccggggcgcgggtcgccgccggggctcaggcgagcggccccgaaggcatcgaggtgccctgcctgctgggcatctcggccgaggctctggtgctggtggcgccgcgcgacggccgcgtagtgttcaattgcgcctgtcgcgacgtgctggcctggaccttctccgagcagcagctggacctgtaccacggccgcggggaggcgatcacgctgcgcttcgacgggtcccccggccaagccgtgggcgaggtggtggcgcgcctgcagctggtgagccgtggctgcgagacccgcgagctggcgctgccccgcgacggtcaaggccgcctgggcttcgaggtggacgccgagggattcgtcacgcacgtggagcgcttcacattcgccgagacggcggggctgcggcccggggcgcgcctcctgcgcgtgtgcggccagacgctgcccagcctccggcccgaggccgctgcccagctcctgcgctcggcgcccaaggtctgcgtcaccgtcctgccccccgacgagagcggccggccccgcaggagtttttcggagctgtacacgctgtcgctgcaggagcctagccggcggggggccccagatcctgtgcaggatgaggtccagggggtgaccctgctgcccaccacaaagcagctgctgcacctgtgcctgcaagatggtggcagtcctccagggcctggggatctggccgaggagaggactgagttcctgcacagccagaactcgctgtcaccacgcagctctctgtcggatgaggccccagtcctgcccaacaccaccccggacctcctcctggccaccacagccaagccatcagtacccagtgctgacagtgagacacccctgacccaggacaggccaggcagtcccagtggctctgaggacaagggcaacccggcgccggagctgagggcctcctttctgccacgtaccttgtctctgcggaactccatcagcaggatcatgtcggaggcgggcagtgggaccctggaggacgagtggcaggccatctcggagattgcctctacttgcaacaccattctggagtcgctgtcccgagagggacagcccatcccagagagtggagaccctaagggaactccaaaatctgatgctgagccagagcctgggaacctctcagagaaggtctctcacttggagtccatgctcaggaagctgcaggaggacctgcagaaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtggagaaaagaggacttcagggagtaaaaaagccactgatgtctgtgtctgaaaaacaaaaaaaaaaaagtcagaggacaacaatgacggggaggggaaaaagggcatgaagcgccatggtcaaccaggtccgtgaccagttctgccaaggggaaccagcgggaccaagggagagaaaagaaagcacgtacggtaga

SEQ ID NO: 21346 - DNA, 2941 bp, Homo sapiens
ggcgggacttagtctagggtcaacatttggtggtgagatgaagcctaggcggggcttagtgatgcgcgtggtcgagcgggggcggggctgccagagggcgggaccaatcgttttcttcggcgcggtccccagaacatcagaacttcttcgggatggacgagtcgctgggcccggtggcagtgagcctgcggcgggaggagaaggagggcagcggagggggcaccctgcacagctaccgcgtcatcgtgcggaccacgcagctccggacactccgtggcaccatctcggaggacgcgctgccgccggggcccccacggggtctgtccccaaggaaacttctggagcacgtggcgccgcagctgagccccagctgcctgcgcctgggctcagcttcacccaaggtaccacggacgctgctcacactggatgagcaagtgctgagcttccaacgcaaggtgggcatcctgtactgccgggcgggccagggctcggaggaggagatgtacaacaaccaggaggcgggaccggccttcatgcagtttctcaccttgctgggcgatgtggtgcggctcaaaggctttgagagttaccgggcccagctagacaccaaaacggattccacaggcacgcactccctctacaccacataccaggaccacgagatcatgttccacgtgtccacgatgctgccttacacccctaataaccagcagcagctcctccggaagcgccacattggcaacgacattgtgaccatcgtgttccaggagcctggcagcaagcccttctgccccaccaccatccgctcgcacttccagcacgtgttcctagtggtgcgggcacacacaccctgcacgccacacaccacctacagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctgcaagacctggccaccaacgaggtgaccactacgtcgctggactcggcttcacgcttcggcctgccctccctgggtgggaggcgccgggcggcccctcggggcccaggcgccgagctgcaggcagcgggctcactggtgtggggagtgcgcgcggcgcccggggcgcgggtcgccgccggggctcaggcgagcggccccgaaggcatcgaggtgccctgcctgctgggcatctcggccgaggctctggtgctggtggcgccgcgcgacggccgcgtagtgttcaattgcgcctgtcgcgacgtgctggcctggaccttctccgagcagcagctggacctgtaccacggccgcggggaggcgatcacgctgcgcttcgacgggtcccccggccaagccgtgggcgaggtggtggcgcgcctgcagctggtgagccgtggctgcgagacccgcgagctggcgctgccccgcgacggtcaaggccgcctgggcttcgaggtggacgccgagggattcgtcacgcacgtggagcgcttcacattcgccgagacggcggggctgcggcccggggcgcgcctcctgcgcgtgtgcggccagacgctgcccagcctccggcccgaggccgctgcccagctcctgcgctcggcgcccaaggtctgcgtcaccgtcctgccccccgacgagagcggccggccccgcaggagtttttcggagctgtacacgctgtcgctgcaggagcctagccggcggggggccccagatcctgtgcaggatgaggtccagggggtgaccctgctgcccaccacaaagcagctgctgcacctgtgcctgcaagatggtggcagtcctccagggcctggggatctggccgaggagaggactgagttcctgcacagccagaactcgctgtcaccacgcagctctctgtcggatgaggccccagtcctgcccaacaccaccccggacctcctcctggccaccacagccaagccatcagtacccagtgctgacagtgagacacccctgacccaggacaggccaggcagtcccagtggctctgaggacaagggcaacccggcgccggagctgagggcctcctttctgccacgtaccttgtctctgcggaactccatcagcaggatcatgtcggaggcgggcagtgggaccctggaggacgagtggcaggccatctcggagattgcctctacttgcaacaccattctggagtcgctgtcccgagagggacagcccatcccagagagtggagaccctaagggaactccaaaatctgatgctgagccagagcctgggaacctctcagagaaggtctctcacttggagtccatgctcaggaagctgcaggaggacctgcagaaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtggagaaaagaggacttcagggagtaaaaaagccactgatgtctgtgtctgaaaaacaaaaaaaaaaaagtcagaggacaacaatgacggggaggggaaaaagggcatgaagcgccatggtcaaccaggtccgtgaccagttctgccaaggggaaccagcgggaccaagggagagaaaagaaagcacgtacggtaga

SEQ ID NO: 21347 - DNA, 3375 bp, Homo sapiens
cgggagagcggcagcgggaccccagcgcgggcggcggcggctgggcgggagccccagagggcaggaactgctgccacaacctcaggctgggcaccaaacacccgtgcccgccaatgcggcccagcccccggagagtcaggcccacagagcatgcccatgtgggccggcggtgtggggagccctcggcggggcatggcccctgcgtccacagatgacctctttgcccgcaagctgcgccagccagcaaggcccccgctgacaccgcacaccttcgagccgaggccagtccggggcccactcctgcgcagcggcagcgatgcaggcgaggccaggccccccacgccagccagcccccgtgcccgtgcccacagccacgaagaggccagccgacctgcagccacttccacccggctcttcactgacccgctggcactgctggggctgccagcagaggaaccagagcctgccttcccaccagtgcttgagcctcgatggtttgcccactatgacgtgcaaagcctgctctttgattgggctccgaggtctcaggggatggggagccactcagaggccagctctgggaccctggcttcagccgaggaccaggctgccagctcggacctgctgcatggggcacctggctttgtgtgtgagctcgggggtgagggtgagctaggcctgggtggaccagcatccccacctgtgccccctgcactgcccaacgcggccgtgtccatcctggaggagccacagaaccgaacctcggcctacagcctggagcacgcagacctgggtgctggctactaccgcaaatacttctatggcaaagaacatcagaacttcttcgggatggacgagtcgctgggcccggtggcagtgagcctgcggcgggaggagaaggagggcagcggagggggcaccctgcacagctaccgcgtcatcgtgcggaccacgcagctccggacactccgtggcaccatctcggaggacgcgctgccgccggggcccccacggggtctgtccccaaggaaacttctggagcacgtggcgccgcagctgagccccagctgcctgcgcctgggctcagcttcacccaaggtaccacggacgctgctcacactggatgagcaagtgctgagcttccaacgcaaggtgggcatcctgtactgccgggcgggccagggctcggaggaggagatgtacaacaaccaggaggcgggaccggccttcatgcagtttctcaccttgctgggcgatgtggtgcggctcaaaggctttgagagttaccgggcccagctagacaccaaaacggattccacaggcacgcactccctctacaccacataccaggaccacgagatcatgttccacgtgtccacgatgctgccttacacccctaataaccagcagcagctcctccggaagcgccacattggcaacgacattgtgaccatcgtgttccaggagcctggcagcaagcccttctgccccaccaccatccgctcgcacttccagcacgtgttcctagtggtgcgggcacacacaccctgcacgccacacaccacctacagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctgcaagacctggccactgttcaattgcgcctgtcgcgacgtgctggcctggaccttctccgagcagcagctggacctgtaccacggccgcggggaggcgatcacgctgcgcttcgacgggtcccccggccaagccgtgggcgaggtggtggcgcgcctgcagctggtgagccgtggctgcgagacccgcgagctggcgctgccccgcgacggtcaaggccgcctgggcttcgaggtggacgccgagggattcgtcacgcacgtggagcgcttcacattcgccgagacggcggggctgcggcccggggcgcgcctcctgcgcgtgtgcggccagacgctgcccagcctccggcccgaggccgctgcccagctcctgcgctcggcgcccaaggtctgcgtcaccgtcctgccccccgacgagagcggccggccccgcaggagtttttcggagctgtacacgctgtcgctgcaggagcctagccggcggggggccccagatcctgtgcaggatgaggtccagggggtgaccctgctgcccaccacaaagcagctgctgcacctgtgcctgcaagatggtggcagtcctccagggcctggggatctggccgaggagaggactgagttcctgcacagccagaactcgctgtcaccacgcagctctctgtcggatgaggccccagtcctgcccaacaccaccccggacctcctcctggccaccacagccaagccatcagtacccagtgctgacagtgagacacccctgacccaggacaggccaggcagtcccagtggctctgaggacaagggcaacccggcgccggagctgagggcctcctttctgccacgtaccttgtctctgcggaactccatcagcaggatcatgtcggaggcgggcagtgggaccctggaggacgagtggcaggccatctcggagattgcctctacttgcaacaccattctggagtcgctgtcccgagagggacagcccatcccagagagtggagaccctaagggaactccaaaatctgatgctgagccagagcctgggaacctctcagagaaggtctctcacttggagtccatgctcaggaagctgcaggaggacctgcagaaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtggagaaaagaggacttcagggagtaaaaaagccactgatgtctgtgtctgaaaaacaaaaaaaaaaaagtcagaggacaacaatgacggggaggggaaaaagggcatgaagcgccatggtcaaccaggtccgtgaccagttctgccaaggggaaccagcgggaccaagggagagaaaagaaagcacgtacggtaga

SEQ ID NO: 21348 - DNA, 3468 bp, Homo sapiens
cgggagagcggcagcgggaccccagcgcgggcggcggcggctgggcgggagccccagagggcaggaactgctgccacaacctcaggctgggcaccaaacacccgtgcccgccaatgcggcccagcccccggagagtcaggcccacagagcatgcccatgtgggccggcggtgtggggagccctcggcggggcatggcccctgcgtccacagatgacctctttgcccgcaagctgcgccagccagcaaggcccccgctgacaccgcacaccttcgagccgaggccagtccggggcccactcctgcgcagcggcagcgatgcaggcgaggccaggccccccacgccagccagcccccgtgcccgtgcccacagccacgaagaggccagccgacctgcagccacttccacccggctcttcactgacccgctggcactgctggggctgccagcagaggaaccagagcctgccttcccaccagtgcttgagcctcgatggtttgcccactatgacgtgcaaagcctgctctttgattgggctccgaggtctcaggggatggggagccactcagaggccagctctgggaccctggcttcagccgaggaccaggctgccagctcggacctgctgcatggggcacctggctttgtgtgtgagctcgggggtgagggtgagctaggcctgggtggaccagcatccccacctgtgccccctgcactgcccaacgcggccgtgtccatcctggaggagccacagaaccgaacctcggcctacagcctggagcacgcagacctgggtgctggctactaccgcaaatacttctatggcaaagaacatcagaacttcttcgggatggacgagtcgctgggcccggtggcagtgagcctgcggcgggaggagaaggagggcagcggagggggcaccctgcacagctaccgcgtcatcgtgcggaccacgcagctccggacactccgtggcaccatctcggaggacgcgctgccgccggggcccccacggggtctgtccccaaggaaacttctggagcacgtggcgccgcagctgagccccagctgcctgcgcctgggctcagcttcacccaaggtaccacggacgctgctcacactggatgagcaagtgctgagcttccaacgcaaggtgggcatcctgtactgccgggcgggccagggctcggaggaggagatgtacaacaaccaggaggcgggaccggccttcatgcagtttctcaccttgctgggcgatgtggtgcggctcaaaggctttgagagttaccgggcccagctagacaccaaaacggattccacaggcacgcactccctctacaccacataccaggaccacgagatcatgttccacgtgtccacgatgctgccttacacccctaataaccagcagcagctcctccggaagcgccacattggcaacgacattgtgaccatcgtgttccaggagcctggcagcaagcccttctgccccaccaccatccgctcgcacttccagcacgtgttcctagtggtgcgggcacacacaccctgcacgccacacaccacctacagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctgcaagacctggccaccaacgaggtgaccactacgtcgctggactcggcttcacgcttcggcctgccctccctgggtgggaggcgccgggcggcccctcggggcccaggcgccgagctgcaggcagcgggctcactggtgtggggagtgcgcgcggcgcccggggcgcgggtcgccgccggggctcaggcgagcggccccgaaggcatcgaggtgccctgcctgctgggcatctcggccgaggctctggtgctggtggcgccgcgcgacggccgcgtagtgttcaattgcgcctgtcgcgacgtgctggcctggaccttctccgagcagcagctggacctgtaccacggccgcggggaggcgatcacgctgcgcttcgacgggtcccccggccaagccgtgggcgaggtggtggcgcgcctgcagctggtgagccgtggctgcgagacccgcgagctggcgctgccccgcgacggtcaaggccgcctgggcttcgaggtggacgccgagggattcgtcacgcacgtggagcgcttcacattcgccgagacggcggggctgcggcccggggcgcgcctcctgcgcgtgtgcggccagacgctgcccagcctccggcccgaggccgctgcccagctcctgcgctcggcgcccaaggtctgcgtcaccgtcctgccccccgacgagagcggccggccccgcaggcctctgggaaagcggcttccctttctgagccacccctgctctccccagctctctgtcggatgaggccccagtcctgcccaacaccaccccggacctcctcctggccaccacagccaagccatcagtacccagtgctgacagtgagacacccctgacccaggacaggccaggcagtcccagtggctctgaggacaagggcaacccggcgccggagctgagggcctcctttctgccacgtaccttgtctctgcggaactccatcagcaggatcatgtcggaggcgggcagtgggaccctggaggacgagtggcaggccatctcggagattgcctctacttgcaacaccattctggagtcgctgtcccgagagggacagcccatcccagagagtggagaccctaagggaactccaaaatctgatgctgagccagagcctgggaacctctcagagaaggtctctcacttggagtccatgctcaggaagctgcaggaggacctgcagaaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtggagaaaagaggacttcagggagtaaaaaagccactgatgtctgtgtctgaaaaacaaaaaaaaaaaagtcagaggacaacaatgacggggaggggaaaaagggcatgaagcgccatggtcaaccaggtccgtgaccagttctgccaaggggaaccagcgggaccaagggagagaaaagaaagcacgtacggtaga

SEQ ID NO: 21349 - DNA, 2849 bp, Homo sapiens
cgggagagcggcagcgggaccccagcgcgggcggcggcggctgggcgggagccccagagggcaggaactgctgccacaacctcaggctgggcaccaaacacccgtgcccgccaatgcggcccagcccccggagagtcaggcccacagagcatgcccatgtgggccggcggtgtggggagccctcggcggggcatggcccctgcgtccacagatgacctctttgcccgcaagctgcgccagccagcaaggcccccgctgacaccgcacaccttcgagccgaggccagtccggggcccactcctgcgcagcggcagcgatgcaggcgaggccaggccccccacgccagccagcccccgtgcccgtgcccacagccacgaagaggccagccgacctgcagccacttccacccggctcttcactgacccgctggcactgctggggctgccagcagaggaaccagagcctgccttcccaccagtgcttgagcctcgatggtttgcccactatgacgtgcaaagcctgctctttgattgggctccgaggtctcaggggatggggagccactcagaggccagctctgggaccctggcttcagccgaggaccaggctgccagctcggacctgctgcatggggcacctggctttgtgtgtgagctcgggggtgagggtgagctaggcctgggtggaccagcatccccacctgtgccccctgcactgcccaacgcggccgtgtccatcctggaggagccacagaaccgaacctcggcctacagcctggagcacgcagacctgggtgctggctactaccgcaaatacttctatggcaaagaacatcagaacttcttcgggatggacgagtcgctgggcccggtggcagtgagcctgcggcgggaggagaaggagggcagcggagggggcaccctgcacagctaccgcgtcatcgtgcggaccacgcagctccggacactccgtggcaccatctcggaggacgcgctgccgccggggcccccacggggtctgtccccaaggaaacttctggagcacgtggcgccgcagctgagccccagctgcctgcgcctgggctcagcttcacccaaggtaccacggacgctgctcacactggatgagcaagtgctgagcttccaacgcaaggtgggcatcctgtactgccgggcgggccagggctcggaggaggagatgtacaacaaccaggaggcgggaccggccttcatgcagtttctcaccttgctgggcgatgtggtgcggctcaaaggctttgagagttaccgggcccagctagacaccaaaacggattccacaggcacgcactccctctacaccacataccaggaccacgagatcatgttccacgtgtccacgatgctgccttacacccctaataaccagcagcagctcctccggaagcgccacattggcaacgacattgtgaccatcgtgttccaggagcctggcagcaagcccttctgccccaccaccatccgctcgcacttccagcacgtgttcctagtggtgcgggcacacacaccctgcacgccacacaccacctacagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctgcaagacctggccacaaagcagctgctgcacctgtgcctgcaagatggtggcagtcctccagggcctggggatctggccgaggagaggactgagttcctgcacagccagaactcgctgtcaccacgcagctctctgtcggatgaggccccagtcctgcccaacaccaccccggacctcctcctggccaccacagccaagccatcagtacccagtgctgacagtgagacacccctgacccaggacaggccaggcagtcccagtggctctgaggacaagggcaacccggcgccggagctgagggcctcctttctgccacgtaccttgtctctgcggaactccatcagcaggatcatgtcggaggcgggcagtgggaccctggaggacgagtggcaggccatctcggagattgcctctacttgcaacaccattctggagtcgctgtcccgagagggacagcccatcccagagagtggagaccctaagggaactccaaaatctgatgctgagccagagcctgggaacctctcagagaaggtctctcacttggagtccatgctcaggaagctgcaggaggacctgcagaaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtggagaaaagaggacttcagggagtaaaaaagccactgatgtctgtgtctgaaaaacaaaaaaaaaaaagtcagaggacaacaatgacggggaggggaaaaagggcatgaagcgccatggtcaaccaggtccgtgaccagttctgccaaggggaaccagcgggaccaagggagagaaaagaaagcacgtacggtaga

SEQ ID NO: 21350 - DNA, 3845 bp, Homo sapiens
cgggagagcggcagcgggaccccagcgcgggcggcggcggctgggcgggagccccagagggcaggaactgctgccacaacctcaggctgggcaccaaacacccgtgcccgccaatgcggcccagcccccggagagtcaggcccacagagcatgcccatgtgggccggcggtgtggggagccctcggcggggcatggcccctgcgtccacagatgacctctttgcccgcaagctgcgccagccagcaaggcccccgctgacaccgcacaccttcgagccgaggccagtccggggcccactcctgcgcagcggcagcgatgcaggcgaggccaggccccccacgccagccagcccccgtgcccgtgcccacagccacgaagaggccagccgacctgcagccacttccacccggctcttcactgacccgctggcactgctggggctgccagcagaggaaccagagcctgccttcccaccagtgcttgagcctcgatggtttgcccactatgacgtgcaaagcctgctctttgattgggctccgaggtctcaggggatggggagccactcagaggccagctctgggaccctggcttcagccgaggaccaggctgccagctcggacctgctgcatggggcacctggctttgtgtgtgagctcgggggtgagggtgagctaggcctgggtggaccagcatccccacctgtgccccctgcactgcccaacgcggccgtgtccatcctggaggagccacagaaccgaacctcggcctacagcctggagcacgcagacctgggtgctggctactaccgcaaatacttctatggcaaagaacatcagaacttcttcgggatggacgagtcgctgggcccggtggcagtgagcctgcggcgggaggagaaggagggcagcggagggggcaccctgcacagctaccgcgtcatcgtgcggaccacgcagctccggacactccgtggcaccatctcggaggacgcgctgccgccggggcccccacggggtctgtccccaaggaaacttctggagcacgtggcgccgcagctgagccccagctgcctgcgcctgggctcagcttcacccaaggtaccacggacgctgctcacactggatgagcaagtgctgagcttccaacgcaaggtgggcatcctgtactgccgggcgggccagggctcggaggaggagatgtacaacaaccaggaggcgggaccggccttcatgcagtttctcaccttgctgggcgatgtggtgcggctcaaaggctttgagagttaccgggcccagctagacaccaaaacggattccacaggcacgcactccctctacaccacataccaggaccacgagatcatgttccacgtgtccacgatgctgccttacacccctaataaccagcagcagctcctccggaagcgccacattggcaacgacattgtgaccatcgtgttccaggagcctggcagcaagcccttctgccccaccaccatccgctcgcacttccagcacgtgttcctagtggtgcgggcacacacaccctgcacgccacacaccacctacagggtggccgtgagccgcacccaggacacccctgccttcgggccagctctgcctgctggcggaggccccttcgcagccaacgccgacttccgggccttcctgctggccaaagcgctgaatggtgagcaggcggccggccacgcgcgccagttccacgccatggccacgcgcacccgccagcagtacctgcaagacctggccaccaacgaggtgaccactacgtcgctggactcggcttcacgcttcggcctgccctccctgggtgggaggcgccgggcggcccctcggggcccaggcgccgagctgcaggcagcgggctcactggtgtggggagtgcgcgcggcgcccggggcgcgggtcgccgccggggctcaggcgagcggccccgaaggcatcgaggtgccctgcctgctgggcatctcggccgaggctctggtgctggtggcgccgcgcgacggccgcgtagtgttcaattgcgcctgtcgcgacgtgctggcctggaccttctccgagcagcagctggacctgtaccacggccgcggggaggcgatcacgctgcgcttcgacgggtcccccggccaagccgtgggcgaggtggtggcgcgcctgcagctggtgagccgtggctgcgagacccgcgagctggcgctgccccgcgacggtcaaggccgcctgggcttcgaggtggacgccgagggattcgtcacgcacgtggagcgcttcacattcgccgagacggcggggctgcggcccggggcgcgcctcctgcgcgtgtgcggccagacgctgcccagcctccggcccgaggccgctgcccagctcctgcgctcggcgcccaaggtctgcgtcaccgtcctgccccccgacgagagcggccggccccgcaggagtttttcggagctgtacacgctgtcgctgcaggagcctagccggcggggggccccagatcctgtgcaggatgaggtccagggggtgaccctgctgcccaccacaaagcagctgctgcacctgtgcctgcaagatggtggcagtcctccagggcctggggatctggccgaggagaggactgagttcctgcacagccagaactcgctgtcaccacgcagctctctgtcggatgaggccccagtcctgcccaacaccaccccggacctcctcctggccaccacagccaagccatcagtacccagtgctgacagtgagacacccctgacccaggacaggccaggcagtcccagtggctctgaggacaagggcaacccggcgccggagctgagggcctcctttctgccacgtaccttgtctctgcggaactccatcagcaggatcatgtcggaggcgggcagtgggaccctggaggacgagtggcaggccatctcggagattgcctctacttgcaacaccattctggagtcgctgtcccgagagggacagcccatcccagagagtggagaccctaagggaactccaaaatctgatgctgagtaagctccccaactccccacagccgctttacctgcccacatgaccccccttcgtgcctgtctgctggggtggagctctgtcctgggctctgctgccacatatgcctagaagaccagcggggcccctctcattagctggggctgggagtcagctggtgcactgccccctgccttggtcctgctgagtcttgacccccatgtcttcaggccagagcctgggaacctctcagagaaggtctctcacttggagtccatgctcaggaagctgcaggaggacctgcagaaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtggagaaaagaggacttcagggagtaaaaaagccactgatgtctgtgtctgaaaaacaaaaaaaaaaaagtcagaggacaacaatgacggggaggggaaaaagggcatgaagcgccatggtcaaccaggtccgtgaccagttctgccaaggggaaccagcgggaccaagggagagaaaagaaagcacgtacggtaga

SEQ ID NO: 21351 - DNA, 1056 bp, Homo sapiens
  misc_feature (8)..(8): n is a, c, g, or t
ggaggcgnctggagccattactgcccacactggggatctggccgaggagaggactgagttcctgcacagccagaactcgctgtcaccacgcagctctctgtcggatgaggccccagtcctgcccaacaccaccccggacctcctcctggccaccacagccaagccatcagtacccagtgctgacagtgagacacccctgacccaggacaggccaggcagtcccagtggctctgaggacaagggcaacccggcgccggagctgagggcctcctttctgccacgtaccttgtctctgcggaactccatcagcaggatcatgtcggaggcgggcagtgggaccctggaggacgagtggcaggccatctcggagattgcctctacttgcaacaccattctggagtcgctgtcccgagagggacagcccatcccagagagtggagaccctaagggaactccaaaatctgatgctgagccagagcctgggaacctctcagagaaggtctctcacttggagtccatgctcaggaagctgcaggaggacctgcagaaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtggagaaaagaggacttcagggagtaaaaaagccactgatgtctgtgtctgaaaaacaaaaaaaaaaaagtcagaggacaacaatgacggggaggggaaaaagggcatgaagcgccatggtcaaccaggtccgtgaccagttctgccaaggggaaccagcgggaccaagggagagaaaagaaagcacgtacggtaga

SEQ ID NO: 21352 - DNA, 511 bp, Homo sapiens
gctgatctagcaggatcctttagaggcacaaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtggagaaaagaggacttcagggagtaaaaaagccactgatgtctgtgtctgaaaaacaaaaaaaaaaaagtcagaggacaacaatgacggggaggggaaaaagggcatgaagcgccatggtcaaccaggtccgtgaccagttctgccaaggggaaccagcgggaccaagggagagaaaagaaagcacgtacggtaga

SEQ ID NO: 21353 - DNA, 436 bp, Homo sapiens
gccagcttcccgggcatgtccaacactgacttctgctccgcctggtggcagaaccatccaatccttgtaccgtgctcaaggagttgttttccaaatgcccaggtcgccttcccactccctgtggtgtgaattgctgtgccactggacctcagagagctagctccccaatactccagccccataatcctgccccaggaacctgccagccagcattctgtaccacatggcagagtgctcaagcatggcccatagacctgttgacggagcatgagagttgggattcccaaggtatgtgattgttttttctctgttaaaactctggatctacttgtgttcccaagaaggtcctcattccttagattaccatgaaaaagttcaggctatgtggaactgaagtcacaaatttaaaatgataccatgggtggctggcccttgc

SEQ ID NO: 21354 - DNA, 718 bp, Homo sapiens
gttgcccaggctggagagcagtagcgcgatctcagctcactgcaacccccacctcctgggttcaagtgattctcctgcctcagcctccccagtagctgggatttacaggtgcccgctaccatgcctggctaatttttgtatttttagtagagacaggctttcaccatgttggccaggctgatctcaaactcctgacctcaggtgatccacccacctcggcctccgaaagtgctgggattacaggagtgagccaccgcgcctggccccgtattcattttttatactggaaaacattttttttgtaatttttctttgcaaagaaatgagcataaaaatgaatactccaaagaaaaggaattattatggcaaattaaaagggacacggtactatgatttaattactgtcttgtctttttaaaatgtcatctcttgttttaccctttttttaaataaaagctttaaaaacatgtctttgggtattattctggaggtatgtttcttttatataagatttcaagtttaaacatttacaataagtaataatatttaaattcttataacaagtaatgaaatatttggtttagtaattagcttagtctatttttaaaaatcattaaaatttactttgtttttaagaatgccatactacaaatgatgttatttggttttaatggtgttttgtgtttaagatagaataaatagagtttgaagaatgtga

SEQ ID NO: 21355 - DNA, 925 bp, Homo sapiens
catcttatatacccataaattgggttttagtgaaagagccaggatggaacataatttcctaacttccatcctagtttcctttctacttgtttagaatggccagtgaaacacacaaatggcactcagatttgttgatggctcaccaactcaaagaggttccttctctcctttgataagtcccacaaaaacatctactgtaaagacttgaaatacaatgcctttcttttttatgagagccaagtttacccacaactctcaactaccagtactggtctgactgtgcagaaaagggttgcccgcaaaggtcaatgatatcaccctagaacattctagaatgatgaattttgagaatgtgaaaccttagaacctcgtgcggttgtctgccttggaattcctgtgctgtatcctgaaattttagctgaatttggcagagaattcagagaaaatttgcttttctaatccttgctgcctgaaagtgctaattattttccatagctaggatattaccatggagcaatattttctctgcctttgataactcccagcaaattactacattaaccgcctttgaaatccaggagccacaaattttaattcagtggcctgctaaaacatgcactctctggtttaaagtttgccaaaggtggtgctgccccatatgccactgtgcccagctgacatattctcacttaatagaattatagagaaatttttcatgtttttctttttctctcccactttttcatattcctctttttcatttttgcctttccgtttctgtctatgatgtaggcttctgaggagaaccaagaagcttggctttagtggtagaatgacagaacttagggatcccttgcaggctagaacaaagttctgacccttagaccaaatctttatgttaagagttttccagaattcaaaaaaa

SEQ ID NO: 21356 - DNA, 595 bp, Homo sapiens
ccattctctacaatgctgtgaaccattgtgtagtgggtcagagcttggctttgggcctggacagacaggttcaaatcccaattttgccgctttctggtgatttgccattaactgtgcccttaccttgctgggcctcagttttttcatcagtcaagtgtagataataagattatctacctcaaacaagtgttatgaaaattcaacaaaatgatagtctttacgcttttagtacagagcctgacatacagtttgtgcaataattagaagttgttttggccaggtgcggtggctcacacctgtaatcccagcatactgggactacaggcatgagccactgtgcccagctgacatattctcacttaatagaattatagagaaatttttcatgtttttctttttctctcccactttttcatattcctctttttcatttttgcctttccgtttctgtctatgatgtaggcttctgaggagaaccaagaagcttggctttagtggtagaatgacagaacttagggatcccttgcaggctagaacaaagttctgacccttagaccaaatctttatgttaagagttttccagaattcaaaaaaa

SEQ ID NO: 21357 - DNA, 1129 bp, Homo sapiens
catcttatatacccataaattgggttttagtgaaagagccaggatggaacataatttcctaacttccatcctagtttcctttctacttgtttagaatggccagtgaaacacacaaatggcactcagatttgttgatggctcaccaactcaaagaggttccttctctcctttgataagtcccacaaaaacatctactgtaaagacttgaaatacaatgcctttcttttttatgagagccaagtttacccacaactctcaactaccagtactggtctgactgtgcagaaaagggttgcccgcaaaggtcaatgatatcaccctagaacattctagaatgatgaattttgagaatgtgaaaccttagaacctcgtgcggttgtctgccttggaattcctgtgctgtatcctgaaattttagctgaatttggcagagaattcagagaaaatttgcttttctaatccttgctgcctgaaagtgctaattattttccatagctaggatattaccatggagcaatattttctctgcctttgataactcccagcaaattactacattaaccgcctttgaaatccaggagccacaaattttaattcagtggcctgctaaaacatgcactctctggtttaaagtttgccaaaggtggtgctgccccatatgccaccgcgcctggccccgtattcattttttatactggaaaacattttttttgtaatttttctttgcaaagaaatgagcataaaaatgaatactccaaagaaaaggaattattatggcaaattaaaagggacacggtactatgatttaattactgtcttgtctttttaaaatgtcatctcttgttttaccctttttttaaataaaagctttaaaaacatgtctttgggtattattctggaggtatgtttcttttatataagatttcaagtttaaacatttacaataagtaataatatttaaattcttataacaagtaatgaaatatttggtttagtaattagcttagtctatttttaaaaatcattaaaatttactttgtttttaagaatgccatactacaaatgatgttatttggttttaatggtgttttgtgtttaagatagaataaatagagtttgaagaatgtga

SEQ ID NO: 21358 - DNA, 814 bp, Homo sapiens
catcttatatacccataaattgggttttagtgaaagagccaggatggaacataatttcctaacttccatcctagtttcctttctacttgtttagaatggccagtgaaacacacaaatggcactcagatttgttgatggctcaccaactcaaagaggttccttctctcctttgataagtcccacaaaaacatctactgtaaagacttgaaatacaatgcctttcttttttatgagagccaagtttacccacaactctcaactaccagtactggtctgactgtgcagaaaagggttgcccgcaaaggtcaatgatatcaccctagaacattctagaatgatgaattttgagaatgtgaaaccttagaacctcgtgcggttgtctgccttggaattcctgtgctgtatcctgaaattttagctgaatttggcagagaattcagagaaaatttgcttttctaatccttgctgcctgaaagtgctaattattttccatagctaggatattaccatggagcaatattttctctgcctttgataactcccagcaaattactacattaaccgcctttgaaatccaggagccacaaattttaattcagtggcctgctaaaacatgcactctctggtttaaagtttgccaaaggtggtgctgccccatatgccacattgaatactgggaaggccactgcgcccggcctcttttctttctttcttactcttgctctcttgctctctctttctctcactctctttctctctctctctttctctctttccctccctccctctctctctctctctttctttatttcct

SEQ ID NO: 21359 - DNA, 557 bp, Homo sapiens
ccattctctacaatgctgtgaaccattgtgtagtgggtcagagcttggctttgggcctggacagacaggttcaaatcccaattttgccgctttctggtgatttgccattaactgtgcccttaccttgctgggcctcagttttttcatcagtcaagtgtagataataagattatctacctcaaacaagtgttatgaaaattcaacaaaatgatagtctttacgcttttagtacagagcctgacatacagtttgtgcaataattagaagttgttttggccaggtgcggtggctcacacctgtaatcccagcactttgggaggctgaggcaggtggatcacttgaggtcgggagttcgagaacagcgtggccaaaatggcgaaaccctgtctctactaaaaacatgaaaattagccgggcgtggtggcgcatgcctgtaatcccagctacttgggaggctgaggtaggagaatggcttgaaaccgggaggcagaggttacagcaagccaggatcgtgccactgcactccagcctgggcgacagagtgacactccatctaa

SEQ ID NO: 21360 - DNA, 728 bp, Homo sapiens
cttcataggtcaaaactggcaatattctcttgtctgcaagataaagtgtttgtgcttctatcaccatatgcatgaacatgtaagaatcagatacaatttctgcttcatcagtttcacatgttcatgttgtcactgaaaaaatgcatctactgtttatagctcccaaggagaccccaaatccttttttttttcttttgagatggagtcttgctcttgtcgcctaggctggagtgcagtggcacaatctcagctcacggcagcctccgcctcccgggttcaaacgattctcatgcctcaggcttccgagtagctgggactacaggtgtgcaccaccatgcccagctaatttttgaatgtttagtagagatgggatttcaccatgttggccaggctggtctcaaactcctgagctcaagtgatccacctgccttggcctcccaaagtactgggactacaggcatgagccactgtgcccagctgacatattctcacttaatagaattatagagaaatttttcatgtttttctttttctctcccactttttcatattcctctttttcatttttgcctttccgtttctgtctatgatgtaggcttctgaggagaaccaagaagcttggctttagtggtagaatgacagaacttagggatcccttgcaggctagaacaaagttctgacccttagaccaaatctttatgttaagagttttccagaattcaaaaaaa

SEQ ID NO: 21361 - DNA, 310 bp, Homo sapiens
aattcatgttttgaatttgatggtggagtgtagttattgattttattcaaaatggcattttgaggttccaacaagtgaagacttgttgataatggcatcacttttgctgtgatgatttctccttatagtcatgcattcctaaaatgaaattatggtagaagccacccaaaatgtgcttactgtgtaataactacctattttaagagcttatatcatggaaaagagctaaaggctaaaacacaaattttgagacagttacttctaaattgctttacaaacaggatgtgtgctgaacacaatcttaaactgt

SEQ ID NO: 21362 - DNA, 587 bp, Homo sapiens
attttgctcttacttgcagcttgtcctgaagatcactatgggcagaactgtgttcaatggcgttcctgtggctcaggacagtgtgacccagtgactggagtgtgtcagtgtccacctggccgaatgggaaccaggtgtcaggaaggtaacaatgggcagggtcaccttctctgtccaagcactaaattagctatgctgcgaaagcagatttggtgccaacgaagataattatatggacaatatttacaagaatgttttctgttagtgtggctttcaaataacatgaaagtacatgctcccgagccgggcgcggtgactcacgcctgtaatcccagcactttgggaggccgaggagggcggatcacgaggtcaggagatcgagaccatcctggctaagacagtgaaaccccgcctctactaaaaatataaaaaattattggggcgtggtggcgggtgccagtagtcccaactactcagtaggctgaggcaggagaatggcgtgaacccgggagacggagcttgcagtgagctgggatcgccccactgcactgcagcctgggcgacagagcaagactcaatcacaaaaa

SEQ ID NO: 21363 - DNA, 1286 bp, Homo sapiens
  misc_feature (3)..(3): n is a, c, g, or t
gcnagcgggagctgctgtggcggcggcaacatggcggacgtgataaatgtcagtgtgaacctggaggccttttcccaggccattagtgccatccaggcgctgcgctccagcgtgagcagggtgttcgactgcctgaaggatgggatgcggaacaaggagacgctggagggccgggagaaggcctttattgcgcacttccaggacaacttacattcggtcaaccgggacctcaatgagctggaacgtctgagcaatctggtaggcaagccatctgagaaccatcctcttcataacagtgggctgttaagcctggatcctgtgcaggacaaaactcctctctatagtcaactccttcaagcatataagtggtcaaacaagttgcagtaccatgcaggactagcatctggccttttaaatcagcagtcattgaagcgttccgctaatcagatgggagtatctgccaaacgtagaccaaaggctcagcccacaactcttgtcctaccacctcaatatgttgatgatgtgatcagccgcattgacaggatgtttcctgaaatgtccatccacttatccagacccaatggaacatcagcaatgcttctgcttgatatatggtccaaatccaactatcaagtattccagaaggtgacagaccatgccaccactgccctgctccactatcagctgccccagatgccggatgtcgtggtccgatccttcatgacctggttaagaagttacataaagctgttccaggccccgtgccagcgctgcgggaagtttctgcaggacggccttcccccgacatggagggatttccgaaccctcgaagccttccatgacacctgccggcagtagcccccacgctggccccagcctcagaccccacccagcaccttcccagacacgcaggaagcccacagaaggctcagctggttcctcactgcccagatgtgtacagctgctcctccctttcataaagcagcgccatgtgtgcagaggccactcttgaagagcagactccctctgtggctgatgggactaattattcccactagccagcggactgaaggcaaagaagacctttctagaacctggtagaaggaagctgtgcagcatgctcctcgtccatgtgtgtcggcagtgctggtgtctgtcgtctccgcgagctgttactggaatgagcccttgtgttcatgggtatcgtcatgcggggttcttgtgttttgtggggcttgggttttggtaacttatttttataagcaataaaccttttgtatcctgga

SEQ ID NO: 21364 - DNA, 2119 bp, Homo sapiens
  misc_feature (561)..(561): n is a, c, g, or t
  misc_feature (661)..(661): n is a, c, g, or t
  misc_feature (1559)..(1559): n is a, c, g, or t
gttaacagtagttacaatattatttcttgaagtcccgaattctaagaccgatgctgatgatccttctctcctttcccctcagcttgatatatggtccaaatccaactatcaagtattccagaaggtaagttttactttttgcttcttactcaagcggcattaggaaaacgtgaatgctttgaggtttaaacattggtctcaaatcagaggcttttgaaaaagtgaaaaaagccagacagaaaaggatgctcactgtctgattccatatgtatgacattctggaaaaaaactgtattctgaaaacctagttttaaaactcggtttctcagagccctagcggtctccactggtgcccaagggatgggccaagggaagcaggctggcactccctcaccctgccccttccccactttgtgctctggggacactgtatctttttcagatattgggcttccttatgaaaaactgttatgggaaatgtcagacgaaatgaaaagtgaccagagaaaattcatttccccagctcctgacagtgcagggccccttccctggactaactcnggccctgtggctgatgaggattctgtccccaccgccacacccccaccagtccccacagtactcagggccagctccctgcagggcagcagccggcttcttntgttctcatccatcttctgtctctggtctcatccagtagtgaaataagagagttggccatcatctcattcgttccctcatccagctcaacaacaggtgtccactccccagcactttgggaggccaaggtaggcagatcacctgaggtcaggagttcaagaccagcctagccaatatggcaaaaccctgtctgtactaaaaatataaaattagccgggcatggtggcgggcgcctataatcctagctactcaggaggctgaggcagaagaattgcttaaacctgggagacagaggttgcagtgagcccagattgtgccattgcactccagcctgggtgacagatgagactccatctcaaaaaaaaaaaaaaaagtatccactgagcccctttgctctgtgccaggcactgttaggtgccagggccacagaggaaactccaacaggcaaggaagcctaacaaatgactccaggtgattaactgggggctgtggccaggaaacacaagggggcctccttctgattaggctagtcagaggaagcctttgtaggggaaactgaggcaggcagtgtgagaaggaggagccagccccgtgaagtggggatgaagtggaggtagaaggcagggctcaggtcagggaggtgcctctaggccctggtgcagaattcggattttatccttaattcagtgagaaaccactgacgggatttacacagagggggatgtgattttgaaagcttggtccgagttatccccacgatgaagaatggttgtgtccacagtgtgccaggaagcacaggactcttttgtagatcaaggtgaaattcacataacttgaaattaaccgttttaaagtgaatgctccttggcttgatgtgccttcacaatagtgtacatccnctacctctgtctggttctaaaacatttccttaccccacaagaaaatctggtgtgcattgagcagtgagcataggacttagtggatcagaggggcgtcatggaccaccctctagaggtgtttactgtacataatccacagtgccccctgggcccctttttggtgataagggctaggcagaggacaggcgtctaggattaggggagtagtctgaggctgaaaaccacacatttagggaacctatataagcattacagattcatgatctgatcacagctaaatgcaatgtgctaccctggattggatcctgaaacagaaagaggttactaatggggccgggtgcggtggctcatgcctgtaatcccagcactttgggaggctcaggtgggtggattacaaggtcaggagttcgagaccagcctggccaacatggtgaaaccctgtctctactaaaaatacacaaatcagccaggcgtggtggcgggcgcctgtaatcccagctacgcgggaggttgcagtgagccactgcactccagcctgggtgacagagcaagactacatc

SEQ ID NO: 21365 - DNA, 469 bp, Homo sapiens
taaattcgcggtcgcgtcgacgtggtcaaacaagttgcagtaccatgcaggactagcatctggccttttaaatcagcagtcattgaagcgttccgctaatcagatgggagtatctgccaaacgtagaccaaaggctcagcccacaactcttgtcctaccacctcaatatgttgatgatgtgatcagccgcattgacaggatgtttcctgaaatgtccatccacttatccagacccaatggaacatcagcaatgcttctggtgaccttgggaaaggtgttgaaagtgatcgtcgtcatgcggagcctgttcattgatcgaacaatagtaaagggatataacgagaatgtctacacagaagatggcaagcttgatatatggtccaaatccaactatcaagtattccagaaggcctgttttttccaagtcttggatgctgagcaaaaaaacaactttgttgttgaaaaatgt

SEQ ID NO: 21366 - DNA, 316 bp, Homo sapiens
tccctccctttccttgggcttgcatccctttgatgtttttacaagccttttttcaaacctgcactcactggtgggtgaatcgcctccctctccttgggagcattagtgcccttcctggcctccgccaagggggagggcggcttttatctcccagcggaatctcattagctttgccgcacaatgggaccgaacctcggctgccacagagtggatttaaattagttaatagcagattttttttttttttttgccccaggcctgttttttccaagtcttggatgctgagcaaaaaaacaactttgttgttgaaaaatgt

SEQ ID NO: 21367 - DNA, 1394 bp, Homo sapiens
  misc_feature (3)..(3): n is a, c, g, or t
gcnagcgggagctgctgtggcggcggcaacatggcggacgtgataaatgtcagtgtgaacctggaggccttttcccaggccattagtgccatccaggcgctgcgctccagcgtgagcagggtgttcgactgcctgaaggatgggatgcggaacaaggagacgctggagggccgggagaaggcctttattgcgcacttccaggacaacttacattcggtcaaccgggacctcaatgagctggaacgtctgagcaatctggtaggcaagccatctgagaaccatcctcttcataacagtgggctgttaagcctggatcctgtgcaggacaaaactcctctctatagtcaactccttcaagcatataagtggtcaaacaagttgcagtaccatgcaggactagcatctggccttttaaatcagcagtcattgaagcgttccgctaatcagatgggagtatctgccaaacgtagaccaaaggctcagcccacaactcttgtcctaccacctcaatatgttgatgatgtgatcagccgcattgacaggatgtttcctgaaatgtccatccacttatccagacccaatggaacatcagcaatgcttctggtgaccttgggaaaggtgttgaaagtgatcgtcgtcatgcggagcctgttcattgatcgaacaatagtaaagggatataacgagaatgtctacacagaagatggcaagcttgatatatggtccaaatccaactatcaagtattccagaaggtgacagaccatgccaccactgccctgctccactatcagctgccccagatgccggatgtcgtggtccgatccttcatgacctggttaagaagttacataaagctgttccaggccccgtgccagcgctgcgggaagtttctgcaggacggccttcccccgacatggagggatttccgaaccctcgaagccttccatgacacctgccggcagtagcccccacgctggccccagcctcagaccccacccagcaccttcccagacacgcaggaagcccacagaaggctcagctggttcctcactgcccagatgtgtacagctgctcctccctttcataaagcagcgccatgtgtgcagaggccactcttgaagagcagactccctctgtggctgatgggactaattattcccactagccagcggactgaaggcaaagaagacctttctagaacctggtagaaggaagctgtgcagcatgctcctcgtccatgtgtgtcggcagtgctggtgtctgtcgtctccgcgagctgttactggaatgagcccttgtgttcatgggtatcgtcatgcggggttcttgtgttttgtggggcttgggttttggtaacttatttttataagcaataaaccttttgtatcctgga

SEQ ID NO: 21368 - DNA, 1426 bp, Homo sapiens
  misc_feature (3)..(3): n is a, c, g, or t
gcnagcgggagctgctgtggcggcggcaacatggcggacgtgataaatgtcagtgtgaacctggaggccttttcccaggccattagtgccatccaggcgctgcgctccagcgtgagcagggtgttcgactgcctgaaggatgggatgcggaacaaggagacgctggagggccgggagaaggcctttattgcgcacttccaggacaacttacattcggtcaaccgggacctcaatgagctggaacgtctgagcaatctggtaggcaagccatctgagaaccatcctcttcataacagtgggctgttaagcctggatcctgtgcaggacaaaactcctctctatagtcaactccttcaagcatataagtggtcaaacaagttgcagtaccatgcaggactagcatctggccttttaaatcagcagtcattgaagcgttccgctaatcagatgggagtatctgccaaacgtagaccaaaggctcagcccacaactcttgtcctaccacctcaatatgttgatgatgtgatcagccgcattgacaggatgtttcctgaaatgtccatccacttatccagacccaatggaacatcagcaatgcttctggtgaccttgggaaaggtgttgaaagtgatcgtcgtcatgcggagcctgttcattgatcgaacaatagtaaagggatataacgagaatgtctacacagaagatggcaagcttgatatatggtccaaatccaactatcaagtattccagaaggtgacagaccatgccaccactgccctgctccactatcagctgccccagatgccggatgtcgtggtccgatccttcatgacctggttaagaagttacataaagctgttccaggccccgtgccagcgctgcgggaagtttctgcaggacggccttcccccgacatggagggatttccgaaccctcgaagccttccatgacacctgccggcagtagcccccacgctggccccagcctcagaccccacccagcaccttcccagacacgcaggaagcccacagaaggctcagctggttcctcactgcccagatgtgtacagctgctcctccctttcataaagcagcgccatgtgtgcagaggccactcttgaagagcagactccctctgtggctgatgggactaattattcccactagccagcggactgaaggcaaagaagacctttctagaacctggtagaaggaagctgtgcagcatgctcctcgtccatgtgtgtcggcagtgctggtgtctgtcgtctccgcgagctgttactggaatgagcccttgtgttcatgggtatcgtcatgcggggttcttgtgttttgtggggcttgggttttggtaacttatttttataagcaataaaccttttgtatcctggaaaaaaaaaaccaaacccaaccaccccaccaca

SEQ ID NO: 21369 - DNA, 1383 bp, Homo sapiens
tacggctaggtacgaggcctgggtggcggtgataaatgtcagtgtgaacctggaggccttttcccaggccattagtgccatccaggcgctgcgctccagcgtgagcagggtgttcgactgcctgaaggatgggatgcggaacaaggagacgctggagggccgggagaaggcctttattgcgcacttccaggacaacttacattcggtcaaccgggacctcaatgagctggaacgtctgagcaatctggtaggcaagccatctgagaaccatcctcttcataacagtgggctgttaagcctggatcctgtgcaggacaaaactcctctctatagtcaactccttcaagcatataagtggtcaaacaagttgcagtaccatgcaggactagcatctggccttttaaatcagcagtcattgaagcgttccgctaatcagatgggagtatctgccaaacgtagaccaaaggctcagcccacaactcttgtcctaccacctcaatatgttgatgatgtgatcagccgcattgacaggatgtttcctgaaatgtccatccacttatccagacccaatggaacatcagcaatgcttctggtgaccttgggaaaggtgttgaaagtgatcgtcgtcatgcggagcctgttcattgatcgaacaatagtaaagggatataacgagaatgtctacacagaagatggcaagcttgatatatggtccaaatccaactatcaagtattccagaaggtgacagaccatgccaccactgccctgctccactatcagctgccccagatgccggatgtcgtggtccgatccttcatgacctggttaagaagttacataaagctgttccaggccccgtgccagcgctgcgggaagtttctgcaggacggccttcccccgacatggagggatttccgaaccctcgaagccttccatgacacctgccggcagtagcccccacgctggccccagcctcagaccccacccagcaccttcccagacacgcaggaagcccacagaaggctcagctggttcctcactgcccagatgtgtacagctgctcctccctttcataaagcagcgccatgtgtgcagaggccactcttgaagagcagactccctctgtggctgatgggactaattattcccactagccagcggactgaaggcaaagaagacctttctagaacctggtagaaggaagctgtgcagcatgctcctcgtccatgtgtgtcggcagtgctggtgtctgtcgtctccgcgagctgttactggaatgagcccttgtgttcatgggtatcgtcatgcggggttcttgtgttttgtggggcttgggttttggtaacttatttttataagcaataaaccttttgtatcctgga

SEQ ID NO: 21370 - DNA, 1273 bp, Homo sapiens
  misc_feature (3)..(3): n is a, c, g, or t
gcnagcgggagctgctgtggcggcggcaacatggcggacgtgataaatgtcagtgtgaacctggaggccttttcccaggccattagtgccatccaggcgctgcgctccagcgtgagcagggtgttcgactgcctgaaggatgggatgcggaacaaggagacgctggagggccgggagaaggcctttattgcgcacttccaggacaacttacattcggtcaaccgggacctcaatgagctggaacgtctgagcaatctggtaggcaagccatctgagaaccatcctcttcataacagtgggctgttaagcctggatcctgtgcaggacaaaactcctctctatagtcaactccttcaagcatataagtggtcaaacaagttgcagtaccatgcaggactagcatctggccttttaaatcagcagtcattgaagcgttccgctaatcagatgggagtatctgccaaacgtagaccaaaggctcagcccacaactcttgtcctaccacctcaatatgttgatgatgtgatcagccgcattgacaggatgtttcctgaaatgtccatccacttatccagacccaatggaacatcagcaatgcttctggtgaccttgggaaaggtgttgaaagtgatcgtcgtcatgcggagcctgttcattgatcgaacaatagtaaagggatataacgagaatgtctacacagaagatggcaagcttgatatatggtccaaatccaactatcaagtattccagaaggtgacagaccatgccaccactgccctgctccactatcagctgccccagatgccggatgtcgtggtccgatccttcatgacctggttaagaagttacataaagctgttccaggccccgtgccagcgctgcgggaagtttctgcaggacggccttcccccgacatggagggatttccgaaccctcgaagccttccatgacacctgccggcagtagcccccacgctggccccagcctcagaccccacccagcacagactccctctgtggctgatgggactaattattcccactagccagcggactgaaggcaaagaagacctttctagaacctggtagaaggaagctgtgcagcatgctcctcgtccatgtgtgtcggcagtgctggtgtctgtcgtctccgcgagctgttactggaatgagcccttgtgttcatgggtatcgtcatgcggggttcttgtgttttgtggggcttgggttttggtaacttatttttataagcaataaaccttttgtatcctgga

SEQ ID NO: 21371 - DNA, 1307 bp, Homo sapiens
  misc_feature (3)..(3): n is a, c, g, or t
gcnagcgggagctgctgtggcggcggcaacatggcggacgtgataaatgtcagtgtgaacctggaggccttttcccaggccattagtgccatccaggcgctgcgctccagcgtgagcagggtgttcgactgcctgaaggatgggatgcggaacaaggagacgctggagggccgggagaaggcctttattgcgcacttccaggacaacttacattcggtcaaccgggacctcaatgagctggaacgtctgagcaatctggtaggcaagccatctgagaaccatcctcttcataacagtgggctgttaagcctggatcctgtgcaggacaaaactcctctctatagtcaactccttcaagcatataagtggtcaaacaagttgcagtaccatgcaggactagcatctggccttttaaatcagcagtcattgaagcgttccgctaatcagatgggagtatctgccaaacgtagaccaaaggctcagcccacaactcttgtcctaccacctcaatatgttgatgatgtgatcagccgcattgacaggatgtttcctgaaatgtccatccacttatccagacccaatggaacatcagcaatgcttctggtgaccttgggaaaggtgttgaaagtgatcgtcgtcatgcggagcctgttcattgatcgaacaatagtaaagggatataacgagaatgtctacacagaagatggcaagcttgatatatggtccaaatccaactatcaagtattccagaaggtgacagaccatgccaccactgccctgctccactatcagctgccccagatgccggatgtcgtggtccgatccttcatgacctggttaagaagttacataaagctgttccaggccccgtgccagcgctgcgggaagtttctgcaggacggccttcccccgacatggagggatttccgaaccctcgaagccttccatgacacctgccggcagtagcccccacgctggccccagcctcagaccccacccagcacagcgccatgtgtgcagaggccactcttgaagagcagactccctctgtggctgatgggactaattattcccactagccagcggactgaaggcaaagaagacctttctagaacctggtagaaggaagctgtgcagcatgctcctcgtccatgtgtgtcggcagtgctggtgtctgtcgtctccgcgagctgttactggaatgagcccttgtgttcatgggtatcgtcatgcggggttcttgtgttttgtggggcttgggttttggtaacttatttttataagcaataaaccttttgtatcctgga

SEQ ID NO: 21372 - DNA, 1070 bp, Homo sapiens
ttcgcatattctacgaatagttcacgctgtctagaataaaatcgaaaatattgattgcagtaccatgcaggactagcatctggccttttaaatcagcagtcattgaagcgttccgctaatcagatgggagtatctgccaaacgtagaccaaaggctcagcccacaactcttgtcctaccacctcaatatgttgatgatgtgatcagccgcattgacaggatgtttcctgaaatgtccatccacttatccagacccaatggaacatcagcaatgcttctggtgaccttgggaaaggtgttgaaagtgatcgtcgtcatgcggagcctgttcattgatcgaacaatagtaaagggatataacgagaatgtctacacagaagatggcaagcttgatatatggtccaaatccaactatcaagtattccagaaggtgacagaccatgccaccactgccctgctccactatcagctgccccagatgccggatgtcgtggtccgatccttcatgacctggttaagaagttacataaagctgttccaggccccgtgccagcgctgcgggaagtttctgcaggacggccttcccccgacatggagggatttccgaaccctcgaagccttccatgacacctgccggcagtagcccccacgctggccccagcctcagaccccacccagcaccttcccagacacgcaggaagcccacagaaggctcagctggttcctcactgcccagatgtgtacagctgctcctccctttcataaagcagcgccatgtgtgcagaggccactcttgaagagcagactccctctgtggctgatgggactaattattcccactagccagcggactgaaggcaaagaagacctttctagaacctggtagaaggaagctgtgcagcatgctcctcgtccatgtgtgtcggcagtgctggtgtctgtcgtctccgcgagctgttactggaatgagcccttgtgttcatgggtatcgtcatgcggggttcttgtgttttgtggggcttgggttttggtaacttatttttataagcaataaaccttttgtatcctgga

SEQ ID NO: 21373 - DNA, 1075 bp, Homo sapiens
ctcgccattattccacccatacattatatcccaacaaccccacactatatatctttatcttgcagtaccatgcaggactagcatctggccttttaaatcagcagtcattgaagcgttccgctaatcagatgggagtatctgccaaacgtagaccaaaggctcagcccacaactcttgtcctaccacctcaatatgttgatgatgtgatcagccgcattgacaggatgtttcctgaaatgtccatccacttatccagacccaatggaacatcagcaatgcttctggtgaccttgggaaaggtgttgaaagtgatcgtcgtcatgcggagcctgttcattgatcgaacaatagtaaagggatataacgagaatgtctacacagaagatggcaagcttgatatatggtccaaatccaactatcaagtattccagaaggtgacagaccatgccaccactgccctgctccactatcagctgccccagatgccggatgtcgtggtccgatccttcatgacctggttaagaagttacataaagctgttccaggccccgtgccagcgctgcgggaagtttctgcaggacggccttcccccgacatggagggatttccgaaccctcgaagccttccatgacacctgccggcagtagcccccacgctggccccagcctcagaccccacccagcaccttcccagacacgcaggaagcccacagaaggctcagctggttcctcactgcccagatgtgtacagctgctcctccctttcataaagcagcgccatgtgtgcagaggccactcttgaagagcagactccctctgtggctgatgggactaattattcccactagccagcggactgaaggcaaagaagacctttctagaacctggtagaaggaagctgtgcagcatgctcctcgtccatgtgtgtcggcagtgctggtgtctgtcgtctccgcgagctgttactggaatgagcccttgtgttcatgggtatcgtcatgcggggttcttgtgttttgtggggcttgggttttggtaacttatttttataagcaataaaccttttgtatcctgga

SEQ ID NO: 21374 - DNA, 2748 bp, Homo sapiens
  misc_feature (3)..(3): n is a, c, g, or t
  misc_feature (1190)..(1190): n is a, c, g, or t
  misc_feature (1290)..(1290): n is a, c, g, or t
  misc_feature (2188)..(2188): n is a, c, g, or t
gcnagcgggagctgctgtggcggcggcaacatggcggacgtgataaatgtcagtgtgaacctggaggccttttcccaggccattagtgccatccaggcgctgcgctccagcgtgagcagggtgttcgactgcctgaaggatgggatgcggaacaaggagacgctggagggccgggagaaggcctttattgcgcacttccaggacaacttacattcggtcaaccgggacctcaatgagctggaacgtctgagcaatctggtaggcaagccatctgagaaccatcctcttcataacagtgggctgttaagcctggatcctgtgcaggacaaaactcctctctatagtcaactccttcaagcatataagtggtcaaacaagttgcagtaccatgcaggactagcatctggccttttaaatcagcagtcattgaagcgttccgctaatcagatgggagtatctgccaaacgtagaccaaaggctcagcccacaactcttgtcctaccacctcaatatgttgatgatgtgatcagccgcattgacaggatgtttcctgaaatgtccatccacttatccagacccaatggaacatcagcaatgcttctggtgaccttgggaaaggtgttgaaagtgatcgtcgtcatgcggagcctgttcattgatcgaacaatagtaaagggatataacgagaatgtctacacagaagatggcaagcttgatatatggtccaaatccaactatcaagtattccagaaggtaagttttactttttgcttcttactcaagcggcattaggaaaacgtgaatgctttgaggtttaaacattggtctcaaatcagaggcttttgaaaaagtgaaaaaagccagacagaaaaggatgctcactgtctgattccatatgtatgacattctggaaaaaaactgtattctgaaaacctagttttaaaactcggtttctcagagccctagcggtctccactggtgcccaagggatgggccaagggaagcaggctggcactccctcaccctgccccttccccactttgtgctctggggacactgtatctttttcagatattgggcttccttatgaaaaactgttatgggaaatgtcagacgaaatgaaaagtgaccagagaaaattcatttccccagctcctgacagtgcagggccccttccctggactaactcnggccctgtggctgatgaggattctgtccccaccgccacacccccaccagtccccacagtactcagggccagctccctgcagggcagcagccggcttcttntgttctcatccatcttctgtctctggtctcatccagtagtgaaataagagagttggccatcatctcattcgttccctcatccagctcaacaacaggtgtccactccccagcactttgggaggccaaggtaggcagatcacctgaggtcaggagttcaagaccagcctagccaatatggcaaaaccctgtctgtactaaaaatataaaattagccgggcatggtggcgggcgcctataatcctagctactcaggaggctgaggcagaagaattgcttaaacctgggagacagaggttgcagtgagcccagattgtgccattgcactccagcctgggtgacagatgagactccatctcaaaaaaaaaaaaaaaagtatccactgagcccctttgctctgtgccaggcactgttaggtgccagggccacagaggaaactccaacaggcaaggaagcctaacaaatgactccaggtgattaactgggggctgtggccaggaaacacaagggggcctccttctgattaggctagtcagaggaagcctttgtaggggaaactgaggcaggcagtgtgagaaggaggagccagccccgtgaagtggggatgaagtggaggtagaaggcagggctcaggtcagggaggtgcctctaggccctggtgcagaattcggattttatccttaattcagtgagaaaccactgacgggatttacacagagggggatgtgattttgaaagcttggtccgagttatccccacgatgaagaatggttgtgtccacagtgtgccaggaagcacaggactcttttgtagatcaaggtgaaattcacataacttgaaattaaccgttttaaagtgaatgctccttggcttgatgtgccttcacaatagtgtacatccnctacctctgtctggttctaaaacatttccttaccccacaagaaaatctggtgtgcattgagcagtgagcataggacttagtggatcagaggggcgtcatggaccaccctctagaggtgtttactgtacataatccacagtgccccctgggcccctttttggtgataagggctaggcagaggacaggcgtctaggattaggggagtagtctgaggctgaaaaccacacatttagggaacctatataagcattacagattcatgatctgatcacagctaaatgcaatgtgctaccctggattggatcctgaaacagaaagaggttactaatggggccgggtgcggtggctcatgcctgtaatcccagcactttgggaggctcaggtgggtggattacaaggtcaggagttcgagaccagcctggccaacatggtgaaaccctgtctctactaaaaatacacaaatcagccaggcgtggtggcgggcgcctgtaatcccagctacgcgggaggttgcagtgagccactgcactccagcctgggtgacagagcaagactacatc

SEQ ID NO: 21375 - DNA, 800 bp, Homo sapiens
  misc_feature (3)..(3): n is a, c, g, or t
gcnagcgggagctgctgtggcggcggcaacatggcggacgtgataaatgtcagtgtgaacctggaggccttttcccaggccattagtgccatccaggcgctgcgctccagcgtgagcagggtgttcgactgcctgaaggatgggatgcggaacaaggagacgctggagggccgggagaaggcctttattgcgcacttccaggacaacttacattcggtcaaccgggacctcaatgagctggaacgtctgagcaatctggtaggcaagccatctgagaaccatcctcttcataacagtgggctgttaagcctggatcctgtgcaggacaaaactcctctctatagtcaactccttcaagcatataagtggtcaaacaagttgcagtaccatgcaggactagcatctggccttttaaatcagcagtcattgaagcgttccgctaatcagatgggagtatctgccaaacgtagaccaaaggctcagcccacaactcttgtcctaccacctcaatatgttgatgatgtgatcagccgcattgacaggatgtttcctgaaatgtccatccacttatccagacccaatggaacatcagcaatgcttctggtgaccttgggaaaggtgttgaaagtgatcgtcgtcatgcggagcctgttcattgatcgaacaatagtaaagggatataacgagaatgtctacacagaagatggcaagttcttcctgtgtgtcaagaggtcttttgatgtcttggtgtttgccctgagaacagacgtgtctgtgctgaagcaattggtcatctgcaa

SEQ ID NO: 21376 - DNA, 622 bp, Homo sapiens
  misc_feature (3)..(3): n is a, c, g, or t
gcnagcgggagctgctgtggcggcggcaacatggcggacgtgataaatgtcagtgtgaacctggaggccttttcccaggccattagtgccatccaggcgctgcgctccagcgtgagcagggtgttcgactgcctgaaggatgggatgcggaacaaggagacgctggagggccgggagaaggcctttattgcgcacttccaggacaacttacattcggtcaaccgggacctcaatgagctggaacgtctgagcaatctggtaggcaagccatctgagaaccatcctcttcataacagtgggctgttaagcctggatcctgtgcaggacaaaactcctctctatagtcaactccttcaagcatataagtggtcaaacaagttgcagtaccatgcaggactagcatctggccttttaaatcagcagtcattgaagcgttccgctaatcagatgggagtatctgccaaacgtagaccaaaggctcagcccacaactcttgtcctaccacctcaatatgttgatgatgtgatcagccgcattgacaggatgtttcctgaaatgtccatccacttatttaggggaaaaaaattaaacaacagggtagacagaagaactaaggcaaaga

SEQ ID NO: 21377 - DNA, 662 bp, Homo sapiens
  misc_feature (3)..(3): n is a, c, g, or t
gcnagcgggagctgctgtggcggcggcaacatggcggacgtgataaatgtcagtgtgaacctggaggccttttcccaggccattagtgccatccaggcgctgcgctccagcgtgagcagggtgttcgactgcctgaaggatgggatgcggaacaaggagacgctggagggccgggagaaggcctttattgcgcacttccaggacaacttacattcggtcaaccgggacctcaatgagctggaacgtctgagcaatctggtaggcaagccatctgagaaccatcctcttcataacagtgggctgttaagcctggatcctgtgcaggacaaaactcctctctatagtcaactccttcaagcatataagtggtcaaacaagccaaggtgggctcggctcgtgggcttgtggcagagccgtcccccgtgcccaggctcccatggcatgcagctagcagcggccaagcttagcgcctcgcctaccacatccaccttctgatggcagtgcccaccagtggaacgaactctctccacacctcattatttctacaaccttgagtgaatttgcaaattaattgatgtgtgggagggaaggcatctgctattgtaaaaacctttaactgtggcagtaaaacttgaaataaaattaagtgttactatagtaaa

SEQ ID NO: 21378 - DNA, 702 bp, Homo sapiens
ttttaaaagtgaaaaattcttcgatagatgggctaatgctctctctactgtttctccctctggagatgaacatctgcaacaagccctccaacaagacggcccctgagaagagtgtgtggacggcaccggcacagcccagcggaccctcccctgagctgcagggccagcgatcccgccggaatgggtggagctggccccctcacccgctccagattgtggcctggctgctgtacctcttctttgctgtgatcggctttgggatccttgttcccctcctgcctcaccactgggtgcccgctggctacgctgtatccttgggaaagcgtagggctggtgtgtggaagtggggaggcaaaggatggctggcacagcggaggcccaaagccgggttgagagccttggggagcacagtcaggagagtggagcagggtgggcccagtcctggggacttgctgcttcccagcctgtctccagcctccacctgacctctccacctgatagggtgagtgggcatgcctaaaatacctaggagcatatgaagccccacaaagatgtgaatcctgtccacagaggcaccacaggagcagtcatagaaggaggagcctcaaaccatcctgatgctaattgtgttcagagctgaacaaaggatgaagtagggagtaattagtccatctatcgaagaatttttcacttttcaaagag

SEQ ID NO: 21379 - DNA, 2057 bp, Homo sapiens
cgggcccagcgccggacgaggcccagccagtctgggtctggcctggccgcccctccagcctgctggagccggagccggagccggagccggagccggagccggagccagagccagagctcgaggactcaccggcccagtctccgtccgggatggggccccgctcccgggcgcgttgccgcccagtcccggggaccgtccctaccgcgagggtctgaggcgcggctgccccggggagggtggaaggccaggcgtggggcccgaacctctggctgactttggcagggcccatctggcacggcctccgcggcgcgcagctgttttcaagtcagcaaacatttactgaggatctactatgtacaagatgaacatctgcaacaagccctccaacaagacggcccctgagaagagtgtgtggacggcaccggcacagcccagcggaccctcccctgagctgcagggccagcgatcccgccggaatgggtggagctggccccctcacccgctccagattgtggcctggctgctgtacctcttctttgctgtgatcggctttgggatccttgttcccctcctgcctcaccactgggtgcccgctggctacgcttgcatgggcgccatctttgctggccaccttgtggtgcacctgaccgccgtctccatcgatccagcagatgccaacgtgcgggacaagagctatgcggggcccctgcccatcttcaaccgaagccagcacgcacatgtcattgaagacctgcactgcaacttgtgcaacgtggatgtgagcgctcgctccaagcactgcagcgcctgcaacaagtgcgtgtgcggtttcgaccaccactgcaagtggctcaacaactgtgtgggcgagcggaactaccggctctttctacacagtgttgcatccgctttactgggcgtcctgctcctggtgctggtggccacatatgtcttcgtggagttctttgtcaaccccatgcgtctgcgcaccaaccgacactttgaagtcctgaagaatcacacggatgtgtggttcgtgttcctgcctgccgcccccgtggagacccaggcccctgccatcctggccctggccgccctgctcatccttctgggcctcctgtccacagccctcctggggcacctgctctgcttccacatttatctcatgtggcacaagctcaccacctatgagtacatcgtgcagcaccgcccaccacaggaggccaagggggttcacagggagctcgagtcatgtcctcccaagatgcggcccattcaggagatggagttctacatgcggaccttcagacatatgcgcccagagccccctggccaggccgggccagcagcagtgaatgccaaacactctcgccctgcctccccggatccgaccccaggtaggagggactgtgctgggcctccggtccaggtggagtgggatagaaagaagcctctaccctggcgctcgcctctgcttcttttggcgatgtggggccctcaggctcccccgtgtctctgcagaaaaagaggaagaggcgcgtgtataaagtgcgaacgtctgagacctcggatccggcgtcggggcctagggcccccagccgccgctccagctcgtcgacggattccgcggacgccagccctgtgcacgccgctggccctgccggcgcctaccactcggcgtcggcagagtccgtggacgagattccagtggcgcagacgcgcctgggcagcgccgctctggccgccccgcggggccggggccgacagcccacgctggcgcggcaggcgcgtgcgcccgccgttttcgtgagcccgagcagcggcgagcccagggcgccgggcggccgggaggctggtctggcttagctgggccgagaggccggagggccgagttagagcggccggcctgactctctatgcaacaccccatccttgccgcaccgagtgcactttaggggcccctacggccggcgggatcggcctccctcccccacgactcagcaatacccgccccaccggctgtgatgctccaataaacttttttatgcttttgcgga

SEQ ID NO: 21380 - DNA, 1303 bp, Homo sapiens
gcaggactaggccactcctgcaaccccctggcctcaaggcccctttgctctcaggggtcgcgtctgcaccctcagggttgctgtgaagatcagggcttgcccataagcctggtgctcagtggggctgcggctctgtttgttccaccacctgctaccttcccttttggtgtagtggcagggagaccaccgcatgtgcatttacgcagccccttctcggcagcctggatcgtggctggtcctctgtgagggcgaggggtgtgcccaggactcagctctgcgggagctggtggatgcacactcaggcctgtttctcagccaggggaaaacaattggttcagaggctggatccctggggacaccaggagcaggtgcgggcagctctgagcttcccaccactccctggctgagcctctctaaactgggcctatagacccatgggggctgggagccttcctgcaggaggcagaggctgaatagatgaggagatggagttctacatgcggaccttcagacatatgcgcccagagccccctggccaggccgggccagcagcagtgaatgccaatccctcccagtttcttgccacccgtggccaagcggaacctccaccaccctcttccccagacactctcgccctgcctccccggatccgaccccagaaaaagaggaagaggcgcgtgtataaagtgcgaacgtctgagacctcggatccggcgtcgggtgagcgcctctccctgtccgggtcctgctctgggaactcgagggaggggaaggcagagccacaagcgagccgcagccactgggctcatgttcccttcccttgcgcagggcctagggcccccagccgccgctccagctcgtcgacggattccgcggacgccagccctgtgcacgccgctggccctgccggcgcctaccactcggcgtcggcagagtccgtggacgagattccagtggcgcagacgcgcctgggcagcgccgctctggccgccccgcggggccggggccgacagcccacgctggcgcggcaggcgcgtgcgcccgccgttttcgtgagcccgagcagcggcgagcccagggcgccgggcggccgggaggctggtctggcttagctgggccgagaggccggagggccgagttagagcggccggcctgactctctatgcaacaccccatccttgccgcaccgagtgcactttaggggcccctacggccggcgggatcggcctccctcccccacgactcagcaatacccgccccaccggctgtgatgctccaataaacttttttatgcttttgcgga

SEQ ID NO: 21381 - DNA, 915 bp, Homo sapiens
ttgtaatacttacacatgtgcatggataaattgcagttatgacgtgtaattcatatcttgctgtttttcacttaacatggtattacaggattttttccattttgctccatgatcttattatttttaataattgcataatagttcattgagcggatgtgccctgcttttctaaaccgttcccatattattagacattagattgtttctatagtttctactattagaagtaaccttgcaacggttggcttcctttgcggagcctttcccttcttttgaattatttccttataatacatttccagaagtgaaattatagggcgaagtagggtctaaacttctggatggctcttgacattgcagctaactgccttctgtaaggtgggtgtaccagaatttagctccgccagccatgagtgaggggactggtgttaccatgtaagtaacatcagcctttctttgcagtatttcatgtttaaatattattatatgtacacataaaataaggctaccaagcattgggcacaaatacttgccccattttttttctgacaggctcagctattgcttttaattgcaaatgagcagatttatttctaggagtgcatcactcatggaatttgaggtctgtctgccctttgatagcaggactcttggcctgccaaatagcttaacattttgtctgaaaaaaagacaggttattttcgccaattgcttttgggattgttattcaggtgtaagaataacattcagggtgttaacgtttctttaatgtgggttgttgaaaaagagtcagtgagtcaccaggtgtggtagctcgtgcctgtgatcccagcactttgggaggctgaggcaggtggatcccttgagctcaggagtttgagaacagcctaggcaacatggtgaaaccccatcttt

SEQ ID NO: 21382 - DNA, 253 bp, Homo sapiens
gattacgggagctacaattcaagatgagatttgggtggggacacaaccaaaccatatcagcctgattataggtatgtttgaaaatctaaaaattaaaatttgaagcgtgcttaatggtatggataagaattggaggatcctagcaagaaacagtgccccttggcttcagaaacaagctgcagaattgggaaaaggcctgtggctgtttgtaagccatcaccgagcttgttgtacagacttacatgcagataca

SEQ ID NO: 21383 - DNA, 454 bp, Homo sapiens
ccaatggaaggctctctcacgaggtaattaagtaggagaggagagagaaactattctgcatctggctttggcagtggaagcaccccgtgactgcaggtaattacgggctccagcagcatcagtggagttctaggagccccagcagcactgtcagcagcaagtgcatgctcacagactctaggccaggggtgtccaatcttttggcttccctgagccacattggaaaaagaaaaagtgtcttgggccacacataaaacacacattaataatagctaacgagctaaaaaaaaatcacaaaaatttcataatgttttaagaaagtttacgaatttgtcttgggctgtattcaaagccatcctgggacatatgtggcccatgggccgtgggttggaccagcttgctctagggatattaattttccacatttttgctcctccatccttagagagctgtg

SEQ ID NO: 21384 - DNA, 337 bp, Homo sapiens
tatttgaaagaaatagagtcatatagaacaacaaatagaggtgctgaagcacaaggtcagatgagtttatatttaaagaaaggtcaggaagttagtcttttccttctaaaatcacaaggtacatacctcgtgactggaatccttttcctaatgaaatattaacatccattagatgttgggtttgcattaaaaatgtctccacatttgtatttttagcatggacacagtggtatcagttaaaataattagcccttgcctgtaatataaaagccttatctctttactcttacttttttagaaggcagatgttttaaaactgatttgaaaatcaaatttg

SEQ ID NO: 21385 - DNA, 344 bp, Homo sapiens
ccaccacgcccggctaatttttgtatttttgctagcgatggggtttcgccatgttggacaggctggtcttgaactgctgacctcaaataatccgcctgcctcagcctcccaaagtgctaggattacaggcatgagccaccgtgcccagcctcaaatgccttttgaatgaatgaatgaacaaaccctcacaacagtactataagaactagatattatttgagtctgtttgtggataaggctcagaaagattaaataattttttccaacttgtagaggtagtgattcagagactcagatcttctgacaccagaaactaacttctatatacaggggctaatggcaga

SEQ ID NO: 21386 - DNA, 115 bp, Homo sapiens
gagaactgccatcatgaccgagggccaccatgatgggtgaaggtggccatgatgggtgaaggcagccatgatgggtgaaggccaccatgatgggtgaaggccaccatgatcagac

SEQ ID NO: 21387 - DNA, 272 bp, Homo sapiens
tttgggaagctgaggcgggaggattgcttgaggccaggaattttagatcaggctgggcaacatagcgataccctgtctctacaaaaaaacaaaacaaaaaaaccccacaaaattagtcaggtgaagtggtgtatgcttgtagtctcagctacttaggaggctgagacaggaggatggcttgatcccaggaggtagaggctatagtgagctaagatggcgccactgtattccagcctgcatgacagtgagagacactcagaaaaaagtctcag

SEQ ID NO: 21388 - DNA, 393 bp, Homo sapiens
ggagagcgccagcctctgggaggcccaggccccaggccctggctgctgcccccggtgtactgccttccaagtgtgtttgaggtcgggtggtagcggggggtccctcctcagaacctgtgttgttctgccggagacaaagttcaggctctggctggcccacgaggcagctgcattctgtcctctgccatgggacactcaccctgagagggccagggctgtggtgtggggcagactggatggccgggaggagacgggaaaaggacagcacccctgttttgccctcctccccccggacagcctgcctggagttctctggcagcagctggagacaccaagagggttccatggagcaggctgtgtttgtgcaggcctgtgtttgcctgtttaccatcg

SEQ ID NO: 21389 - DNA, 427 bp, Homo sapiens
tttttgagacaggatcttgctctgtaacccaggctggagtgtagtagccccatcacagatcactgcagccttgacctcccaggctcaagctattctgccccacctcagcctcccaagtagctgtgatgacaggcacatgccaccatgcccagctaatttttgtattttttgtagaggtggagttttgccatgttgccagcgctggtcttgaactcctgggttcaagtggtccattcatctaggcctcccaaagtgctgggattacagatgtgagccacagagcccagcctcaatagctttttacagtgagtggggttgagcaggggtgatattctccatagtgaaattttatgtagccattgtttgagggactttgggaaaccctgggttcaaagggcacagggacattctctcttctaagcagatg

SEQ ID NO: 21390 - DNA, 982 bp, Homo sapiens
  misc_feature (617)..(617): n is a, c, g, or t
  misc_feature (655)..(655): n is a, c, g, or t
  misc_feature (689)..(689): n is a, c, g, or t
  misc_feature (978)..(978): n is a, c, g, or t
ttaagaatgattctactatgaaacagacataaaggaacattcttaaaagcctgtaatttctaaataaaagtcagtgaacctctttctttttttctttttttaatttatttatatatatatatatatttttattatactttaagttctagggtactctgccgttaagaccctatatctatagacaaaacaaatcctaactggcagcgtataaagtactctttaattcacacaatgtgttatatttctggaaaagatagtctcaggagcagtttaatctgacacgtgtacccataaaaatggaattaaactcagccaggtgcggtgactcacggcctgtaatcccagcactttgggaggccaaggcgggccaatcacgaggtcaggagattgagaccatcctggccaacatagtgaaaccccgtctctactaaaaatacaaaaattagctcggcgtggtggcgcatgcctgtaatcccagctacacaggaggctcaaacaggagaatcgcttgaacttgggaggcggatgttgcagtgagccaagatcgtgccactgacttcagctggcagtagagcgagactctgttgctacagggatgactcaactttcaagtctgnaaggactgatgccagctttatagatgatacaacctatntactataatatatgcttattaatatatactgatntagaaggtagaggatgttatatagatttactgatatgtagctagtacttttattaatcaaactagtatactagtagcgctgagttatgacgtttttcggataacttgctcttaagtgcatttaggtgcaattacattagacgtgaagagtaactaggtaactaactagtatagtgctgatcttagccgcatgtgacgaaggatagtgtcttcgggattacaggcgtcatgcagtgtggtactggggttttttacacacttcccttgggggttttttttcctcctttccncctt

SEQ ID NO: 21391 - DNA, 642 bp, Homo sapiens
ttaagaatgattctactatgaaacagacataaaggaacattcttaaaagcctgtaatttctaaataaaagtcagtgaacctctttctttttttctttttttaatttatttatatatatatatatatttttattatactttaagttctagggtactctgccgttaagaccctatatctatagacaaaacaaatcctaactggcagcgtataaagtactctttaattcacacaatgtgttatatttctggaaaagatagtctcaggagcagtttaatctgacacgtgtacccataaaaatggaattaaactcagccaggtgcggtgactcacggcctgtaatcccagcactttgggaggccaaggcgggccaatcacgaggtcaggagattgagaccatcctggccaacatagtgaaaccccgtctctactaaaaatacaaaaattagctcggcgtggtggcgcatgcctgtaatcccagctacacaggaggctcaaacaggagaatcgcttgaacttgggaggcggatgttgcagtgagccaagatcgtgccactgacttcagctggcagtagagcgagactctgtccagaattgactcaacttttcaagttctgataatatgcttattatatattacctgtt

SEQ ID NO: 21392 - DNA, 380 bp, Homo sapiens
aatcaggcatcgtcgacaagaaaagaggcagccatgagccattatcagtcaacacttggaagtccttgagggagggatgcacttactggataaagggcatgtaggcagaatatcattgggtctattttaccacagtggctggtctctaggaacctccgtatgaattcctttaactttgaccacaaaaccgtaaatgttcttttcattaaaatctcttgaatcaatagagatgattctgttttctgtctggaaaagagctaaactagaacagtacagctggaattaaaaattaggagtggtgtggcagacagaggctaagatggccatctcctggtattcatgccccgtagtcgacgcaccctcaccttgagtatgggtga

SEQ ID NO: 21393 - DNA, 178 bp, Homo sapiens
cacacagagcccccagagggtatgaattggatctgaaaaggggagaggcagagggagattcttatccagggagcgtagggaacacgctttgtgcttagggcagaggctgtgtgggatgaaacagagtttgatttatgtaatccaaccttgtcagacaccacagccagctctttagaga

SEQ ID NO: 21394 - DNA, 448 bp, Homo sapiens
tatagagtattaggataatcttgtcatttcagcttgtattctattcagaaaacaacttgagttattgaagttatgcttatttgtttgtttttaagcagaatcctgatattattagagttgctctttaggaggaataatctgatccctttaattaaatccattaatatttgtgttgtggatgctatccagatactgtatggagagcttgaggtttgaaatacaagtaataattgaagccatagatgaagacgaaattttcaactgggagagtgaaagtagggaaaatgtatcttgccttcaaacatcttaatttccttctgagaattagagcatcttagtctggaaaaggctttatagacagcttgattttgttctcacattttacaggtgaagaaactgagaaccagacagtccaacttatttgtcctaccaaactaggtatatgatc

SEQ ID NO: 21395 - DNA, 441 bp, Homo sapiens
agtcatgtccttacatggatggtggcaggcaaagaaagagagcttgtgcagaaaaactccccatttttaagacccatcagatcttgtgagattcattcactatcacaagaactgcatgggaaagacccgcccccgtgattcaatcatttccccaccaggacccctccccacaacacccagaggattatgaaagctacaagatgagatttgggtggggacacagaatcaaaccatatcaatagtcaagttcacataaccacacgtagtcgtttcctaacgtaaaagagaaaaaagagtggtgtcatgaaaacaatgactggttccacttgtagttcatgcagttcaaataactacacaagcttttcctcatgacagccatgatacttcagtttgtagcagatatgctttatgcaaacttcccagtttgtcagataatattaa

SEQ ID NO: 21396 - DNA, 496 bp, Homo sapiens
gagacagggtctcactctgccacccaggctggagtgcaggggcatgatcagggctcactgaagcctctgcctcctgggctcaagcgatcctcccatcccagcctcccgagtagcccggctaatttttgtagttttagagactggtctcaaactcctggactcaagtatctgcccacatactggcctcccaaagtgctgggattacaggtgtgagccaccgggcctggctgtattcatgagcattttacaattattatgtcaagttctggtttataaaactcttaatgccccattaattatcattgcattaaatctatgaattaatatggaaagtgttattatgtcatttatgtaatctttccagttacaagcaaagatggctatgcatccagtctgattacctttattgtgtcattatggttttagagttttctttttagttcttgttaggttgacattaaagtatttaatggggatttagaatttcatttggaga

SEQ ID NO: 21397 - DNA, 246 bp, Homo sapiens
acttgctaaagatcaaccaacttgttcatttttcaattgtttagggccttgctggaatttaacacaaggcagagaataagatttgagtaaaagagagagttatataaaattgatgcttttctctcttttttttaatcattgaaaagtgaatggagagaccatattgttctacatctgtatgtaagagctctgatgtatctagaatttgtaagctgtccagcaaaaatgaaaaagggtctgtcgacg

SEQ ID NO: 21398 - DNA, 483 bp, Homo sapiens
atgagctaactgacttagctactagaggtgttttcagatacactgacaatcctttgggctccacgaagaagtctgctgaagagtgctatcattttccttctacccatacaggaaaaccctggcttgtgaggtagaggagcaggatggaaagagcatgggctctggccagcaaaagacccaagtctgactactcattcagtccctcattatctatgtgggcttgggctagttaccgaacttctccaaatctctgtttctcatttctagaatgggaacaaatctacctccttccacgtcaacaaacactttttagtttattttgtgtcttccggcatctggaatggaataagaatttaatgaaagtttgaatttacaatatgtcaggcattgaactagaagctttacttacatgatgtcatttaattcttacaaaaagcccttgaggtagatgttggtcaaacgaataaatgaatgaatcaatct

SEQ ID NO: 21399 - DNA, 448 bp, Homo sapiens
tgccccacacacattggctaaatgcgtgggaggtggtagggttggttccaggtcctctaattcaaaatctaatgccccaccccatgcttcagcatatcccagccctaattccatgtgcgggtggtgcccaaccaccctgctaccctcctcccaagtatcctacctacatccttccctggcattccacaaggtctcccaactcagcctcctcttggtcacagtggcataccatgtcggtggaggacagtcgtaagggacccagtggcagaggtctattaccattgggcatccaccctagtactttcaatcccgttccccatcatcagtgccatatgctccaccccattcactgggagcagccaccagcaaatatgggaacctaggggaacaagaggaatgtggcagggctgagggttctgggtctcaggcacttaattggaaaatgaac

SEQ ID NO: 21400 - DNA, 165 bp, Homo sapiens
gtcaccagcctggacaagtcatttgcttgtgcaaactgatcaggacagatgtcacttacaaaaatatttgacttggaactcatgtgcttgttggcccagacaccttcaaaactggggttttattaggaaatgctggttaaaagaactcatagaaagaaaacgtta

SEQ ID NO: 21401 - DNA, 304 bp, Homo sapiens
ctcatctgtaaaatggagataatatcaccatgcactcagccctagccactgcattgctgttactgataccattactgctgctacgtcgtttttttgatggctcagcccttagggaagggggatcaagggagaagcccggaccttcccgcaggaggtgggctgggcacagccctgaaccatggaggtcacccaccctgaggtcgggacctgggttcccttcctatccactgggggtcccagcctttgtcttcatctctccaggtcccagcccttcacagtgggcacttccctgcctgtgacggag

SEQ ID NO: 21402 - DNA, 3719 bp, Homo sapiens
cgggcgccggaagtggcgaaggcggggtcggcgctgccgggtgaaatcgtaggacagtgaagatgctgctggaattgtccgaggagcataaggaacacctggccttcctgcctcaagtggacagcgcggtggtcgccgagtttgggcggattgctgtggaattcctgagacgcggcgcaaacccaaaaatctacgaaggcgccgccagaaaactcaatgtgagtagtgacactgtccagcatggtgtggaaggattaacgtatctcctcactgagagctcaaagctcatgatttctgaactggatttccaagactctgtttttgttctgggattctctgaagaattaaacaaattgttgcttcagctttatctggacaacagaaaagagatcagaacgattctgagtgaattggcaccaagccttcccagttatcataaccttgaatggcgactagatgtacagcttgcaagtagaagtctcaggcaacagattaaaccagcagtgactataaagctacaccttaatcaaaatggagatcacaacaccaaagttctgcagacagacccagccaccctgctccatttggttcaacaactggaacaagcattggaagagatgaagacaaaccactgtaggagagttgttcgcaacatcaagtagtaccagttttaaggttttaattcatttgaatcacttatgaattgatgatatacagcaattacttttcaaaattaattttttattaattcatgatgataaatacatagtattcctcagtatctattccaagatactgaggtcataatcagaagctaagctgggtgcagtggctcatgccagttatcccagcactttgggaggccgaggtgggcaaatcatgaggtcaggagattgagaccttcctggctaacatggtgaaaccccatctctactaaaaatataaaaaattagccaggtgtggtggcacgcatctatcagagtcccagctactcaggaggctgaggcaggagaatcgcttgaacctgggaggtggaggttgcagtgagctgagattgtgccactgcactccagcctgggtgacagagtgagactccatctcaaaaataataataataataataaagtaaaaataaaaataaaaaagtaatcagaagctaaagtaaagttcctttcctggtgctaactgtggtcttcttgacacattaagatgtattttgtattttaagagtctcatgctctaccgttggaactagccagatggccattattttgtattttaaatacataaataggattgaatcaactagaaatgaatctatatgttctgtatatatgaatgactatcttgtttttgctacttcttttgactgcttaattttattattttcatctttattgatcaaatttgaaaataaaattcacaatgtaatactactactatgcagaattttctaaacagttcagtatttttgacttttaaaaacaccccacagtgttaatagccacagaatattgaacatcaataggatttttaatgctatattgttataggcagtttattcatttttctttgtatatgaagatgataagtatcatattgcctaagtttgagtgatcatggttaattaattggcttaaatagtactcaaatttgtgtggtcgtatattgtattttatcaaggactaattcttccaccatacccaaagcatctaggagacactctgtcatttacatttacaaataatggatgcagagaaatataatcaattcttgattgtcctggatacaaattatagtcactttttataatttgaataaactatgatgagggaaggaaggccatgtttattacattataggcaactatcccttctcaaaacataacttgatttatgttttgttttattttttagtagggaaccaaaagcttttggtctgaaaaactcaggtgctgatttgtcaggtcagcctgagagagtgcagagatactgaggtcagcttagggagaagaattgtatggaagggtggaaatgagggttcagtcttaactatgtgtccaagaccttatcctgagagtcttcatggaataatctagaaagggctgtagaagcaatcaaactctaaactgcgctctagactttgtcaatactttgcttcgtaagaattagggattttcatatcagagtgataccatgttgcaatctctttagagaagagagagcctagcagggaataggctagtggaagaaaaacatacttgagatggttacccattggtccctgcaggcatctgggccacccttttcctgtaggtatatattctgccgttgtgaaacaactatattattagatgtcagcaaactataatcagaaataatttttaattatagtggcaacttgattaatgaagctctcatatacaacctcacaaacaaaaagaaactttattacgtgaaatagtagcatatgtcattgggtttaaaagcaacatgcctgcaaaacatatgataaaaaatacctctgtaagggtttttatttgtccaccttcgatggaaggtaaacatggctgatcccagccaagatgaaacaatagccctttgtctcctcagaacaacctatctccaactctttgtccactgttcttaccccaattaaaacaagaaagcatgtgctaatccttttttaatttttatcaacctgccttggcctcctttcactgtactccattattccttctgtgatgttctaccttcttcaccttttgagaccagggtgagttgggagcagtttgcctaccttcttttagaatctggggcttatcttttagtacaagccattgaataagcctcttccttttttttgctcaaacattccacatccttgtggattcccctgcattgtttgttttatataacatttgatatttgttgtagcttgtatatgaacataattttctttagaggtagtcactgttctctccagtatgacccaggtttcttgactctgagtaatgcaccttctataactatctaaatttctattgaagctttttggattatgagtatgctgacttttcacgattggctggtgcatgtttagacttaaatgtcatatccttcatgtctcaaagccaaaatagtaacatctcatctcagaacagagctgtgaccacatgccaatatatgtgtcacaaagtctacatatgttacattccttggaagtctccttaaatgtttcacaaaatgtcaacaagcttgttttgttattgatatttccgagattgggcacatttaagacagtaaacgggaaaggtggtgaagatgctataagaagatgctgtatcttgagaattgaaaaatgagaatctgacatggtttgaaaaatcatgaagggtatatataaaggatgcatgtgtaggagccattaaaattcataacagtatgtgccccttcagcgttttaatcttatgaagtggttaagagataagtcttcggagttggacaaaaggatttgaatttaggttctgtggattattatgggtccttgataaattctcaaagcctttttttttgttcatctctaaaataggaatataggattacctaccacattgactcgtaaggactatatgagaccatgtatatagaatgtttaacatagtaccaggctttacaaagaactcaataaatgtttaccattattgaaaaaaaaaaaaa

SEQ ID NO: 21403 - DNA, 3759 bp, Homo sapiens
tgcatggtgaatatagaacagtggtttataaaagccaggctggtaccgcccggaatcccgggatatcccggcgctgccgggtgaaatcgtaggacagtgaagatgctgctggaattgtccgaggagcataaggaacacctggccttcctgcctcaagtggacagcgcggtggtcgccgagtttgggcggattgctgtggaattcctgagacgcggcgcaaacccaaaaatctacgaaggcgccgccagaaaactcaatgtgagtagtgacactgtccagcatggtgtggaaggattaacgtatctcctcactgagagctcaaagctcatgatttctgaactggatttccaagactctgtttttgttctgggattctctgaagaattaaacaaattgttgcttcagctttatctggacaacagaaaagagatcagaacgattctgagtgaattggcaccaagccttcccagttatcataaccttgaatggcgactagatgtacagcttgcaagtagaagtctcaggcaacagattaaaccagcagtgactataaagctacaccttaatcaaaatggagatcacaacaccaaagttctgcagacagacccagccaccctgctccatttggttcaacaactggaacaagcattggaagagatgaagacaaaccactgtaggagagttgttcgcaacatcaagtagtaccagttttaaggttttaattcatttgaatcacttatgaattgatgatatacagcaattacttttcaaaattaattttttattaattcatgatgataaatacatagtattcctcagtatctattccaagatactgaggtcataatcagaagctaagctgggtgcagtggctcatgccagttatcccagcactttgggaggccgaggtgggcaaatcatgaggtcaggagattgagaccttcctggctaacatggtgaaaccccatctctactaaaaatataaaaaattagccaggtgtggtggcacgcatctatcagagtcccagctactcaggaggctgaggcaggagaatcgcttgaacctgggaggtggaggttgcagtgagctgagattgtgccactgcactccagcctgggtgacagagtgagactccatctcaaaaataataataataataataaagtaaaaataaaaataaaaaagtaatcagaagctaaagtaaagttcctttcctggtgctaactgtggtcttcttgacacattaagatgtattttgtattttaagagtctcatgctctaccgttggaactagccagatggccattattttgtattttaaatacataaataggattgaatcaactagaaatgaatctatatgttctgtatatatgaatgactatcttgtttttgctacttcttttgactgcttaattttattattttcatctttattgatcaaatttgaaaataaaattcacaatgtaatactactactatgcagaattttctaaacagttcagtatttttgacttttaaaaacaccccacagtgttaatagccacagaatattgaacatcaataggatttttaatgctatattgttataggcagtttattcatttttctttgtatatgaagatgataagtatcatattgcctaagtttgagtgatcatggttaattaattggcttaaatagtactcaaatttgtgtggtcgtatattgtattttatcaaggactaattcttccaccatacccaaagcatctaggagacactctgtcatttacatttacaaataatggatgcagagaaatataatcaattcttgattgtcctggatacaaattatagtcactttttataatttgaataaactatgatgagggaaggaaggccatgtttattacattataggcaactatcccttctcaaaacataacttgatttatgttttgttttattttttagtagggaaccaaaagcttttggtctgaaaaactcaggtgctgatttgtcaggtcagcctgagagagtgcagagatactgaggtcagcttagggagaagaattgtatggaagggtggaaatgagggttcagtcttaactatgtgtccaagaccttatcctgagagtcttcatggaataatctagaaagggctgtagaagcaatcaaactctaaactgcgctctagactttgtcaatactttgcttcgtaagaattagggattttcatatcagagtgataccatgttgcaatctctttagagaagagagagcctagcagggaataggctagtggaagaaaaacatacttgagatggttacccattggtccctgcaggcatctgggccacccttttcctgtaggtatatattctgccgttgtgaaacaactatattattagatgtcagcaaactataatcagaaataatttttaattatagtggcaacttgattaatgaagctctcatatacaacctcacaaacaaaaagaaactttattacgtgaaatagtagcatatgtcattgggtttaaaagcaacatgcctgcaaaacatatgataaaaaatacctctgtaagggtttttatttgtccaccttcgatggaaggtaaacatggctgatcccagccaagatgaaacaatagccctttgtctcctcagaacaacctatctccaactctttgtccactgttcttaccccaattaaaacaagaaagcatgtgctaatccttttttaatttttatcaacctgccttggcctcctttcactgtactccattattccttctgtgatgttctaccttcttcaccttttgagaccagggtgagttgggagcagtttgcctaccttcttttagaatctggggcttatcttttagtacaagccattgaataagcctcttccttttttttgctcaaacattccacatccttgtggattcccctgcattgtttgttttatataacatttgatatttgttgtagcttgtatatgaacataattttctttagaggtagtcactgttctctccagtatgacccaggtttcttgactctgagtaatgcaccttctataactatctaaatttctattgaagctttttggattatgagtatgctgacttttcacgattggctggtgcatgtttagacttaaatgtcatatccttcatgtctcaaagccaaaatagtaacatctcatctcagaacagagctgtgaccacatgccaatatatgtgtcacaaagtctacatatgttacattccttggaagtctccttaaatgtttcacaaaatgtcaacaagcttgttttgttattgatatttccgagattgggcacatttaagacagtaaacgggaaaggtggtgaagatgctataagaagatgctgtatcttgagaattgaaaaatgagaatctgacatggtttgaaaaatcatgaagggtatatataaaggatgcatgtgtaggagccattaaaattcataacagtatgtgccccttcagcgttttaatcttatgaagtggttaagagataagtcttcggagttggacaaaaggatttgaatttaggttctgtggattattatgggtccttgataaattctcaaagcctttttttttgttcatctctaaaataggaatataggattacctaccacattgactcgtaaggactatatgagaccatgtatatagaatgtttaacatagtaccaggctttacaaagaactcaataaatgtttaccattattgaaaaaaaaaaaaa

SEQ ID NO: 21404 - DNA, 3849 bp, Homo sapiens
tgcatggtgaatatagaacagtggtttataaaagccaggctggtaccgcccggaatcccgggatatcccggcgctgccgggtgaaatcgtaggacagtgaagatgctgctggaattgtccgaggagcataaggaacacctggccttcctgcctcaagtggacagcgcgggtcagcgggcgtgggggcggtgttctgtgggctggggaggaggtcaaaggcagcgcctggcactcaacagccttctgactttcattgcagtggtcgccgagtttgggcggattgctgtggaattcctgagacgcggcgcaaacccaaaaatctacgaaggcgccgccagaaaactcaatgtgagtagtgacactgtccagcatggtgtggaaggattaacgtatctcctcactgagagctcaaagctcatgatttctgaactggatttccaagactctgtttttgttctgggattctctgaagaattaaacaaattgttgcttcagctttatctggacaacagaaaagagatcagaacgattctgagtgaattggcaccaagccttcccagttatcataaccttgaatggcgactagatgtacagcttgcaagtagaagtctcaggcaacagattaaaccagcagtgactataaagctacaccttaatcaaaatggagatcacaacaccaaagttctgcagacagacccagccaccctgctccatttggttcaacaactggaacaagcattggaagagatgaagacaaaccactgtaggagagttgttcgcaacatcaagtagtaccagttttaaggttttaattcatttgaatcacttatgaattgatgatatacagcaattacttttcaaaattaattttttattaattcatgatgataaatacatagtattcctcagtatctattccaagatactgaggtcataatcagaagctaagctgggtgcagtggctcatgccagttatcccagcactttgggaggccgaggtgggcaaatcatgaggtcaggagattgagaccttcctggctaacatggtgaaaccccatctctactaaaaatataaaaaattagccaggtgtggtggcacgcatctatcagagtcccagctactcaggaggctgaggcaggagaatcgcttgaacctgggaggtggaggttgcagtgagctgagattgtgccactgcactccagcctgggtgacagagtgagactccatctcaaaaataataataataataataaagtaaaaataaaaataaaaaagtaatcagaagctaaagtaaagttcctttcctggtgctaactgtggtcttcttgacacattaagatgtattttgtattttaagagtctcatgctctaccgttggaactagccagatggccattattttgtattttaaatacataaataggattgaatcaactagaaatgaatctatatgttctgtatatatgaatgactatcttgtttttgctacttcttttgactgcttaattttattattttcatctttattgatcaaatttgaaaataaaattcacaatgtaatactactactatgcagaattttctaaacagttcagtatttttgacttttaaaaacaccccacagtgttaatagccacagaatattgaacatcaataggatttttaatgctatattgttataggcagtttattcatttttctttgtatatgaagatgataagtatcatattgcctaagtttgagtgatcatggttaattaattggcttaaatagtactcaaatttgtgtggtcgtatattgtattttatcaaggactaattcttccaccatacccaaagcatctaggagacactctgtcatttacatttacaaataatggatgcagagaaatataatcaattcttgattgtcctggatacaaattatagtcactttttataatttgaataaactatgatgagggaaggaaggccatgtttattacattataggcaactatcccttctcaaaacataacttgatttatgttttgttttattttttagtagggaaccaaaagcttttggtctgaaaaactcaggtgctgatttgtcaggtcagcctgagagagtgcagagatactgaggtcagcttagggagaagaattgtatggaagggtggaaatgagggttcagtcttaactatgtgtccaagaccttatcctgagagtcttcatggaataatctagaaagggctgtagaagcaatcaaactctaaactgcgctctagactttgtcaatactttgcttcgtaagaattagggattttcatatcagagtgataccatgttgcaatctctttagagaagagagagcctagcagggaataggctagtggaagaaaaacatacttgagatggttacccattggtccctgcaggcatctgggccacccttttcctgtaggtatatattctgccgttgtgaaacaactatattattagatgtcagcaaactataatcagaaataatttttaattatagtggcaacttgattaatgaagctctcatatacaacctcacaaacaaaaagaaactttattacgtgaaatagtagcatatgtcattgggtttaaaagcaacatgcctgcaaaacatatgataaaaaatacctctgtaagggtttttatttgtccaccttcgatggaaggtaaacatggctgatcccagccaagatgaaacaatagccctttgtctcctcagaacaacctatctccaactctttgtccactgttcttaccccaattaaaacaagaaagcatgtgctaatccttttttaatttttatcaacctgccttggcctcctttcactgtactccattattccttctgtgatgttctaccttcttcaccttttgagaccagggtgagttgggagcagtttgcctaccttcttttagaatctggggcttatcttttagtacaagccattgaataagcctcttccttttttttgctcaaacattccacatccttgtggattcccctgcattgtttgttttatataacatttgatatttgttgtagcttgtatatgaacataattttctttagaggtagtcactgttctctccagtatgacccaggtttcttgactctgagtaatgcaccttctataactatctaaatttctattgaagctttttggattatgagtatgctgacttttcacgattggctggtgcatgtttagacttaaatgtcatatccttcatgtctcaaagccaaaatagtaacatctcatctcagaacagagctgtgaccacatgccaatatatgtgtcacaaagtctacatatgttacattccttggaagtctccttaaatgtttcacaaaatgtcaacaagcttgttttgttattgatatttccgagattgggcacatttaagacagtaaacgggaaaggtggtgaagatgctataagaagatgctgtatcttgagaattgaaaaatgagaatctgacatggtttgaaaaatcatgaagggtatatataaaggatgcatgtgtaggagccattaaaattcataacagtatgtgccccttcagcgttttaatcttatgaagtggttaagagataagtcttcggagttggacaaaaggatttgaatttaggttctgtggattattatgggtccttgataaattctcaaagcctttttttttgttcatctctaaaataggaatataggattacctaccacattgactcgtaaggactatatgagaccatgtatatagaatgtttaacatagtaccaggctttacaaagaactcaataaatgtttaccattattgaaaaaaaaaaaaa

SEQ ID NO: 21405 - DNA, 3397 bp, Homo sapiens
tcgactagatgtacagatgtagaaaagtgcacaggtcaatgtaccgctcaatgaattatcacatggtgcatttaactgtgactcacaccccagaagcatcctccttgcctcctaattactgccccttcactcctttctaaagcttgcaagtagaagtctcaggcaacagattaaaccagcagtgactataaagctacaccttaatcaaaatggagatcacaacaccaaagttctgcagacagacccagccaccctgctccatttggttcaacaactggaacaagcattggaagagatgaagacaaaccactgtaggagagttgttcgcaacatcaagtagtaccagttttaaggttttaattcatttgaatcacttatgaattgatgatatacagcaattacttttcaaaattaattttttattaattcatgatgataaatacatagtattcctcagtatctattccaagatactgaggtcataatcagaagctaagctgggtgcagtggctcatgccagttatcccagcactttgggaggccgaggtgggcaaatcatgaggtcaggagattgagaccttcctggctaacatggtgaaaccccatctctactaaaaatataaaaaattagccaggtgtggtggcacgcatctatcagagtcccagctactcaggaggctgaggcaggagaatcgcttgaacctgggaggtggaggttgcagtgagctgagattgtgccactgcactccagcctgggtgacagagtgagactccatctcaaaaataataataataataataaagtaaaaataaaaataaaaaagtaatcagaagctaaagtaaagttcctttcctggtgctaactgtggtcttcttgacacattaagatgtattttgtattttaagagtctcatgctctaccgttggaactagccagatggccattattttgtattttaaatacataaataggattgaatcaactagaaatgaatctatatgttctgtatatatgaatgactatcttgtttttgctacttcttttgactgcttaattttattattttcatctttattgatcaaatttgaaaataaaattcacaatgtaatactactactatgcagaattttctaaacagttcagtatttttgacttttaaaaacaccccacagtgttaatagccacagaatattgaacatcaataggatttttaatgctatattgttataggcagtttattcatttttctttgtatatgaagatgataagtatcatattgcctaagtttgagtgatcatggttaattaattggcttaaatagtactcaaatttgtgtggtcgtatattgtattttatcaaggactaattcttccaccatacccaaagcatctaggagacactctgtcatttacatttacaaataatggatgcagagaaatataatcaattcttgattgtcctggatacaaattatagtcactttttataatttgaataaactatgatgagggaaggaaggccatgtttattacattataggcaactatcccttctcaaaacataacttgatttatgttttgttttattttttagtagggaaccaaaagcttttggtctgaaaaactcaggtgctgatttgtcaggtcagcctgagagagtgcagagatactgaggtcagcttagggagaagaattgtatggaagggtggaaatgagggttcagtcttaactatgtgtccaagaccttatcctgagagtcttcatggaataatctagaaagggctgtagaagcaatcaaactctaaactgcgctctagactttgtcaatactttgcttcgtaagaattagggattttcatatcagagtgataccatgttgcaatctctttagagaagagagagcctagcagggaataggctagtggaagaaaaacatacttgagatggttacccattggtccctgcaggcatctgggccacccttttcctgtaggtatatattctgccgttgtgaaacaactatattattagatgtcagcaaactataatcagaaataatttttaattatagtggcaacttgattaatgaagctctcatatacaacctcacaaacaaaaagaaactttattacgtgaaatagtagcatatgtcattgggtttaaaagcaacatgcctgcaaaacatatgataaaaaatacctctgtaagggtttttatttgtccaccttcgatggaaggtaaacatggctgatcccagccaagatgaaacaatagccctttgtctcctcagaacaacctatctccaactctttgtccactgttcttaccccaattaaaacaagaaagcatgtgctaatccttttttaatttttatcaacctgccttggcctcctttcactgtactccattattccttctgtgatgttctaccttcttcaccttttgagaccagggtgagttgggagcagtttgcctaccttcttttagaatctggggcttatcttttagtacaagccattgaataagcctcttccttttttttgctcaaacattccacatccttgtggattcccctgcattgtttgttttatataacatttgatatttgttgtagcttgtatatgaacataattttctttagaggtagtcactgttctctccagtatgacccaggtttcttgactctgagtaatgcaccttctataactatctaaatttctattgaagctttttggattatgagtatgctgacttttcacgattggctggtgcatgtttagacttaaatgtcatatccttcatgtctcaaagccaaaatagtaacatctcatctcagaacagagctgtgaccacatgccaatatatgtgtcacaaagtctacatatgttacattccttggaagtctccttaaatgtttcacaaaatgtcaacaagcttgttttgttattgatatttccgagattgggcacatttaagacagtaaacgggaaaggtggtgaagatgctataagaagatgctgtatcttgagaattgaaaaatgagaatctgacatggtttgaaaaatcatgaagggtatatataaaggatgcatgtgtaggagccattaaaattcataacagtatgtgccccttcagcgttttaatcttatgaagtggttaagagataagtcttcggagttggacaaaaggatttgaatttaggttctgtggattattatgggtccttgataaattctcaaagcctttttttttgttcatctctaaaataggaatataggattacctaccacattgactcgtaaggactatatgagaccatgtatatagaatgtttaacatagtaccaggctttacaaagaactcaataaatgtttaccattattgaaaaaaaaaaaaa

SEQ ID NO: 21406 - DNA, 3034 bp, Homo sapiens
gggaatactatgtatctattcctcagtatcttggaatagatactgaggaatactatgtatgtatcatcatgaattaggacatagtattcctcagtatctattccaagatactgaggtcataatcagaagctaagctgggtgcagtggctcatgccagttatcccagcactttgggaggccgaggtgggcaaatcatgaggtcaggagattgagaccttcctggctaacatggtgaaaccccatctctactaaaaatataaaaaattagccaggtgtggtggcacgcatctatcagagtcccagctactcaggaggctgaggcaggagaatcgcttgaacctgggaggtggaggttgcagtgagctgagattgtgccactgcactccagcctgggtgacagagtgagactccatctcaaaaataataataataataataaagtaaaaataaaaataaaaaagtaatcagaagctaaagtaaagttcctttcctggtgctaactgtggtcttcttgacacattaagatgtattttgtattttaagagtctcatgctctaccgttggaactagccagatggccattattttgtattttaaatacataaataggattgaatcaactagaaatgaatctatatgttctgtatatatgaatgactatcttgtttttgctacttcttttgactgcttaattttattattttcatctttattgatcaaatttgaaaataaaattcacaatgtaatactactactatgcagaattttctaaacagttcagtatttttgacttttaaaaacaccccacagtgttaatagccacagaatattgaacatcaataggatttttaatgctatattgttataggcagtttattcatttttctttgtatatgaagatgataagtatcatattgcctaagtttgagtgatcatggttaattaattggcttaaatagtactcaaatttgtgtggtcgtatattgtattttatcaaggactaattcttccaccatacccaaagcatctaggagacactctgtcatttacatttacaaataatggatgcagagaaatataatcaattcttgattgtcctggatacaaattatagtcactttttataatttgaataaactatgatgagggaaggaaggccatgtttattacattataggcaactatcccttctcaaaacataacttgatttatgttttgttttattttttagtagggaaccaaaagcttttggtctgaaaaactcaggtgctgatttgtcaggtcagcctgagagagtgcagagatactgaggtcagcttagggagaagaattgtatggaagggtggaaatgagggttcagtcttaactatgtgtccaagaccttatcctgagagtcttcatggaataatctagaaagggctgtagaagcaatcaaactctaaactgcgctctagactttgtcaatactttgcttcgtaagaattagggattttcatatcagagtgataccatgttgcaatctctttagagaagagagagcctagcagggaataggctagtggaagaaaaacatacttgagatggttacccattggtccctgcaggcatctgggccacccttttcctgtaggtatatattctgccgttgtgaaacaactatattattagatgtcagcaaactataatcagaaataatttttaattatagtggcaacttgattaatgaagctctcatatacaacctcacaaacaaaaagaaactttattacgtgaaatagtagcatatgtcattgggtttaaaagcaacatgcctgcaaaacatatgataaaaaatacctctgtaagggtttttatttgtccaccttcgatggaaggtaaacatggctgatcccagccaagatgaaacaatagccctttgtctcctcagaacaacctatctccaactctttgtccactgttcttaccccaattaaaacaagaaagcatgtgctaatccttttttaatttttatcaacctgccttggcctcctttcactgtactccattattccttctgtgatgttctaccttcttcaccttttgagaccagggtgagttgggagcagtttgcctaccttcttttagaatctggggcttatcttttagtacaagccattgaataagcctcttccttttttttgctcaaacattccacatccttgtggattcccctgcattgtttgttttatataacatttgatatttgttgtagcttgtatatgaacataattttctttagaggtagtcactgttctctccagtatgacccaggtttcttgactctgagtaatgcaccttctataactatctaaatttctattgaagctttttggattatgagtatgctgacttttcacgattggctggtgcatgtttagacttaaatgtcatatccttcatgtctcaaagccaaaatagtaacatctcatctcagaacagagctgtgaccacatgccaatatatgtgtcacaaagtctacatatgttacattccttggaagtctccttaaatgtttcacaaaatgtcaacaagcttgttttgttattgatatttccgagattgggcacatttaagacagtaaacgggaaaggtggtgaagatgctataagaagatgctgtatcttgagaattgaaaaatgagaatctgacatggtttgaaaaatcatgaagggtatatataaaggatgcatgtgtaggagccattaaaattcataacagtatgtgccccttcagcgttttaatcttatgaagtggttaagagataagtcttcggagttggacaaaaggatttgaatttaggttctgtggattattatgggtccttgataaattctcaaagcctttttttttgttcatctctaaaataggaatataggattacctaccacattgactcgtaaggactatatgagaccatgtatatagaatgtttaacatagtaccaggctttacaaagaactcaataaatgtttaccattattgaaaaaaaaaaaaa

SEQ ID NO: 21407 - DNA, 960 bp, Homo sapiens
ggtcctgcgggtctcatactggagagagcagtttgcctaccttcttttagaatctggggcttatcttttagtacaagccattgaataagcctcttccttttttttgctcaaacattccacatccttgtggattcccctgcattgtttgttttatataacatttgatatttgttgtagcttgtatatgaacataattttctttagaggtagtcactgttctctccagtatgacccaggtttcttgactctgagtaatgcaccttctataactatctaaatttctattgaagctttttggattatgagtatgctgacttttcacgattggctggtgcatgtttagacttaaatgtcatatccttcatgtctcaaagccaaaatagtaacatctcatctcagaacagagctgtgaccacatgccaatatatgtgtcacaaagtctacatatgttacattccttggaagtctccttaaatgtttcacaaaatgtcaacaagcttgttttgttattgatatttccgagattgggcacatttaagacagtaaacgggaaaggtggtgaagatgctataagaagatgctgtatcttgagaattgaaaaatgagaatctgacatggtttgaaaaatcatgaagggtatatataaaggatgcatgtgtaggagccattaaaattcataacagtatgtgccccttcagcgttttaatcttatgaagtggttaagagataagtcttcggagttggacaaaaggatttgaatttaggttctgtggattattatgggtccttgataaattctcaaagcctttttttttgttcatctctaaaataggaatataggattacctaccacattgactcgtaaggactatatgagaccatgtatatagaatgtttaacatagtaccaggctttacaaagaactcaataaatgtttaccattattgaaaaaaaaaaaaa

SEQ ID NO: 21408 - DNA, 316 bp, Homo sapiens
ataataataataattagccaggtgtggttgtgggcacctgtaatcccagctactcgggagactgaagcaggagaatagcttgaactcaggaggcggaggttgctgtgagctgagattgtgccattgcattccagcctgaacaacaagaatgaaactccatctcaaataaataaataaatagaagtatgtattgtgttgcttagaaggtgtggtggaaattaacttgctgagtgagatcaaaggattggcactgaattgaaataaagaaatattcatgctgagtctggttcaaatataactgcacctgtaagaattg

SEQ ID NO: 21409 - DNA, 334 bp, Homo sapiens
ttgtgtgggaggtgccagcaaaagcttgcaaactctctcaggtttctttgtgtggtcttccctccttcctcctccacaccctgtggtgccaggccccagcgggaagagatgagggaggagcgggctgcctcgcccctttctcccgcctgggaggagccagctggcgtctccgggggcccgggaccgctgcccgcctgcaccaccaggggtcagcagagtgtcgtggctgcagccagtgcaggggagggggctggcgcggttgaggggcatctaggagtggccgggagcatgcctgtgcatttccttattaaattgtttttcgaacttaaagtga

SEQ ID NO: 21410 - DNA, 289 bp, Homo sapiens
tcggtccactccccttcaaaatgagaatctagatactacctcctggggccccagcgggaagagatgagggaggagcgggctgcctcgcccctttctcccgcctgggaggagccagctggcgtctccgggggcccgggaccgctgcccgcctgcaccaccaggggtcagcagagtgtcgtggctgcagccagtgcaggggagggggctggcgcggttgaggggcatctaggagtggccgggagcatgcctgtgcatttccttattaaattgtttttcgaacttaaagtga

SEQ ID NO: 21411 - DNA, 256 bp, Homo sapiens
aacaaggaaaaataaaggcatagctgatcaaataaataagggattgggcagaagttgagagaaggaagggtcacagatttcctcctcttacgtagtgggagtcaggagataccatcgaaaattgacatatcaataaatagaggcatggccaggcacggtggctcatgcctgtaatcccagcactttgggaggccaaggcgggaggattgcttgaggccaggagtttaagactagcctggtaaatatagtgagaccc

SEQ ID NO: 21412 - DNA, 544 bp, Homo sapiens
ttgctttaatagtctagattttaatctgaggcctcaaattctctgatttgtcttatttcctcctaagataatgccatgggtgctttaggggtgcagtgtgtgagagtatgaattttgaagtcatatagacaaaccatagttcaaagcgaagttttgttaatatcttgatgatgttggaaaagtgtgacatgggaatgattaatattaatagcacttcccacataggattgttacagggattcagtgagatgatatttgtgaaaacattaacataggccgggcgcagtggctcacgcctgtaatcccagcactttgggaggccgaggtgggcggatcgcgaggtcaggagatcgagaccatcctggctaacacggtgaaatcccgtctctactaaaaatacaaaaaaaaattagccaggcgtagcggtgggcgcctgtagtcccagctgctggggaggctaaggcagcagaatggcatgaacccgggaggcggagcttgcagtgagccgagattgcgcccactgcactccagcctgggtgacata

SEQ ID NO: 21413 - DNA, 344 bp, Homo sapiens
atagaagtttgaaaagagaccacgtgtgcccagagcatggacaataaagcgagagcacatccgtactaaaaagaagacgattgataggcaggcaggcaggcaggcaggcaggcaggcaggcaggcaaatgtagaaggagccaggcgcagcgtctcacgcctgtaatagcagcagtgtgggcggccgaggcaggcaggcggattgcttgaggacaggagttcgagaccagcgtgggcaacatgatagaaccccgaaacccatctcactcacatacatacatacatacgtacatacatagatacacacacacacacacacacacacacacacacacacacacacac

SEQ ID NO: 21414 - DNA, 259 bp, Homo sapiens
tatttttagtagagatggttttcactctgttggccaggttcgtctcaaactcctgacctcaagtgatccacctgcctcagcctcccaaagtgctggaattacaagcatgagccactgtgcctggccttgtcttctcttaatgtcttttactctgccccatttataatataattttcttaaatatttcctccacatatacagtgttataatttttgcttcagtaattaagcataattacaaactcaagaggataagtaag

SEQ ID NO: 21415 - DNA, 435 bp, Homo sapiens
atgattttttccgtaaatattataagcatttttctacaacatacctagctttttgtgtatgtaatatgaaagtcattgaaatgagatatagacattttatggcttttgaaatctatcaccaaatttagaaaaaataaaataaaaaaatgaaatctattaccaaattgtttgacagaaatttttaaaagtatattattaagctacaatcaactgtaaagtttgctttgttccagataaagcattttatctcatccagtagagaaaccacttatttatttttttggtatgaaatattgtattgggtactttggtgtttagaagattaactgaaatgtcagaaaaatagacagactcttagaaaagtcagattgaagtgagccgacatcacgccaccgcactccagtctgggtgacagagtgagactccatctcaaaa

SEQ ID NO: 21416 - DNA, 4630 bp, Homo sapiens
  misc_feature (928)..(928): n is a, c, g, or t
tgcaaggcctgcagagttagcaccagctccactagggccatagatgccccctcctttgtgcctagctcctgcgaatccaccgagtgcctgagaccatagcttctactgtgcccacccaggcagggaccctcggccccctctcctccatttctgagcccccatggccagatcctgggcagggaaatgatcctttcaggagacaaccagagcccctcaccaggaacgggggcacccgtggactacgggagggtggcggttgggttctctgctccctcccagctcctgaacctggaacaatcggcagaaaacccaggaaccccggcactcctgcattcagcacgggattcccccacccatgcccagaagccctgaccttgctgtttctggaaaaagcatggggtggggcagggagggctggcatttcccccagaagaccttgccctttgacctgcccactctccacactgcctcacctggaaagccatgtcctgctggcctcattccttcctgaagggcctaggagtggggaggcctgggtagggctgccacaggctgggtagagccgccctggcaggaagcagggggtaaggtggccataccagcacatgctgcactaggagcagagccctgcacctgcctagctgccttcctgggagaaacctccctgggagaccatggccccaagccctggcctctagtgatacgcccctcgggaatctcctgttccggggcctgattctcaggaacaccaggtttcagaccatcttcagcacctaatgttgatgggtgtcaaacatctcctggagtggaccaactcgcacccctgcaaagtcggagctgctgagaaggggcagctctgaatagaggggcatctgcctgaacctcacttttcctggggccctctccttgaccccgtagccaccaccanactgcttccagggggtccagctctgcttcccttcccacctgtcctagagtggacagagctttttccttgggttctctcttgcatcactaagttcagcagggaatttgcggaattttcaggaagaactttccccagtaataagggagaacagaaagaaaatcctagaaaatacagagtatccatgctggcagctttttgtacaacacccatagggacccccccaaatagctattacaaaggggcagcccattcactacacaagaaccccacacctggcttccaccctccccagctcctgcacttctccccagagcgggaccctcttacttccccccatgaaggggggcaccttgtgctaaggccaaggctgagcgaggtcccagctcacctccctgcttgatccagattgcactgtgatgagcacattgctgacctaggccagtcctggggcaggcgtgctctctctcccatacataggagtggcctcaaggccacccagtgctgaccccaacagagccctgaactgtccagaaactgcatcctcagcacaggaagtacccacatggacagagggaagcccagcctcggggccggttgcctcctcttctctgggtgttctccagtggcttcttggagcctaggctggtttatctcccctgcctaaaaggccctggggttgccaatgcaaattcattaaaacgaagaccagatatcccagactgcacagaggccgagagaaatggtatagtgcgtgattagcattgctgccctccaacctcctgggattcatgcagataatcaaaaactgactatgactcccaagttctctgaaggatgagatcacaactgacaactcttacgacagagggagagtggtgagagagagaaagagggtactgggctagagccatgttcttcctgccgaggtgccagggggaggcggcagtgggcagggggtgctggggccttacctgtctgccctggtggggatgaaagacaggtgacaggcaggtgccctgtgcacagccttatcattgaaggcaggcccaggacagcctgccccatctgccccagccccatgggatggtttggtccagcctgactggggcaggattagctgcaattcctgccctgtgtgtcgtccagccagactgcctcttgaaagatggcttgtccaagcggcagacagtggtagaacaacccagggcttggaaatctgacctccttgtccatgccaacagcctgggagatgagacagggttagaggaaacagaggcccaggatacggcaggttctgcctgggagtgtacaatggttggagtccagagccaacgatgtggtccccagcggggtgtgcccctcctgctgacgagggtacagatccatacccaggtcaattcctcccgggcccctgtttggaggctgctacagccttgagttccttggagagagaggacacgcctgtggaatgtcaccttcagtcccgtgcaggcaaaaggcccctgcacaccagggccctaggaaagcagcatcaggtgctgggatcccacccagctggcacgggcacgttcttgccctgcacactccatgctgcccttccctaagctcgcaggggcagacaccaagagaagggcgcgtcccctagtcccctgggtgacctgtgtcaggacagcaggcaagaatgaaacgtggccttggctgacgggttggaatatttgtgaccgttcttgtctttctccctcctgcttccccggcaccctagccccatctccaggagcccctcaggcagagtaagtggggagtgtgtccagggatttttttgtgtttaccaaggtcctgctgtgcacttagaatctgtcaccataaatacttatctcgcagttaccccagcaagagggtgttatttcccccattttataaaaggaaattaaggctgggcaaagttaaagacttgcttgtcagtggtcatggctgttgtcttgccacccccagctggggagaaggaagaaaactgggccgggaacccctcccctcagtgtcccccagttctccatctccataaggagccatcaggctgtcattaaggaacagagtgtcactcagggggcactgtcacaaagcagcacccatggcacatgggccgggggtgcagaagcctggcttatttcaggctgacagctggaccctctgggtgcaggggctcaggcagtggccaagagcccaaagggctaaggcccgtgacgaccacccagcccgtcaccccaggtacaaacactgaccccaaagcaagagcagggactgtccctcagccctcagggccttcatgcagggtgcagaatctcatgtccacatggaggtcacccctcaggtcacacccactcccagagcaaccctgggcagggaggggcaccctggggttgtgttgaccacctccccttcaggtgaggcccttttctgccttctttctagccccctgcatggggcacctgctattgctggggctctggggtggaccctgtgtgatttctgtcagggagcttgtgctgtgcatggccagaggtgtttacatccagaagggcccagcacggccctgtggggtgtggggggaatatggtagatcattgtgatgtgcctcggggccctcttgccttggagccagctttgtttcagaatctgctacttgggccctcttcagggtttgaggctggagaagtgagttgggacagtcactgtcatcaccacccaccctgtcacccacctggaaaacattcttgatatactggccatgctgggccgggctcacatccactgagggtatagtgaccaagcgtctaaaccagtcgttctcaaacttcggtgagtatcagaatcacctggaagggcttttacaaacagattgctggccccaccccccagaatttctcatcaggagtgggcaagaccaatcatttgcatttctgacaagttcccaggagctgcagctgctggccctggaaccacactttgagaaccactgctttagaccaaacaccaaaggaagatgcagccaccctcctttacatgtcacaacgctcagggtccatgagtacctcaggctgtccagctgagctccacctgcagcagccgagattcccgactcgctccaccattgggggctaggagtgaagcgtgtcaccatggtcagctcatggccagccaggaaagcctctctgctgtgcgtctgtgcagttcttgttcttccctggaggactcttggatcgcctgtgatcttggccaggagaccaggtgcctgggtcccttcctggaaggggacaagttacacaccccagccccattttcccaccaacttctacatgccttgggagaacctgctacatgttggctgcccccttcccctatttcagcagtgcccagtcctgcttataaacctgaggcctgctccccataccctgccctgtgcaagtgccagccgttattccaggcagcccaatgttgttgaggccagatggattcctggaagcagctggcccatggatgtgagtcatcacagtattctagaaacagagaagaggtcttaacctaatgcgcatagagaaattgttctcattgtaaacatacccctgtccttagctgatctaggtggaagcccagcttcatgtgctagggggcatgataatgataataaaggaattgtatctagga

SEQ ID NO: 21417 - DNA, 886 bp, Homo sapiens
tgcaaggcctgcagagttagcaccagctccactagggccatagatgccccctcctttgtgcctagctcctgcgaatccaccgagtgcctgagaccatagcttctactgtgcccacccaggcagggaccctcggccccctctcctccatttctgagcccccatggccagatcctgggcagggaaatgatcctttcaggagacaaccagagcccctcaccaggaacgggggcacccgtggactacgggagggtggcggttgggttctctgctccctcccagctcctgaacctggaacaatcggcagaaaacccaggaaccccggcactcctgcattcagcacgggattcccccacccatgcccagaagccctgaccttgctgtttctggaaaaagcatggggtggggcagggagggctggcatttcccccagaagaccttgccctttgacctgcccactctccacactgcctcacctggaaagccatgtcctgctggcctcattccttcctgaagggcctaggagtggggaggcctgggtagggctgccacaggctgggtagagccgccctggcaggaagcagggggtaaggtggccataccagcacatgctgcactaggagcagagccctgcacctgcctagctgccttcctgggagaaacctccctgggagaccatggccccaagccctggcctctagtgatacgcccctcgggaatctcctgttccggggcctgattctcaggaacaccaggtttcagaccatcttcagcacctaatgttgatgggtgtcaaacatctcctggagtggaccaactcgcacccctgcaaagtcggagctgctgagaaggggcagctctgaatagaggggcatctgcctgaacctca

SEQ ID NO: 21418 - DNA, 4607 bp, Homo sapiens
  misc_feature (928)..(928): n is a, c, g, or t
tgcaaggcctgcagagttagcaccagctccactagggccatagatgccccctcctttgtgcctagctcctgcgaatccaccgagtgcctgagaccatagcttctactgtgcccacccaggcagggaccctcggccccctctcctccatttctgagcccccatggccagatcctgggcagggaaatgatcctttcaggagacaaccagagcccctcaccaggaacgggggcacccgtggactacgggagggtggcggttgggttctctgctccctcccagctcctgaacctggaacaatcggcagaaaacccaggaaccccggcactcctgcattcagcacgggattcccccacccatgcccagaagccctgaccttgctgtttctggaaaaagcatggggtggggcagggagggctggcatttcccccagaagaccttgccctttgacctgcccactctccacactgcctcacctggaaagccatgtcctgctggcctcattccttcctgaagggcctaggagtggggaggcctgggtagggctgccacaggctgggtagagccgccctggcaggaagcagggggtaaggtggccataccagcacatgctgcactaggagcagagccctgcacctgcctagctgccttcctgggagaaacctccctgggagaccatggccccaagccctggcctctagtgatacgcccctcgggaatctcctgttccggggcctgattctcaggaacaccaggtttcagaccatcttcagcacctaatgttgatgggtgtcaaacatctcctggagtggaccaactcgcacccctgcaaagtcggagctgctgagaaggggcagctctgaatagaggggcatctgcctgaacctcacttttcctggggccctctccttgaccccgtagccaccaccanactgcttccagggggtccagctctgcttcccttcccacctgtcctagagtggacagagctttttccttgggttctctcttgcatcactaagttcagcagggaatttgcggaattttcaggaagaactttccccagtaataagggagaacagaaagaaaatcctagaaaatacagagtatccatgctggcagctttttgtacaacacccatagggacccccccaaatagctattacaaaggggcagcccattcactacacaagaaccccacacctggcttccaccctccccagctcctgcacttctccccagagcgggaccctcttacttccccccatgaaggggggcaccttgtgctaaggccaaggctgagcgaggtcccagctcacctccctgcttgatccagattgcactgtgatgagcacattgctgacctaggccagtcctggggcaggcgtgctctctctcccatacataggagtggcctcaaggccacccagtgctgaccccaacagagccctgaactgtccagaaactgcatcctcagcacaggaagtacccacatggacagagggaagcccagcctcggggccggttgcctcctcttctctgggtgttctccagtggcttcttggagcctaggctggtttatctcccctgcctaaaaggccctggggttgccaatgcaaattcattaaaacgaagaccagatatcccagactgcacagaggccgagagaaatggtatagtgcgtgattagcattgctgccctccaacctcctgggattcatgcagataatcaaaaactgactatgactcccaagttctctgaaggatgagatcacaactgacaactcttacgacagagggagagtggtgagagagagaaagagggtactgggctagagccatgttcttcctgccgaggtgccagggggaggcggcagtgggcagggggtgctggggccttacctgtctgccctggtggggatgaaagacaggtgacaggcaggtgccctgtgcacagccttatcattgaaggcaggcccaggacagcctgccccatctgccccagccccatgggatggtttggtccagcctgactggggcaggattagctgcaattcctgccctgtgtgtcgtccagccagactgcctcttgaaagatggcttgtccaagcggcagacagtggtagaacaacccagggcttggaaatctgacctccttgtccatgccaacagcctgggagatgagacagggttagaggaaacagaggcccaggatacggcaggttctgcctgggagtgtacaatgtggtccccagcggggtgtgcccctcctgctgacgagggtacagatccatacccaggtcaattcctcccgggcccctgtttggaggctgctacagccttgagttccttggagagagaggacacgcctgtggaatgtcaccttcagtcccgtgcaggcaaaaggcccctgcacaccagggccctaggaaagcagcatcaggtgctgggatcccacccagctggcacgggcacgttcttgccctgcacactccatgctgcccttccctaagctcgcaggggcagacaccaagagaagggcgcgtcccctagtcccctgggtgacctgtgtcaggacagcaggcaagaatgaaacgtggccttggctgacgggttggaatatttgtgaccgttcttgtctttctccctcctgcttccccggcaccctagccccatctccaggagcccctcaggcagagtaagtggggagtgtgtccagggatttttttgtgtttaccaaggtcctgctgtgcacttagaatctgtcaccataaatacttatctcgcagttaccccagcaagagggtgttatttcccccattttataaaaggaaattaaggctgggcaaagttaaagacttgcttgtcagtggtcatggctgttgtcttgccacccccagctggggagaaggaagaaaactgggccgggaacccctcccctcagtgtcccccagttctccatctccataaggagccatcaggctgtcattaaggaacagagtgtcactcagggggcactgtcacaaagcagcacccatggcacatgggccgggggtgcagaagcctggcttatttcaggctgacagctggaccctctgggtgcaggggctcaggcagtggccaagagcccaaagggctaaggcccgtgacgaccacccagcccgtcaccccaggtacaaacactgaccccaaagcaagagcagggactgtccctcagccctcagggccttcatgcagggtgcagaatctcatgtccacatggaggtcacccctcaggtcacacccactcccagagcaaccctgggcagggaggggcaccctggggttgtgttgaccacctccccttcaggtgaggcccttttctgccttctttctagccccctgcatggggcacctgctattgctggggctctggggtggaccctgtgtgatttctgtcagggagcttgtgctgtgcatggccagaggtgtttacatccagaagggcccagcacggccctgtggggtgtggggggaatatggtagatcattgtgatgtgcctcggggccctcttgccttggagccagctttgtttcagaatctgctacttgggccctcttcagggtttgaggctggagaagtgagttgggacagtcactgtcatcaccacccaccctgtcacccacctggaaaacattcttgatatactggccatgctgggccgggctcacatccactgagggtatagtgaccaagcgtctaaaccagtcgttctcaaacttcggtgagtatcagaatcacctggaagggcttttacaaacagattgctggccccaccccccagaatttctcatcaggagtgggcaagaccaatcatttgcatttctgacaagttcccaggagctgcagctgctggccctggaaccacactttgagaaccactgctttagaccaaacaccaaaggaagatgcagccaccctcctttacatgtcacaacgctcagggtccatgagtacctcaggctgtccagctgagctccacctgcagcagccgagattcccgactcgctccaccattgggggctaggagtgaagcgtgtcaccatggtcagctcatggccagccaggaaagcctctctgctgtgcgtctgtgcagttcttgttcttccctggaggactcttggatcgcctgtgatcttggccaggagaccaggtgcctgggtcccttcctggaaggggacaagttacacaccccagccccattttcccaccaacttctacatgccttgggagaacctgctacatgttggctgcccccttcccctatttcagcagtgcccagtcctgcttataaacctgaggcctgctccccataccctgccctgtgcaagtgccagccgttattccaggcagcccaatgttgttgaggccagatggattcctggaagcagctggcccatggatgtgagtcatcacagtattctagaaacagagaagaggtcttaacctaatgcgcatagagaaattgttctcattgtaaacatacccctgtccttagctgatctaggtggaagcccagcttcatgtgctagggggcatgataatgataataaaggaattgtatctagga

SEQ ID NO: 21419 - DNA, 2499 bp, Homo sapiens
  misc_feature (928)..(928): n is a, c, g, or t
tgcaaggcctgcagagttagcaccagctccactagggccatagatgccccctcctttgtgcctagctcctgcgaatccaccgagtgcctgagaccatagcttctactgtgcccacccaggcagggaccctcggccccctctcctccatttctgagcccccatggccagatcctgggcagggaaatgatcctttcaggagacaaccagagcccctcaccaggaacgggggcacccgtggactacgggagggtggcggttgggttctctgctccctcccagctcctgaacctggaacaatcggcagaaaacccaggaaccccggcactcctgcattcagcacgggattcccccacccatgcccagaagccctgaccttgctgtttctggaaaaagcatggggtggggcagggagggctggcatttcccccagaagaccttgccctttgacctgcccactctccacactgcctcacctggaaagccatgtcctgctggcctcattccttcctgaagggcctaggagtggggaggcctgggtagggctgccacaggctgggtagagccgccctggcaggaagcagggggtaaggtggccataccagcacatgctgcactaggagcagagccctgcacctgcctagctgccttcctgggagaaacctccctgggagaccatggccccaagccctggcctctagtgatacgcccctcgggaatctcctgttccggggcctgattctcaggaacaccaggtttcagaccatcttcagcacctaatgttgatgggtgtcaaacatctcctggagtggaccaactcgcacccctgcaaagtcggagctgctgagaaggggcagctctgaatagaggggcatctgcctgaacctcacttttcctggggccctctccttgaccccgtagccaccaccanactgcttccagggggtccagctctgcttcccttcccacctgtcctagagtggacagagctttttccttgggttctctcttgcatcactaagttcagcagggaatttgcggaattttcaggaagaactttccccagtaataagggagaacagaaagaaaatcctagaaaatacagagtatccatgctggcagctttttgtacaacacccatagggacccccccaaatagctattacaaaggggcagcccattcactacacaagaaccccacacctggcttccaccctccccagctcctgcacttctccccagagcgggaccctcttacttccccccatgaaggggggcaccttgtgctaaggccaaggctgagcgaggtcccagctcacctccctgcttgatccagattgcactgtgatgagcacattgctgacctaggccagtcctggggcaggcgtgctctctctcccatacataggagtggcctcaaggccacccagtgctgaccccaacagagccctgaactgtccagaaactgcatcctcagcacaggaagtacccacatggacagagggaagcccagcctcggggccggttgcctcctcttctctgggtgttctccagtggcttcttggagcctaggctggtttatctcccctgcctaaaaggccctggggttgccaatgcaaattcattaaaacgaagaccagatatcccagactgcacagaggccgagagaaatggtatagtgcgtgattagcattgctgccctccaacctcctgggattcatgcagataatcaaaaactgactatgactcccaagttctctgaaggatgagatcacaactgacaactcttacgacagagggagagtggtgagagagagaaagagggtactgggctagagccatgttcttcctgccgaggtgccagggggaggcggcagtgggcagggggtgctggggccttacctgtctgccctggtggggatgaaagacaggtgacaggcaggtgccctgtgcacagccttatcattgaaggcaggcccaggacagcctgccccatctgccccagccccatgggatggtttggtccagcctgactggggcaggattagctgcaattcctgccctgtgtgtcgtccagccagactgcctcttgaaagatggcttgtccaagcggcagacagtggtagaacaacccagggcttggaaatctgacctccttgtccatgccaacagcctgggagatgagacagggttagaggaaacagcagtgcccagtcctgcttataaacctgaggcctgctccccataccctgccctgtgcaagtgccagccgttattccaggcagcccaatgttgttgaggccagatggattcctggaagcagctggcccatggatgtgagtcatcacagtattctagaaacagagaagaggtcttaacctaatgcgcatagagaaattgttctcattgtaaacatacccctgtccttagctgatctaggtggaagcccagcttcatgtgctagggggcatgataatgataataaaggaattgtatctagga

SEQ ID NO: 21420 - DNA, 432 bp, Homo sapiens
tggtgagtcagctgtttattatcagagagattcataatcaaaagagtcatagagtgggaaaactgacatatttcaacaaatctagtccagaatgttaaatagcacaatgggaaaatgtcaatgaggcacaactaaatgaaaattatctcattgcatacaacctcaatttcaaccattagaaaacactgggttgttttcaaatcacagtgtggtgctacaaagaaagcagttgagtgtttatgtaatacaatattgtgaaagcttgtggaaaacttttcttaaaatttttaaggccttggccaggcgcattggttcacgcctgtaattgagcactttgggaggccgagacgggtggatcacgaggtcaggagattgagaccatcctggctaacacggtgaaaccccatctctactaaaaatacaaaaaaaaat

SEQ ID NO: 21421 - DNA, 378 bp, Homo sapiens
gtcaggagatcgagaccatcctggccaacatggtgaaaccctgtctctactgaaaacgcaaaaattagctgggcgtggtggcgcacgcttgtaatcccagctacttgggaggctgacgcaggagagtctcttgaacctgggaggtggaggttgcagtgagccaagatcacgccactgcactccagcctggcaacagagcaagactctgtctcaaaaaaagaaaggaaagaacagtgaagttctctgcccttgtatgattccatgataattacaagtgtgtctatccccaaagtttctatgttaatacctctctacttccagttcttagaagggaagaatgaaacaggaaaacttcggctgcttctacttatccagttt

SEQ ID NO: 21422 - DNA, 117 bp, Homo sapiens
gaaacacagccataaatgttacagatgctccttgactaatgatggggttgcatttcaataatgccatcataagttgaaaataccgtaaatggaaagtgcatttaatacatctaacct

SEQ ID NO: 21423 - DNA, 193 bp, Homo sapiens
taatatataatattatatatacatatgtatgtatgatgcttttcatccccaccctttcccacatctcaggaacctgtcagcaacttatccagtttaaagctgctgttcctctacctcagtggtttgggagaacatggtcattatttcactcattctttacttcctgtctcttctaggattggaatgggggagg

SEQ ID NO: 21424 - DNA, 492 bp, Homo sapiens
ttgagagatcttaccgatgttcttggcttccattacatctatgtgctgatgaatcccaaacctctgcatctctccacctaggatgcctctacttcattgtcttgcccctttaagctgagcccacccagctcaaatctacactgtctgttctcatccctgtcaatgcactctccagcttggggcaggtggagggggcactgtttcatgaggaaagctaatggtatgcagaagggattgaataaaagaaaggaagagaatggagaacatccgcttggctggggctcaatatccaagcatgccaagatgaaagtggagcagggtgcggccttgggaaggagacgtgaatgaactgctgacattccttgaggacaagaggccaaagcctgctggctctaaaactagtatgtttaaagcaaattattagttttgctcaaagtgccactgacatcataaaagaataagatatacctggccaagaccccacctcttaaa

SEQ ID NO: 21425 - DNA, 375 bp, Homo sapiens
caagtttgagaacactggatgcaagcattttccatacagagaagagaggaaggagcattgcacaccattgaaaaagtatcccccaaatcagaggaaaggtcatttgtagcattctgtgaagtttgtcatggcttgaacttaaagtaagttgaacatagtaagctgactatactaggaatttcccccaaattttgctcagatccatgtatttttattgttccggaaagcttaatctttcccttttaggtcattggatcattaattacatttaaagaaaaagctttgtgtttggttgtatttatttatttttctgaaaattaaattatgaagttggctgaacacttttttttataattggaatgttataactagaag

SEQ ID NO: 21426 - DNA, 448 bp, Homo sapiens
gttggctggctgatctttggtctttgttccaccactgaggatgtggagggaaggaattgttgtcttgttttgctccttctgtttggatgcttccaatagtatgtgacatgtactaggtgctcagtaaatatttgatgagtggattatactgcttccttcctgaaccaatatagtgaacctgagtcctccctattacttcctacttttgtattttctaatgtatacaaaaggaaggccaggcatggtggcttacgcctgtaatcccagcactttgggaggtggaggcggatggatcactcaaggtcaggagttcgagaccaacctggccaacatgatgaaaccccatctctactaaaaatacagaaattagccgggcgggcgaaggttgcagtgagctgagatggtgccactgcactccagcctgacaacagagcgagactttgtcaca

SEQ ID NO: 21427 - DNA, 1030 bp, Homo sapiens
gcatatggctatagtttttgttactgtgtttattattaacataccaccactatgtatttcttccatgaaggcatttggatcattctaccttttttgctattttgaacaaagccattatgaacattcttgtgtatatatgtcaggttgtacatgtgtatgatctcttgagaatacatccagcaatggaattggtgggtcataggatatgtatatcttcaaattaactaggtaatacctaacttttccaaagtaattagtgctttcaccagcagcattaaaaggttccacatttggtattgttagactaaaactttggaaaatctaggcttgtaatggtacctcgttgcttaatttgcatttccatgaggttaattattttttctacaaatttatttaccatttggatttcccctttttgcaaagttgctgtttaaatcatttgcccatttttaaaaattttattgactttttggttaataaaattccttcatatactgagactacttaatcatttggtaataactatttcaaatatcttctcacagttatttatcgttctgctcctagtgaaatgtatccatctttttctctattttttggtgtttttgtgtcttatttaaaaaatacttccctctccttaggtcatgaatatcttctgtactgtgttctaaaatatgtgtagttttgtcttccactcaaattgaattttgttttgtgggtgaggtaggtatccaggttctttttttttcccttgtttcttgaaaagtcatctttctcatttggttgaacatgccatttctgtcatctgtgaaatgctcatatttacatgagtctatttctgggctctcttttattccattgatcaatttgcccatatatcagtaacacactgtcttaactactaaagcttttaaaagtcttgatatttggtaaaataagtctttttataccttgttcttcaagattttggctgtgatcagttctttgcacttttatacaaattttagaatttcaacaaaacaaaattgtt

SEQ ID NO: 21428 - DNA, 1020 bp, Homo sapiens
aacttggtgcgagcaacacagaagtttgtctgaaggcggcgccaagcagcgtttcgtgggagaactgggttgatgactgaaattttgaggaagattactttgggaattctcaagtttctcttagtcgcttcttgtctatttgaaatctgtaactttaaacaaaccacgcttactcttccttattctccctgtaaggtacaattagaatagaaaagtttatgaaagtgtatccaaaacttaaatatgtggcgtacaagtgtatggtattattggaatggcattcgcgatcctagagtctacagtgttccctgaataaaactaggggtgagcctggcggtaatcctgcctaggaggtttatagcaaagcagtgtcccctaacggtgcaagaatacccttctgtcgaaaaactgccttataggaatgggtgactgtatgcggtatgtcctgtactgtacatcaataaataactaagccaggccagaaaaagggtgacaaaaggtccacaattatgttaaggaagaccaagacggtatatttgaagttttgtgtatacagaacatttgcccaaatgtaactaatttttttaaagggagattataagcatctcctgtggtccaaacatagttgttaaaatgggttaaaatcggtgaagtgcctaagaacttgactgagacatggtgtttgttaaatacagtatactatctattcagtaaaaatagatcaatatggcatgtatttatcaagtgaatttcatttttctgttggtagacattcaagttattttcaagatatccctataactgacaatactgcagtgattatctcttgctgttataaacagtgcttcaggtggtcatgatagtatttctgtagaattgactccttatgagagtgctggataaccatgttgctaaattgccctgaaatgattgtacctttttatgttcactcgctcaaaagatgtgtttttatctccatgctagccagcactggatgataatggtatttttaaaatatct

SEQ ID NO: 21429 - DNA, 290 bp, Homo sapiens
aaatacaaaaaattagccaggcgaggtggcgggcacctgtaatcccagctactcagaaggccgaggcaggagagtctcttgaacccaggcggcggaggttgcagtgagctaggatcatgccactgcactatagcctgggcaacagagggagacttcgtctcaaaaatcaaacacacaaacaaaacaaaataagggttaatgggctctgcatgagtccttaagagcctctctatgagtaaggagaataaactttctaataagcatttcatgacattttttatggcccttca

SEQ ID NO: 21430 - DNA, 455 bp, Homo sapiens
tcagatcacttacaaaggaaacaccattaggttaatagtaaatgcctcaacaaaaacctcagaagccagaagagatggaggacctattttcagtgatcttaaagaaaagaaattccaaccaagaatttcatatcctaccaaataaaacctcataagcaaaggagatataaaatctttcttagacaagcaatcactaggggaatttatttcctctaacctgccttaaaagaggtccttaagagagtgataagcatggaaatgaaagaacaatacctgccaccacaaacacatttaagtacacagcctactgacaccataagacaacctcataatccagtgaacaaaatatacagttaacaacatgaggaaagtctcaaaatctaggatatcaacattaaccttgaatgtaagtggtctaaacatccaacttaaaaagttatgaagtggtaacttgg

SEQ ID NO: 21431 - DNA, 401 bp, Homo sapiens
tccttgacgctggggaccaggaacttccggaagccactgggcagcatgtgctttgttttttgttgctcccatgaccagtgttgggcatcaagatctggcccttgcaggcgcggtggctcatgtctgtaatcccagcactttgggaggctgaggagggtggatcacctgaggtcaggagtttgagaccagcctggccaacatggtgaaaccccgtctctaataaaaatacaaaaactagccaggcatggtggtgggagcctgtaatcccagctactctggaggctgaggcatgagaattgcttcaacccggaaggcggaggttgcagtgagctgagatcgcaccactgcactgcagcctgcacaacagagtgagactctgtctcaaaaaagaaaaaaaaata

SEQ ID NO: 21432 - DNA, 497 bp, Homo sapiens
tccaaaatcagcacctttgaaatagaagatataatgcataagacagaacagacttcagatacctctaagaaacttgtgtaattggtctttatagctttttacagatgacgaaaattatgaatataaagactgtcttctttgggaaaatacatgtccaacagttgaagtaatccctaaaccttatcttgtctttttctttcctgacctaacttaacaataacaaaccttgagctcttatatcccagcaaagggatgttatgcagaagttactttagatatccacccagttttgctgttggctatgaattgtgacaagtgcttcagtacattgtcctacaccaccaggcgcttgagtcctagatttaaaaaaagcaccataagcaatggataattgtttactctgatggaatggcttcaaaattgtagcctttataatttttagtcatgtagctacaaaataatatccccaaagaatactattcccattccatgtttaa

SEQ ID NO: 21433 - DNA, 2465 bp, Homo sapiens
  misc_feature (80)..(80): n is a, c, g, or t
tgcatctttatgataagtggatcaaagatgctgatccaagagttgaagattggctcctcatgtcctcgcctctgccacanaccatcctcctaggattctatgtctattttgtcacttccttgggaccaaagctcatggaaaatcgcaagccctttgaactcaagaaagcaatgataacgtacaattttttcatagtactcttttctgtgtatatgtgttatgagtttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccgtggacctggtggtttggagtcaaatttgctgcaggtggtttgggaacattccatgcccttctaaatacagctgtacatgtagtcatgtattcctactatggactttctgcattggggccagcctaccagaagtatttgtggtggaaaaaatatttgacatcattacagcttgtccagtttgttattgtcgccatccacataagccagttctttttcatggaggattgcaagtatcagtttccagtctttgcgtgcatcattatgagttacagtttcatgtttctgctgctctttctccatttttggtaccgtgcttacaccaaaggtcagaggttgcccaaaactgtgaaaaatggaacttgcaaaaacaaagataattgaagcccaacataagtctatgatcgaaactgatacattgtcttccttgacaatcaagagatatttacctatgcagtgcattttgtatatttttcaaaactaagagcttgtatttttatggtaagttattgggatgtctgatatttgagagcccgaagcttccagataacagtcttctgataattagagcctacagcagccagaatttgtttttgtttttgtttttgtttttttagctgcttttaaacctaatccaaaggttttgtttaaaacattttgttgcagtgaaaaaaagatatgaagcaatacagtactcttcaaagaagtccaataaagatgaaaaatatcattaggtattttgagcacagacggagatccatgtgataaaatagattccttctgctgggtctggaaagtctggaaaccacctgtaggccctggctttgtcatttattgactgtattcagaagatactatatttgctctagagttaactcccattttagcaagctagcacaggtgaaaattgagtgagtttttgataacttgtcatttaaaatcattaatgataattttcaatggatcttttcagtagccatcaccagttttgctgataagacttcctcacaacccatttgttgtacaaactgtttcaaagtagcaatcctttgggttagtacacttgataccaagtttcattcagttgattattttcaaaacaaggtgatttgttttaatgggttaatgaatactttgctattactgttttacaattaactttgtatatctctggaaagaggtgaatttgtcaatgaaaaaagtattgtgtagttcagtgggaaaaacctgttgtctgttatagtatcacatcactttcttacattgtcatggtttaaattattatcttggtgaaatatataggttagatacttaaatgttcatattattagcacactacaggtactacccttaaatcataaataatattacccattgtacacagtttccagatatgagttagagtggctgtgaagcaactagaggcaaattgtggcacagagaatatccaggggaaaattgattatgtaagcaagggctgttctactttgagagagagacagacagactacataatagtaatatattatataattaatgttatagatacactgaacaataaaacattttctggaattatgaattaattaacaacctggatttctgtttccagacctataaaccatgtaatgaaggactgaaattcgtttggcatacactttgtttctttaaaattgctagtttctttctgttatttttacattttcttgtcagagaatcaaaactattagtcagtagagttttgtccatgaaataatatttggacatttgtgaatttttccctattttttttcttcttttatttatactcaattttgaagcactgtttatgtttgtaggactttaaacaattagtacttaaagccccagttaattttgaacacacagagatacttattgtactctgtgtacagtaagtatttttatgtttacacttaccagattcataaggttatttgcctttaagtgatcttttgtgattttacttgattacagcatgagaaggtaaaggttgataaatgggagtaattacat

SEQ ID NO: 21434 - DNA, 3658 bp, Homo sapiens
  misc_feature (80)..(80): n is a, c, g, or t
tgcatctttatgataagtggatcaaagatgctgatccaagagttgaagattggctcctcatgtcctcgcctctgccacanaccatcctcctaggattctatgtctattttgtcacttccttgggaccaaagctcatggaaaatcgcaagccctttgaactcaagaaagcaatgataacgtacaattttttcatagtactcttttctgtgtatatgtgttatgagtttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccgtggacctggtggtttggagtcaaatttgctgcaggtggtttgggaacattccatgcccttctaaatacagctgtacatgtagtcatgtattcctactatggactttctgcattggggccagcctaccagaagtatttgtggtggaaaaaatatttgacatcattacagcttgtccagtttgttattgtcgccatccacataagccagttctttttcatggaggattgcaagtatcagtttccagtctttgcgtgcatcattatgagttacagtttcatgtttctgctgctctttctccatttttggtaccgtgcttacaccaaaggtcagaggttgcccaaaactgtgaaaaatggaacttgcaaaaacaaagataattgaagcccaacataagtctatgatcgaaactgatacattgtcttccttgacaatcaagagatatttacctatgcagtgcattttgtatatttttcaaaactaagagcttgtatttttatggtaagttattgggatgtctgatatttgagagcccgaagcttccagataacagtcttctgataattagagcctacagcagccagaatttgtttttgtttttgtttttgtttttttagctgcttttaaacctaatccaaaggttttgtttaaaacattttgttgcagtgaaaaaaagatatgaagcaatacagtactcttcaaagaagtccaataaagatgaaaaatatcattaggtattttgagcacagacggagatccatgtgataaaatagattccttctgctgggtctggaaagtctggaaaccacctgtaggccctggctttgtcatttattgactgtattcagaagatactatatttgctctagagttaactcccattttagcaagctagcacaggtgaaaattgagtgagtttttgataacttgtcatttaaaatcattaatgataattttcaatggatcttttcagtagccatcaccagttttgctgataagacttcctcacaacccatttgttgtacaaactgtttcaaagtagcaatcctttgggttagtacacttgataccaagtttcattcagttgattattttcaaaacaaggtgatttgttttaatgggttaatgaatactttgctattactgttttacaattaactttgtatatctctggaaagaggtgaatttgtcaatgaaaaaagtattgtgtagttcagtgggaaaaacctgttgtctgttatagtatcacatcactttcttacattgtcatggtttaaattattatcttggtgaaatatataggttagatacttaaatgttcatattattagcacactacaggtactacccttaaatcataaataatattacccattgtacacagtttccagatatgagttagagtggctgtgaagcaactagaggcaaattgtggcacagagaatatccaggggaaaattgattatgtaagcaagggctgttctactttgagagagagacagacagactacataatagtaatatattatataattaatgttatagatacactgaacaataaaacattttctggaattatgaattaattaacaacctggatttctgtttccagacctataaaccatgtaatgaaggactgaaattcgtttggcatacactttgtttctttaaaattgctagtttctttctgttatttttacattttcttgtcagagaatcaaaactattagtcagtagagttttgtccatgaaataatatttggacatttgtgaatttttccctattttttttcttcttttatttatactcaattttgaagcactgtttatgtttgtaggactttaaacaattagtacttaaagccccagttaattttgaacacacagagatacttattgtactctgtgtacagtaagtatttttatgtttacacttaccagattcataaggttatttgcctttaagtgatcttttgtgattttacttgattacagcatgagaaggtaaaggttgataaatgggagtaattacatatatatatataatttattatttttttttctgaagcagagttttactcttgttgcccaggctagagtgcaatggcacaatctcggttcactgcaacctctgcctcccaggttcaagtgattctcctgtctcagcctcccaagtagctgggattacaggtgcccgccaccatgctcagctaatttttgtatttttagtagagacagggttggccaggctggtctcgagctcctgacctcaggtgatcctcccacctcggcctcccaaagttctgggattacaggggtgagccactgtgcccggccataattttatatttttagaaaataaagaatgaaggacaaaagagcacagctaaatgaaactgctgctctaatttattccactggaaaggtctcaggactccttaactgttttccaggtttggctcttcatatctaacctgtgctaaaatgagaaggtatgctaggtgctgttagaaatcacaccatttccaaagaacccaagtagtatagagaccaaaatgaggcaaaaataaaagagatgaaacaggagagtttatttcttgcatactttccgaccttcatcatacaacctctcctaacctccctgtagtctttaaaatgtttaacttgcctataagctaacatgtaataaaacacatactcaattatatgaatagaagtggagagccagaatgctacaaaagaaatcacagctgctagaagtatcctccatagaaacatcaacatgattgtggatcaaaatgattttcactggatatggaatttgtatgggccatatttattaaaagagttctgtgtggtcacatagagttcctttgggatttcatcccacttttcaggacttaatttgtttgggtttgcttacctaacaagcaacaacaacaacaaaataaatagttccaaaatctagtttattacataaatctctatgaatccttgagggcctatatctatattataaataaatacaaatatagatttttaaatatctatgggactttgccatttacagccttaagtataaaattacgagattatattctttccattaccctttatttctgctaactttttaaagactggaacattctgtggatgttgtcaaagtttgagtttgtttttccctgtgtattataataaatttgtggtattgcatgtaaaaaaaaaaa

SEQ ID NO: 21435 - DNA, 3362 bp, Homo sapiens
  misc_feature (80)..(80): n is a, c, g, or t
tgcatctttatgataagtggatcaaagatgctgatccaagagttgaagattggctcctcatgtcctcgcctctgccacanaccatcctcctaggattctatgtctattttgtcacttccttgggaccaaagctcatggaaaatcgcaagccctttgaactcaagaaagcaatgataacgtacaattttttcatagtactcttttctgtgtatatgtgttatgagtttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccgtggacctggtggtttggagtcaaatttgctgcaggtggtttgggaacattccatgcccttctaaatacagctgtacatgtagtcatgtattcctactatggactttctgcattggggccagcctaccagaagtatttgtggtggaaaaaatatttgacatcattacagcttgtccagtttgttattgtcgccatccacataagccagttctttttcatggaggattgcaagtatcagtttccagtctttgcgtgcatcattatgagttacagtttcatgtttctgctgctctttctccatttttggtaccgtgcttacaccaaaggtcagaggttgcccaaaactgtgaaaaatggaacttgcaaaaacaaagataattgaagcccaacataagtctatgatcgaaactgatacattgtcttccttgacaatcaagagatatttacctatgcagtgcattttgtatatttttcaaaactaagagcttgtatttttatggtaagttattgggatgtctgatatttgagagcccgaagcttccagataacagtcttctgataattagagcctacagcagccagaatttgtttttgtttttgtttttgtttttttagctgcttttaaacctaatccaaaggttttgtttaaaacattttgttgcagtgaaaaaaagatatgaagcaatacagtactcttcaaagaagtccaataaagatgaaaaatatcattaggtattttgagcacagacggagatccatgtgataaaatagattccttctgctgggtctggaaagtctggaaaccacctgtaggccctggctttgtcatttattgactgtattcagaagatactatatttgctctagagttaactcccattttagcaagctagcacaggtgaaaattgagtgagtttttgataacttgtcatttaaaatcattaatgataattttcaatggatcttttcagtagccatcaccagttttgctgataagacttcctcacaacccatttgttgtacaaactgtttcaaagtagcaatcctttgggttagtacacttgataccaagtttcattcagttgattattttcaaaacaaggtgatttgttttaatgggttaatgaatactttgctattactgttttacaattaactttgtatatctctggaaagaggtgaatttgtcaatgaaaaaagtattgtgtagttcagtgggaaaaacctgttgtctgttatagtatcacatcactttcttacattgtcatggtttaaattattatcttggtgaaatatataggttagatacttaaatgttcatattattagcacactacaggtactacccttaaatcataaataatattacccattgtacacagtttccagatatgagttagagtggctgtgaagcaactagaggcaaattgtggcacagagaatatccaggggaaaattgattatgtaagcaagggctgttctactttgagagagagacagacagactacataatagtaatatattatataattaatgttatagatacactgaacaataaaacattttctggaattatgaattaattaacaacctggatttctgtttccagacctataaaccatgtaatgaaggactgaaattcgtttggcatacactttgtttctttaaaattgctagtttctttctgttatttttacattttcttgtcagagaatcaaaactattagtcagtagagttttgtccatgaaataatatttggacatttgtgaatttttccctattttttttcttcttttatttatactcaattttgaagcactgtttatgtttgtaggactttaaacaattagtacttaaagccccagttaattttgaacacacagagatacttattgtactctgtgtacagtaagtatttttatgtttacacttaccagattcataaggttatttgcctttaagtgatcttttgtgattttacttgattacagcatgagaaggtaaaggttgataaatgggagtaattacatatatatatataatttattatttttttttctgaagcagagttttactcttgttgcccaggctagagtgcaatggcacaatctcggttcactgcaacctctgcctcccaggttcaagtgattctcctgtctcagcctcccaagtagctgggattacaggtgcccgccaccatgctcagctaatttttgtatttttagtagagacagggttggccaggctggtctcgagctcctgacctcaggtgatcctcccacctcggcctcccaaagttctgggattacaggggtgagccactgtgcccggccataattttatatttttagaaaataaagaatgaaggacaaaagagcacagctaaatgaaactgctgctctaatttattccactggaaaggtctcaggactccttaactgttttccaggtttggctcttcatatctaacctgtgctaaaatgagaaggtatgctaggtgctgttagaaatcacaccatttccaaagaacccaagtagtatagagaccaaaatgaggcaaaaataaaagagatgaaacaggagagtttatttcttgcatactttccgaccttcatcatacaacctctcctaacctccctgtagtctttaaaatgtttaacttgcctataagctaacatgtaataaaacacatactcaattatatgaatagaagtggagagccagaatgctacaaaagaaatcacagctgctagaagtatcctccatagaaacatcaacatgattgtggatcaaaatgattttcactggatatggaatttgtatgggccatatttattaaaagagttctggctctccacttctattcatataattgagtatgtgttttattacatgttagcttataggcaagttaaacattttaagtc

SEQ ID NO: 21436 - DNA, 453 bp, Homo sapiens
atgaaatttttaagaaatagtttgtggtgatataaattagttttcatctggcagtcattggttttccaccctgccctcttaagagagaacagggttgctttactttgtttgccagagctttacattttgcatttagtaacagaggcattgtgtttttatagtatgaaaacaacgaaagatcactttgtgatctttactttttgattttgaccacttcctgtgtaaccttaagtttcttacaagtatcccctgttaactgttaaaaacgaaatgtatgttcatttcatgtccttgggacttttaaaaatgcgctgtgcattatccggaaaagcctgttcaaaaacaagatgagataatttctgtttaatttgtggtagaaagaatgactgtgcacttttatgtgcaaaggttttaagtataataattaaaatagtacttgtttactcagttacc

SEQ ID NO: 21437 - DNA, 442 bp, Homo sapiens
gagtaagtttgctatgtattaatatatgataaagtactgtacaggctaatgctgtctggtatcaaaaggtactttcaaaagttttttaaagctataaatagatataaatcatagcttaatcaggtctcagctacagattttcattttattggccctttccagaatgatctgaatcccatcttgagagcaagtctttagacttttaagctagttactgtcatatggtattgctctcttgtccaggcttcttcccatcccagccacaggaaatcttttcatttctcttggattgtgagcattagtgagaagaatgggctgtctagtacagtacatcaattgaaaaggtcttgtctggttttgtacggtaacatccattctcccctctgcctcccaagccaagctagcccttctgttttcctctctctcaatatgatgaatatgg

SEQ ID NO: 21438 - DNA, 503 bp, Homo sapiens
gagataagtataggcacagagcaatttatatgagttgattatagtgcattttactataattccatggtaaaaaagcctgattagaatcacatattcactgtagcacctattttctgacacagttcagtatcatgcaggttccttagaaattgtcggagggaatgtaattatccaaaaatgctgaaattacttgttgtaaactagcctatgtgttatggatccatggcttatactaaaagccagttttcaggtagagttgaatgtagctagagctgctgcccccaatgtgacatcaacatttactgaattcatacaaagatgtgtgattttttttttccacaatgttgggattatacttctaatttgccaaagaaatagctaagctttctagagtatggagtctgtccagataatcttggtatagtctccttttttggagggtgtgtggtagcgggggaatcatgtggtccctggaactctgtatgcaattatttgctctgctg

SEQ ID NO: 21439 - DNA, 369 bp, Homo sapiens
ctccagctgcctagttgtagttgacagacaactttataagctctagtcaaccctattgactaagcttctgaaccactagcatagttctagggtcaggcggatgcctactgtgggcaggaaagtgatgcatgcatgtgtgggagcagtgtcttaatgtctgaaatagtagccatgagctacatgtggctatggagcacttgaaatgtgggagtccaaattatcatgtgctgtgagtgtaaaataatatgtttctaagaccgtgtgtgaaagaatataaaatatctcattaaaaaatgtttatattgagtacatgttgaaataattttatatttgtgacacattgtgttaaataaaatattaaaatttaca

SEQ ID NO: 21440 - DNA, 528 bp, Homo sapiens
ggagaatcttgcagagtgctttctttctaggcccctctgcaaacgtcttcattcattcatcctttcccctcactctcttccttttttttaattttttttctttcttcacctatttattgggcgcctactttgtaccaggcatcgtgctaatctctggttagcagaaaacatgctgactcttgctctcttggcgcctaccgtctggtgatggggtccaaggtgcttcactgactggaccaaaagtttaccgaacttctttttttcttatttgtggcaggcactgtgttatgcccagaagggggtgcttggggaacatagaaaataagggaaaaaaaaagagagagaaaagcactgcgaagaggataaaataccctatggatagggatgggaatagggctattttagaaatatttgcattttccgaaatactgttttataataagaataacattaagtgtacctatttgctaattttgtgatgattatataagaaaagcctgggcaacagaaccagaccctatttcaaaa

SEQ ID NO: 21441 - DNA, 395 bp, Homo sapiens
tgacaagctgcacgttttaccaaaaaaaaaaaaaaagcttgcaatagaaagaataatatctgcagggcaggtatggggatccaccatcttaagtccttttatccctaccaaatgtttccttctgagaaactgcatttgtcagctcagctctctcaacctctgggagtaggtttacatatatttgctcacttgatatatggctgataggaactgagcaagtaaaattttcatttcattgaattttaattaatttacatttaaattgctacatgggattagtggttccatactagacagtgaagctagcctgtacttgttaaaaagaacccaatgagtgaaatgaacaaagtaaacatagcacatttctaatgaagcacataaaataatgagtggcc

SEQ ID NO: 21442 - DNA, 1169 bp, Homo sapiens
ttacccacagtgtgttatctaatgcctttcaaactaggggaaaaaaatcagtgaacattatggtagatgctaaaatctgccattttcttgtatatttctgacagtttcagttactttgcatttgtattatacaatgactaacatcagccttttaccattctttcctctggtatttttcagtaacaaatagtgaatgtatttagagataaaaataattttgtgaccaaatgtgttcttgtagagtgcgttattttcccctattttctctgtggtattgcaaacagtcatggtgagtgctgcaggttatatgaggataagtaagacttggtacagaaatgtccagaatactcaaaactggaaaaaagtgatccctgatagttaaatggtcaagataggcttcctgaaggtgatggtgtttagccagtcctggaaggaatgcgcaatacaatttcaacaggtagaaataagatgattaagggtaaaataagaaaggggaagattagtgcatcatatagagcaggactgttgagcaagagtgtagaccacaagttgagggtatgctaggaaataaggctagaaaagaaggttgagatcagattatggagattcttattaatactaaactaagcagtttagcttatttctggtaggcattggggtgccgctggagagagcagggaaggaatatatgatgctaactaaggttattttgacaatgctgtaattgaaagtgaggaagagagacactttactacaggtaataatttaaaggccttccatgtacagtcattgtgccagaaacttagggataaaaagatgaatataatacaatgccacacctttggtcttgtagtctataatggaaaggctaaatggttaaatagattattatactgaaatgtggtaaatacgttgaaaggttttagtgtcttttttttttttttttaagacagagtcttgctctgtctgttggcctggctggaatgcagtggtttgatctcacctcactgcaacctccacctcctgggctcaagctattctcatgcctcagcctcctgagtagctgggattacaggagaattgcttgaatccaggaggcggatgttgcagtgagttgagatcatgctactgcactccagcctgggcaacagagtgagactctgtctcaa

SEQ ID NO: 21443 - DNA, 369 bp, Homo sapiens
ttttttttttgagacagagtctcactctgttgcccagcatggagtgcaatggcacgatctcaggtcactgcaacctctgccccctgggctcatgagagtctcccacctcagcctcccaattagctggggctacaggtgtgtgccaccacacccggctatttttttgtatttttagtaggtatggggtttcaccatgttggccaggctggtcttgaactcttgacctcaagtgatccacccactttggcttcccaaagtgctgggattacaggtgtgagccaccatgcccggccataaatttcttaatgttgaaccaaccttgtaatcacgggaaaaattatacttggtgatagggtttggctgtgtccc

SEQ ID NO: 21444 - DNA, 395 bp, Homo sapiens
caaccagaggagaagtcagaacattaccagtatttccaggaaggtggggccagcgggttggtccctgactgtgtgtgagctgagcatgacagcctcgggaagttgatatggagcatgcattagattcagctcactctcaaaaaaagttgtaagtgccaaaacagatgattaatttgctggcatctgaaaaagaggagcggcatgtttgctgcctggcacatatcacttggacctattccttatttgtgactctgatcctgagagaaatttcaaggaaacgtatgtcttcgggaactttagaaagcttgggaaagaggatgaagatgatgactaacattgactggcacctactattgctggccagcatataaggaactttatcttcattatttcat

SEQ ID NO: 21445 - DNA, 491 bp, Homo sapiens
gtaagcactaacagatgccaagtgaacctgactccagaggttattctgcaatttaggctctttttttagagggctcgtgggttatttcagcaatctaatctctggtctgatgcgtcctttccgttttcaccataattaaactactcattggcaagtgaggaaaagagaattgttggatttatgtcaccaacttctatgttaaagaaggaaaatttcaacatagtatagtggcatgagcactaccatcatcagtgtctatcatatttatctattgtgttctgtttctgtttttatcatatttattgtgttatctattatgttgttccctttccttcaaagatttcagggtgtcatatattatacaagagcaaagtggcaaatttaaacccgttttcaggtagggaaaactgagaatgtaaaaatagaaagtgagtcagtacactaattctgtgaaacagagaattcccttttaatcttttttactacgttgg

SEQ ID NO: 21446 - DNA, 538 bp, Homo sapiens
ggagacacaatctcgttacccaggctggggtgcagtagtgtgatcatagctcactgtaatctcaaattcctggactcaagggatcctcccacctcagcctccttgagtagagagacagagtgagaccctgtctcaaaacaaacaaacaaacaaaatcacactctttatccactgcaaaacagtgtaagaaaataactctggccagaggtaccacagtgtgcagggaaggtgtgcgaaagttctgacccaaatctactcattcctgaaattcttaatagcaatgcagggtagaacacaagaaaattaagtagaatacagggagccatgctagtttttgttctacaaacataagagaaggaaatctctgaaaagtattcacatcaattaagagattttttaaaaaccccaaacttaggccaggcgcagtggctcacgcctgtaatcccagtactctgggaggccaaggcgggaggatcacgaggtcaggagatcaagaccatcctggctaacgctagagtagaaaccctatctctactaa

SEQ ID NO: 21447 - DNA, 405 bp, Homo sapiens
tgttctaggtattagacactattctcacgagaaagtgagttagagaaaagaaaatcataaagaagagaaaatatatttgctcatcatgacatggaagcggatcatcttaaaggtcttcattcttgatgtcttcatgtcaagtaggctgaggaggaggaggaagaggagggattggtcttgccatctcaggggtggcagaggcaaaagaaaatccatgcataagtggaccgtgcagttcaaacttgtgttgttcaaggatcaactgtgtaggctttctccttctctagacgggacttcaagatagaatggaccctctgtcatcatttttgcatctccaacagccacaacagtgctttatatataacaaatgaccaataaatgcctatcaaatgcattgaataatgg

SEQ ID NO: 21448 - DNA, 411 bp, Homo sapiens
  misc_feature (362)..(362): n is a, c, g, or t
  misc_feature (397)..(397): n is a, c, g, or t
ctgaccagaaaagggtagaaggattgacgtttacgaagtttttgaatcaggaggcaaggtcgccttgtgcccccaaaaggatagaaaaaggcctggcaaactggagaatcgcgtccttacggtgcctacatatttatagtacgaattaaactgctcaaggggtgctaggtttgtctgcagtccgtttctccctcatggtggaagacgcgtggggaaacttggtatcctgtgttttccagttgaaagcttgtgaaaattcgctttatccttgaagttcagaattttcaccaggatgtatgaagaccctgtcctcgatggatcagctggcaccacccagatggataaactggcttcatctgatncttgtggcccccatccagggaagtgactcagtgtnaagaagacagcttt

SEQ ID NO: 21449 - DNA, 617 bp, Homo sapiens
tgcccatctcatgtggttcagttctaatagcaggtcttcttcttcctttcattccttcctttattcagcaagcatttgttgagcatctactatgtgccaagcattgtgcttgggcaacaacagtccacaaagcagactccccacctgcccttatgaaactgtatctcctcctcccaaacattatcaccaccccaccatttccacaatgaaaactgaattcagacagcattctccattctgccagagtaacctaggaagaagaacatagcagcagacggatcctcagggaggaggcagcagagtgacagatggtaaactgcatcaggccacatatttgcacctttcagatacagccaactcttccagggcctagactgagctggttggagctccccaaagcagcattcagttgcttttccttgatatccaccctggctacctatattccctttctttatataggcacaaccattcaccactacgctggattatctaacactccaattctattaactcatccaggggacacacagttgagtctgatgaagcctaagaactgccaggtgctgagatattgtaactgggaattaagatttagccaaggacattgtgagact

SEQ ID NO: 21450 - DNA, 366 bp, Homo sapiens
gttccgagaagcacgggtgggctgcgaggaggaggtgggctcctctcccttcccctgcccctcttcctccttgttcgtcttgagctccgtcaagtggccccagaagaaccagcagatgcgatggccctgtgcctgtggagcagggggccaggcagcatggctgtgtcacactcagccttgcgcctagagctctgtgactctgggcatgagccactcacgggaatgcaggtggaccctgcctgtttacaagacagtctggtgcgggtattgcaggtattaaagcagaaacatcgtgtaccctctgacccacccgttctccttctcagtctctatatctcaaggagatgtataggatgactactctga

SEQ ID NO: 21451 - DNA, 451 bp, Homo sapiens
ttttacaggctaatacagtcatggatttagtaaaatccagttgaaagatttttaattatataattgtatctaagctgtcctaatatctgaaagaaatttcattctgaataaagaaattgtattctggataaagctcctttcaaacaagatcaagattaaacaaatacaaagagggatgcatttgggcatgcggataaacttccagtttgaggagttttaaatagcaagtaagaaaagagagattggtctttgtaacctccaaaagaacgtggctatattaaaattttcccaataacaaaactgactttaaatacttgccaaaaacagtgactcttttagtcatgagtgtgcttagtttaatcccacacactgatatcacattaagaactgaaggctgaggatatacaggaatcaagggccaatttgggacaacttggccaccacacatctg

SEQ ID NO: 21452 - DNA, 364 bp, Homo sapiens
aaatatatatatatatatatatgtatttatatgaatgacccccaggttctctggcttgacaattgggtggattatattgttattttgttatttagtaagatggggaagggttggaatgatgagttcaattttcgatttgttgagtttgagggatttacaggaaatccaaatgaagataatccaggaatcgatctatacatacccagaattcaggagtgaggtctacactgaatatacagatttgtgcctcactatgtactgagtgtccctaatccagaagttcaaaatttgaaattttttgagttctagatttgtaatgctcaaccttgtaagtataatgcaaaccttccaaaccaaaaaaaaa

SEQ ID NO: 21453 - DNA, 383 bp, Homo sapiens
aatctcacaaatgtactcaccatcataacaaatgccaatgaagtctttcttccattgctgcacccacaaacaaatgtttaaactgtttcagcttgtttgctaaggttcaaaatccattttccaacatttgtagagctaagaaaacgctaaaggtcacaaagcccgtattatttctatattgcaaaaatttagtcacagtggaagaagggcagaaacaaaagtaaaacaagggaagatgtggagaacagaaaaggaaagagatgaataaaaagaggcattccattcctttattcattaatttattgattcattaaccaattatttgaggattttatatactagcactgttatatgctgaaaaataaagtcaaatgagatgtggt

SEQ ID NO: 21454 - DNA, 766 bp, Homo sapiens
acatctgcctgtaatgccaaggccttgtgatagggagtggcctgaagcccggggtagaggagtggacctccccagcatagctggggaaggagtctcaaggagatgacatttgaccagtcctcatggttgtttgcaagtggcttctctgctgtggaatgggaagaaagggtcttccaggaagaggggttagcctttgtaaaagtgcagagaaacgtttgtatgagcaagagagtaattagggaaccgtgagcaattccatgtgactctgactataggtaggctgcagggaagggaagagacagatgaggactgtcttcctagtgcctagaacagtggctggcccatagtaggtattcggtgcatcttagtggagaaatgtgtgaaagaggaaagagagggctgggaggtagactactactagattggctatgggtggagctgggggctcagcattttcaagctctgaagtttggtctccttgaaggaacaggagcagctctggattttagaaggccaattctgtccacagtgcaccagtgttctaggtgaggttggatgatggggagacttgtattctccactttgttttatctttgacctcacatgccctcttttactcctggcttccactgttgacgtccttaaaccttgctattgctcgctcttttctcaatttgttacatccttctttcaaactcttgccttttctgtaattcccgtgtgacccataatcatccccatgccctcatataccaccgtcgtctcc

SEQ ID NO: 21455 - DNA, 198 bp, Homo sapiens
aaggggaagcaggcaccttctttacaaagcagcagaagagagaagagtgagcgaaggaggaacttgccaaacacttataaaaaccttgagagaattcactcactgtcacgagcacagcatgagggaaccacccccatgatccagtcagctcccaccacattccttcctcaacacctgacacgggggattacaatgcaa

SEQ ID NO: 21456 - DNA, 483 bp, Homo sapiens
gtccccttttgggccagagaattctctgttgttggggactgtcctgtgcactgtaggatgttcacagcattcctcactctacccacgagctgccagtagcaccccctctctagttgtgacaaccaaatttctccagacttagccagacatcccctgggagaagtaacccccacatccccctaccccactgaaaaccagtggcaggccaggcacgctggcttacgcctgtaatcccagcattttgggaggccgaggtgggtggatcacgaggtcaagagattgagaccatcctggccaacatggtgaaaccctgtctctactaaaaacacaaaaattagctgggcatggtggcacgcgcctatagtcccagctacttgggaggctggggcaggagaattgcttgaacccgggaggcagaggttgcagtgagtcgagattgcgccactgcactccagcctggcaacagagcaagaccccgtctca

SEQ ID NO: 21457 - DNA, 453 bp, Homo sapiens
gtgcaacttctgcattcttgcttcaatgttgactaggcacaggcttcgtttttctttttgagacagagttttgctctgttgcccagtctggagtgcagtggtatgatcatagctcactgcagcctcaacctcctgggcttaaactattttcccctgtcaacttcccaagtagctgggactacagacacatgccaccatgcctggcttcagcatccattcttaaactccttttcaccattgatctgggattttactcttagctggaacctgtctgagacccgactattggaggtctcttactgctggaggatggtatctctgggaaaggcccactcccagacccaggaatgtaggatccatctcagtgcagcttttctcagctctctacttgtctggggtaccacacttctcaaccggattctgtacttctcataaaggtattttgatcagtaa

SEQ ID NO: 21458 - DNA, 407 bp, Homo sapiens
caaaaattagccaggcatggtggcgggcacctgtaatcccagctactcgggaggctgaggcaggagaattgcttgaacccgggagacggaggttgctgtaagccaagatcacaccattgcactccagcctgggcgacaagagcaaaactctgtctcaaaaaaaaaaaaaaaagataataccttggctgggcatggtgactcttgcctgtactcccagcactttgagattacggaggcagaggtgggagtattgcttcaggccaggagatcaaaaccagcctaagcaacatagtaagactcttgcctgtactcccagcactttgagattacagaggcagaggtgggagtattgcttcaggccaggagatcaaaaccagcctaagcaacatagtaagactctttctaca

SEQ ID NO: 21459 - DNA, 349 bp, Homo sapiens
ggaaggcagaagttgcagtgagcccagatcgcgccactgcattctagcctgggtgacagagcaagacttcatctaaaaataaataaacaaacagatggtttctaaccaaactggccttaccggatacctccagttctctctttcttaaaataagggagtgatgtctttggcctggataagcagcttgagccatatggttcttctggattcagctctagaaagggcccatgctcagctgtttagctttggacagttattgagccccactgaagctcagacctgtcatctgtgggatagggtgctggacccaccctgagggattatcatgaggcttaaatgaggtagaaca

SEQ ID NO: 21460 - DNA, 269 bp, Homo sapiens
catcaaagcaataacttccctcacattcacatttattcaagtttatttgtagggaggcaatatttcctcttcccctgaggaaggcccaccatcagtacagtagtgcccaggtcactgcaattctctcctgatgaaaaccttaacatcctgactcaatcattcaaaaagcattcttaatgccaggcaggctgctaagtgaaggggatgcatcagccaataagtcgttatctctgctttctaaaagttcatctaatggactggttccagag

SEQ ID NO: 21461 - DNA, 1037 bp, Homo sapiens
ggaatttgctacatatactatatttaaaaagaggtgaagatgaactccagactactatgattgctcatgacattgaatttgataacttttaatttgcggataagaaattcttgtgaaatagctcaatctgtctatgtgttgtagaagtgagtggttggagacagtgagtaccaattcatttgatcacataatcgttcaacaaacacacaatgccaggttctgtactaggtactggggtgacttctatgatggctaacgtgaactgtggactctgctcttgtgggaaaggtagacagttgtaggaagggactcacaaatttctgggtgttacaaattccaaatactttgggatatatgaaagagaccacttacagagtatttactgggtgtcagtcactgtgctaaccacatcacattcattatcacgtttaactgtgagatctctataaaataggaattattattttcccttttaatggatgagaaacataacatcaaagtgtacagatcaggtgacttgttgcgtgtcagtggtaattggctacattggttgctcacagtgaaccatgtcttttatactcacactcgtatagtcactactccttgaatcaaggctggccctgggattcactttaaccactagactgtgtcagaaatgatctcgttccagttccagacctaagcattaagtagacctggcagatttcacttctgtaatcttgaaagccctgtcacctggtaaaaaaaaaaaaaaaaagaaagtctatttatgctgctggagagactgtatgctgagactgtgtagagagacacaggaagagggagagaccctgagattctaggggaggagagagagaggttcaattgagcccagatcccagccaactagccagctgaatgcagccacatgagcaaccaccagtaagatgaacggaacggtgccactgagccccgcccagattatggactcctgagcaaatacaatggtagttgtttataaccactgagttttgggtggtcagttacatagcaaaaaa

SEQ ID NO: 21462 - DNA, 828 bp, Homo sapiens
ggaatttgctacatatactatatttaaaaagaggtgaagatgaactccagactactatgattgctcatgacattgaatttgataacttttaatttgcggataagaaattcttgtgaaatagctcaatctgtctatgtgttgtagaagtgagtggttggagacagtgagtaccaattcatttgatcacataatcgttcaacaaacacacaatgccaggttctgtactaggtactggggtgacttctatgatggctaacgtgaactgtggactctgctcttgtgggaaaggtagacagttgtaggaagggactcacaaatttctgggtgttacaaattccaaatactttgggatatatgaaagagaccacttacagagtatttactgggtgtcagtcactgtgctaaccacatcacattcattatcacgtttaactgtgagatctctataaaataggaattattattttcccttttaatggatgagaaacataacatcaaagtgtacagatcaggtgacttgttgcgtgtcagtggtaattggctacattggttgctcacagtgaaccatgtcttttatactcacactcgtatagtcactactccttgaatcaaggctggcccctgagattctaggggaggagagagagaggttcaattgagcccagatcccagccaactagccagctgaatgcagccacatgagcaaccaccagtaagatgaacggaacggtgccactgagccccgcccagattatggactcctgagcaaatacaatggtagttgtttataaccactgagttttgggtggtcagttacatagcaaaaaa

SEQ ID NO: 21463 - DNA, 574 bp, Homo sapiens
gctgggataacaggcatgagccactgcgcccggcccaaaacaatggtttttagatgttttcttgctggtctgctacacgttcttcttctgttcagtcagtgcatgtagtaataaataaaagctctgctcattgcttttgtttattttaagtactttttcacgtagtgcggtgtcatggcctcagataaatgtctacataatgcagtcaactttcccacaccttgggtgtcctctaagaaatgcagactacagaatcttgatcatatttatatatgattgtcctttggctctaaatttatcccattatcaggttggcttttattttgggaattctgtctgcatcagaaacatggctaaatgacttcaacttcaagttcaaacacttgaagttcaaaaacttcaagttcaaacacttcatttgttggcattttcatttttagcaagtgaatatctggcatgaattaactaaagtttagaagatctttgtttttcttcttccctccccacccccaaaaagaagaaaattcctaaagctttttgtaatttttatcacaaaataatagacttagtacag

SEQ ID NO: 21464 - DNA, 359 bp, Homo sapiens
cagtcaagataccaaaagctctagattaggagtggggaacgaggtccctgacccctctgctattcccttcttggtacaactccttagttctgcattcctgatttaagaaactgtgagcttcgccggccgggcgcggtggctcacgcctctaatcccagcactttgggaggccgaggcgggcggatcacaaggtcaggagattgagaccatcctggctaacacggtgaaaccctgtctctactaaaaatacaaaaaaattagccaggcgtgttggcgggcgcctgtagtcccagctgctggggaggctgaggcaggagaatggcgtgaacccggaaggcagagcttgcggtaagccgaga

SEQ ID NO: 21465 - DNA, 342 bp, Homo sapiens
tttttttatcaaatgtattttttaattgaggcatgcacattgttttttaggcataatgtattgcacacttaatattgactacagtatagtgtaaacataacatttatatgcactaagacacacaaaaaatcatctgactagctttactgcaatattcactttattgcaatggtctggaactgaatctgcaatatctccaaggtgtgcctgtataatctcaaccaagccaaaagcaatattacaaatatacttaaaaaaaaaaaaaacaaaaaaaaactgggcccagcatggtggtggctcacacctgtaatcctagcactttgggaggccaaggcgggtgga

SEQ ID NO: 21466 - DNA, 158 bp, Homo sapiens
cattctcacacagtatgaaactggtggtgtgtcttggagggaggaagccatgggctcgctctttttcccagaccatactcagctgttaaactctaccaattgctggctgattgctttattgttttcaacaatgttttggggcatagattgctgcccaa

SEQ ID NO: 21467 - DNA, 149 bp, Homo sapiens
aaacatttaaaaaatttttattctcataactctgtgaagttgctactattatcctcattttactgatgaggaaactaaggcaaagaggatctaagcgatctgaccaaggtgacataaatgtttacttttatgaccatgctgtgtctgct

SEQ ID NO: 21468 - DNA, 411 bp, Homo sapiens
gcgcctgtagtcccagctactcgggaggctgaggcaggagaatggcgtgaacctgggaggcggagcttgcagtgagccaagattgcgccactgcactccagcctgggcaacacagccagactccgtctcaaaaaaaaaaagaaaagaaaagcaattgataaagaaatttctctcccactatcaaaccttccattccatgtgtttctgtgctcccatattctgcctgccttcccaccacagtggatgaactgcccctttttatccaagaccaactcctctactgctctcctgtatcccatttcttaagcctaccttaaggattttactccttctgctctgtcttgaatggctgtttccctgtctactggatcattcctatcaatatccaacagctgttttctctcttatgtt

SEQ ID NO: 21469 - DNA, 553 bp, Homo sapiens
tttggcccctttccttcatcatctgccactgcagcttgtaatgctactaatcgaattatttctcattttagtcaagatgatcttactgctcttgtgcagatgacagaaaaagaacatggcgatagggttttttttggtaaaaatttagcattttcatttgacatgcatgatttggaccactttgacgaactgccaataaatggtgaaactcagaaaactataagcctagattataagaagtttctgaatgaacatctccaggaggcttgcaccccagaactcaagcctgtggaaaaaacaaatggctcctttttgtggtgtgaagttgaaaagtacctaaattcaactttgaaggaaatgactgaagtgccaagagtagaagatctttgctgtactttatatgatatgcttgcttctattaaaagtggtgatgaacttcaggatgaggtatagttgaaatgatttatttttttatattaatgtgaactatcctaatgaaatagtgttttttaaacatgggtggttagcaaagaaagttctttaatgttctgta

SEQ ID NO: 21470 - DNA, 416 bp, Homo sapiens
aaaaatgttgctgctaccacttattaaatacaagaagctggttaataaattgtataaacattacactttatctgctgcacgtgaatagacagagtactggtggttctcagcctttgttctaacatacttacacaaatctttttgaaagtaattttcttcctagaagaaataatataggtgggattggagagttggaagtttcattgccagttgagtctgcttgctttgataacctcattcccaaatttatttggaatgagagcagtttgatttctttctacacagtaactgcttattctgctccaatctgaaacggagctcttgtcacactgtggaccagaggtagcatcttagatagtgaacattatttcccaggagacagagaaaagcagtggacttgaagatgtcagctggtt

SEQ ID NO: 21471 - DNA, 730 bp, Homo sapiens
gagagagaccctccccaggccacttaggcaaagccatcagcatcatctggggtcccgtcttgacacctctacacactcatgtctgtgacaaaggaacataggtgatggcagggaagcccttaagaggcagaggctggtgggcttgcaatgggggccgcagggaagagggggaagggttaggggaacctcgaggtttccggagctccacggcagggcacagctgggaagaagatgggaccagcaccctccattggaggcagccaggaccctagaagttctcaaagggccaggatgaaaacagccggccaggcaggaggaagcgcaggcaggggccactgccaggccgaggcagatctgacggtcgcctgcctcggcctcaccttccatgcctcctcagggcctgtcaacagctgggaagatcagtgcacaaaggttgggctccatcaccagggaccctgatgcccagagaggccacgggtagagctggacatacctcagaccgcacccactcctccccactgggagacccatttggccctgggactccctgtcaagttcactttcccacctgtcagcaggtttagacaggcgcaccgatccccagacaaccagagcaaccagatcgccgcagacaacggggagccatcaggagctgaactaagcccagggtctgcgcccacagtccatggccgcaggagtcagatccccacccacaggacccccaggggcc

SEQ ID NO: 21472 - DNA, 186 bp, Homo sapiens
attggcatggttacttggagtaaattaaacagacattttggcaaaacctttagaacactcatttcaagcaaaatcttcacaacggtaaaagctaattttgtgtttctaactcttcttatttagactcaattgaaaaatatttagaattgaggatttttcccctcttggggcaagggaaggaaagag

SEQ ID NO: 21473 - DNA, 367 bp, Homo sapiens
atttagagcggttgaatgaaattgtattaaatatgtaaagaaatttaggtgtcattgacattatcttaatattgaattttcccatccagtaatatgaatcttttgaaaaggtggcttgagtaactggatttttctcgaagtttttgttttcttcacaagggttatatacatttcttaaattggtttctagatgtttttatattttttgttgcttttatgattaggatgtttttgttgcttagcaagttaatactggtgtattggaaggcaattgagttttttttgttactattgtttgtttttgatatggagtctctgtcgccactgtactccagcctgggagacagagtaagactcaaaactcaag

SEQ ID NO: 21474 - DNA, 3689 bp, Homo sapiens
aaacagtcacatccggggccgagaggaaccgcgaacgagctgggcgtgcgcccttgcttcgtgccctcaacccgcatggcggagccgctggcgcgccgcggagaggccgggcgagtcgggcggtttcggcgcccgcgctgagccgcggaggaggggcggaggacgcccctgcagccgatacgtgcttttcaacatgccttcagcactaatgactgctccaggaatgtctacattaagaagaatggctttactttacatcgaaaccccattgctcagagcactgatggtgcaaggaccaagattggtttcagtgagggccgccatgcatgggaagtgtggtgggagggccctctgggcactgtggcagtgattggaattgccacaaaacgggcccccatgcagtgccaaggttatgtggcattgctgggcagtgatgaccagagctggggctggaatctggtggacaataatctactacataatggagaagtcaatggcagttttccacagtgcaacaacgcaccaaaatatcagataggagaaagaattcgagtcatcttggacatggaagataagactttagcttttgaacgtggatatgagttcctgggggttgcttttagaggacttccaaaggtctgcttatacccagcagtttctgctgtatatggcaacacagaagtgactttggtttaccttggaaaacctttggacggatgacagtggctttcttgtgatgacagacagaatggaggagagatctgcttatgggaagtagaaccatgaagtgactgtcacacatgcatgtccaagaaacatcctgaaaacacatgaagtcgtaaactggagaagcagctctacagcagagattatcttcgtgtttcctctttctactgggccagaaaaatcctcagggttgcagttggttgagtgggcagttgacatatgcatgttgcacccgatgttgtctctaagttagcaatgtgttatttccagctttaaaggtgagattgtagagatgctgtcaaagggataaggaaatagcaagatttttaagtagtgtgtttgtgaagactgatcccattttacaactgcctgttctttctccagtccttttttttccagccagcttgactattagaaaagtatgaaactggttgggttttatttaatatttttaatatattgagaagcatggtctgcctggactgcacttctctaaaagtgagatataaaattgtgcagctattttaaaagttgtatataatatgtgtgtaaaaaaaaaaaactgtaaaaaagaaaggacaaacaggttgttttgttctagttctaatttcttaaaaaccactacatggttacaaaattggaataacatttggggacaactgggttaactacaaagaagaggattttaagaggagatgtgttgtattgactcattttgtattatttttggcttacagttcccatagctgttagagtctggtttgtttttgtttttactctcaaaatcatagtaaagatctctcagtctcctggctaaagattgaaggaaggcaaatctatttctaattatacatatatcagtaaggatgatctcaacataatagtaatgtgtatcttttggtatccagttttatttttggccttctaagaaagtgtctcataacacagaacattgccatttgctcttgtaggcctcaaatatgaaagctattagtcatagagcctaggaaaaaaagaattgattaatggtccttttattttgtaaccttataaatgctgtagatattatcaaaaaaattttaatttcatattgtttacatcatgcaactaatctaagcctcaaactcgttattggggctataaagaaaacgtttacttacccagctgaaacaggttaagaatattcttaatctcattatagataattgcccccatgggacttgaaatacaacaccttgtgctgaaaacttcaggttggcaatatttgaaggtttcgttgtagaagagtttaacattaactcctattttgacttacaaatcttgtttctcatcactaaaatgcttttgaattaataatccaacccacatgagctgagagtttttcttttgttagaaaagaaacagacatctttctgtatgaaagtataaattgtatggttttagatacataagaattgacaaaagcgagcgaaatctttgtacttctgagttcttgctgtatgtatgttttgttttaaatctgattagggacacccagcagctggccgggattcttggattgctccttgggagttaagattgtcaatactcctgtgaagcaagggatttcagccatagaacaaagatttattgttgccacctgaaaagtttacaagtatttattgtgtatttgatacattgcttgaaaagatgaaatctgttaaagattcttttcgatgtccaggttaagaagaaacctccttgtattgagtgaaattatatgttaaatgtattagagaatgtaggtggtatagaaattgatttttcttggtgtagaacaactcagttcggcaaagtttaaaatttgattaaacaagagaagtggttcaggttgaagatggacttgttaggaagtgatcaagtcctttaagtacttgtttctttttcaggttgtgatgtggccattccgaattttgttgagagtttggtttataattgtctcttttgtcttgttagtaaacattcatttgcaacagttttgaaggtgctgagtggaaaaccgaaacacatggttattgcgtattggacctagaatgaaataattgcctcaatatttaacaacaagccattcttatctcaaagatttaaattcccgaatgtcccattcgcaaatcatatgcaattgaagtgagcagcatgagcatctgggtcatgagggccttcatttacgtaaatttgtcactaaaacccagtagtagctctacaaaatcttaaactgctgcagtgctcaaggagatggaatatctttgtcattggtgctgaggagagcatttcggtagaagacagttgcgcctgaagattgagtgtaaatcattcaaaccagtggttctcagtgttggctgtatacactttgtagtcactttggaatgttggaagacacatcgatgcttgggttccgtatgccaagattctgatgttggtctggaatatgagctggtcataaggatttttaaaaactttctggtcatttcaatatgctgccaaggttgagaaccactgttgtaaaattcaccttgagttttctcatctgcaaaatagaaaaaaaaaaatccttgctccctcccttcactacctcacaaggatattgagggtaaaggagaaaataatgggaaagtgcttgtgccgtggatgaaaagtgctattaaaagtcaaaggagtgttctgtttcaattcatagtatgatcagggaaagtgtaactgagtatactttgttgacttgggaaacctggagcactttctttggttggttaacgaagcatgcagatgtggaagcagacgttactattatccctactatggtcttctgtcatactgagacaggctgttttaattacctggttttacataggaaagaagaaatattaaggcttaaagtttgtaatgatcaatggctcataattcattaaatcttttcatacaaggaa

SEQ ID NO: 21475 - DNA, 3528 bp, Homo sapiens
ttacctaggctggagtgcagtgggcagtggtgcgataccagctttggccaccacgcccagctaattttttgtatttttactagagttggggtttcgccatgttgcccaggctagtcttgaactccgagttcaggcgatttgcccaccttgccttcccaaagtgctgggattgcaggggtgagccaccgcgcccggcccgatcccctcctttttttatagatgtttcttcctgactagaaagcttcccttctgatttttctagatagctttcaggataatattcttaatattttcaacttcttgatttgtgtcttgtttcttctagctacacccttggcagattttcttctaaccttttgatatctgtttgcagataggagaaagaattcgagtcatcttggacatggaagataagactttagcttttgaacgtggatatgagttcctgggggttgcttttagaggacttccaaaggtctgcttatacccagcagtttctgctgtatatggcaacacagaagtgactttggtttaccttggaaaacctttggacggatgacagtggctttcttgtgatgacagacagaatggaggagagatctgcttatgggaagtagaaccatgaagtgactgtcacacatgcatgtccaagaaacatcctgaaaacacatgaagtcgtaaactggagaagcagctctacagcagagattatcttcgtgtttcctctttctactgggccagaaaaatcctcagggttgcagttggttgagtgggcagttgacatatgcatgttgcacccgatgttgtctctaagttagcaatgtgttatttccagctttaaaggtgagattgtagagatgctgtcaaagggataaggaaatagcaagatttttaagtagtgtgtttgtgaagactgatcccattttacaactgcctgttctttctccagtccttttttttccagccagcttgactattagaaaagtatgaaactggttgggttttatttaatatttttaatatattgagaagcatggtctgcctggactgcacttctctaaaagtgagatataaaattgtgcagctattttaaaagttgtatataatatgtgtgtaaaaaaaaaaaactgtaaaaaagaaaggacaaacaggttgttttgttctagttctaatttcttaaaaaccactacatggttacaaaattggaataacatttggggacaactgggttaactacaaagaagaggattttaagaggagatgtgttgtattgactcattttgtattatttttggcttacagttcccatagctgttagagtctggtttgtttttgtttttactctcaaaatcatagtaaagatctctcagtctcctggctaaagattgaaggaaggcaaatctatttctaattatacatatatcagtaaggatgatctcaacataatagtaatgtgtatcttttggtatccagttttatttttggccttctaagaaagtgtctcataacacagaacattgccatttgctcttgtaggcctcaaatatgaaagctattagtcatagagcctaggaaaaaaagaattgattaatggtccttttattttgtaaccttataaatgctgtagatattatcaaaaaaattttaatttcatattgtttacatcatgcaactaatctaagcctcaaactcgttattggggctataaagaaaacgtttacttacccagctgaaacaggttaagaatattcttaatctcattatagataattgcccccatgggacttgaaatacaacaccttgtgctgaaaacttcaggttggcaatatttgaaggtttcgttgtagaagagtttaacattaactcctattttgacttacaaatcttgtttctcatcactaaaatgcttttgaattaataatccaacccacatgagctgagagtttttcttttgttagaaaagaaacagacatctttctgtatgaaagtataaattgtatggttttagatacataagaattgacaaaagcgagcgaaatctttgtacttctgagttcttgctgtatgtatgttttgttttaaatctgattagggacacccagcagctggccgggattcttggattgctccttgggagttaagattgtcaatactcctgtgaagcaagggatttcagccatagaacaaagatttattgttgccacctgaaaagtttacaagtatttattgtgtatttgatacattgcttgaaaagatgaaatctgttaaagattcttttcgatgtccaggttaagaagaaacctccttgtattgagtgaaattatatgttaaatgtattagagaatgtaggtggtatagaaattgatttttcttggtgtagaacaactcagttcggcaaagtttaaaatttgattaaacaagagaagtggttcaggttgaagatggacttgttaggaagtgatcaagtcctttaagtacttgtttctttttcaggttgtgatgtggccattccgaattttgttgagagtttggtttataattgtctcttttgtcttgttagtaaacattcatttgcaacagttttgaaggtgctgagtggaaaaccgaaacacatggttattgcgtattggacctagaatgaaataattgcctcaatatttaacaacaagccattcttatctcaaagatttaaattcccgaatgtcccattcgcaaatcatatgcaattgaagtgagcagcatgagcatctgggtcatgagggccttcatttacgtaaatttgtcactaaaacccagtagtagctctacaaaatcttaaactgctgcagtgctcaaggagatggaatatctttgtcattggtgctgaggagagcatttcggtagaagacagttgcgcctgaagattgagtgtaaatcattcaaaccagtggttctcagtgttggctgtatacactttgtagtcactttggaatgttggaagacacatcgatgcttgggttccgtatgccaagattctgatgttggtctggaatatgagctggtcataaggatttttaaaaactttctggtcatttcaatatgctgccaaggttgagaaccactgttgtaaaattcaccttgagttttctcatctgcaaaatagaaaaaaaaaaatccttgctccctcccttcactacctcacaaggatattgagggtaaaggagaaaataatgggaaagtgcttgtgccgtggatgaaaagtgctattaaaagtcaaaggagtgttctgtttcaattcatagtatgatcagggaaagtgtaactgagtatactttgttgacttgggaaacctggagcactttctttggttggttaacgaagcatgcagatgtggaagcagacgttactattatccctactatggtcttctgtcatactgagacaggctgttttaattacctggttttacataggaaagaagaaatattaaggcttaaagtttgtaatgatcaatggctcataattcattaaatcttttcatacaaggaa

SEQ ID NO: 21476 - DNA, 4680 bp, Homo sapiens
aaacagtcacatccggggccgagaggaaccgcgaacgagctgggcgtgcgcccttgcttcgtgccctcaacccgcatggcggagccgctggcgcgccgcggagaggccgggcgagtcgggcggtttcggcgcccgcgctgagccgcggaggaggggcggaggacgcccctgcagccggtgcgtctgccctcagtgaggcggggcgcgcggcggacgcccccgggcaggggcgggagtggtggaggcgccggcggttggcactgacaggggcggtgagcgagccgctccggtctccgggcgaggcttggccttccgagcagagacggcgggaagcggcggcggcagcggcggccctagggccggctggtgaggcgatggcggcgccggccccgggggctggggcagcctcgggcggcgctggctgtagcggcggcggcgcgggcgcgggcgcgggctcgggctctggggccgcgggggccgggggccggctgcccagccgggtgctggagttggtgttctcttacctggagctgtccgagctgcggagctgcgccctggtgtgcaagcactggtaccgctgcctgcacggcgatgagaacagcgaggtgtggcggagcctgtgcgcccgcagcctggcagaagaggctctgcgcacggacatcctgtgcaacctgcccagctacaaggccaagatacgtgcttttcaacatgccttcagcactaatgactgctccaggaatgtctacattaagaagaatggctttactttacatcgaaaccccattgctcagagcactgatggtgcaaggaccaagattggtttcagtgagggccgccatgcatgggaagtgtggtgggagggccctctgggcactgtggcagtgattggaattgccacaaaacgggcccccatgcagtgccaaggttatgtggcattgctgggcagtgatgaccagagctggggctggaatctggtggacaataatctactacataatggagaagtcaatggcagttttccacagtgcaacaacgcaccaaaatatcagataggagaaagaattcgagtcatcttggacatggaagataagactttagcttttgaacgtggatatgagttcctgggggttgcttttagaggacttccaaaggtctgcttatacccagcagtttctgctgtatatggcaacacagaagtgactttggtttaccttggaaaacctttggacggatgacagtggctttcttgtgatgacagacagaatggaggagagatctgcttatgggaagtagaaccatgaagtgactgtcacacatgcatgtccaagaaacatcctgaaaacacatgaagtcgtaaactggagaagcagctctacagcagagattatcttcgtgtttcctctttctactgggccagaaaaatcctcagggttgcagttggttgagtgggcagttgacatatgcatgttgcacccgatgttgtctctaagttagcaatgtgttatttccagctttaaaggtgagattgtagagatgctgtcaaagggataaggaaatagcaagatttttaagtagtgtgtttgtgaagactgatcccattttacaactgcctgttctttctccagtccttttttttccagccagcttgactattagaaaagtatgaaactggttgggttttatttaatatttttaatatattgagaagcatggtctgcctggactgcacttctctaaaagtgagatataaaattgtgcagctattttaaaagttgtatataatatgtgtgtaaaaaaaaaaaactgtaaaaaagaaaggacaaacaggttgttttgttctagttctaatttcttaaaaaccactacatggttacaaaattggaataacatttggggacaactgggttaactacaaagaagaggattttaagaggagatgtgttgtattgactcattttgtattatttttggcttacagttcccatagctgttagagtctggtttgtttttgtttttactctcaaaatcatagtaaagatctctcagtctcctggctaaagattgaaggaaggcaaatctatttctaattatacatatatcagtaaggatgatctcaacataatagtaatgtgtatcttttggtatccagttttatttttggccttctaagaaagtgtctcataacacagaacattgccatttgctcttgtaggcctcaaatatgaaagctattagtcatagagcctaggaaaaaaagaattgattaatggtccttttattttgtaaccttataaatgctgtagatattatcaaaaaaattttaatttcatattgtttacatcatgcaactaatctaagcctcaaactcgttattggggctataaagaaaacgtttacttacccagctgaaacaggttaagaatattcttaatctcattatagataattgcccccatgggacttgaaatacaacaccttgtgctgaaaacttcaggttggcaatatttgaaggtttcgttgtagaagagtttaacattaactcctattttgacttacaaatcttgtttctcatcactaaaatgcttttgaattaataatccaacccacatgagctgagagtttttcttttgttagaaaagaaacagacatctttctgtatgaaagtataaattgtatggttttagatacataagaattgacaaaagcgagcgaaatctttgtacttctgagttcttgctgtatgtatgttttgttttaaatctgattagggacacccagcagctggccgggattcttggattgctccttgggagttaagattgtcaatactcctgtgaagcaagggatttcagccatagaacaaagatttattgttgccacctgaaaagtttacaagtatttattgtgtatttgatacattgcttgaaaagatgaaatctgttaaagattcttttcgatgtccaggttaagaagaaacctccttgtattgagtgaaattatatgttaaatgtattagagaatgtaggtggtatagaaattgatttttcttggtgtagaacaactcagttcggcaaagtttaaaatttgattaaacaagagaagtggttcaggttgaagatggacttgttaggaagtgatcaagtcctttaagtacttgtttctttttcaggttgtgatgtggccattccgaattttgttgagagtttggtttataattgtctcttttgtcttgttagtaaacattcatttgcaacagttttgaaggtgctgagtggaaaaccgaaacacatggttattgcgtattggacctagaatgaaataattgcctcaatatttaacaacaagccattcttatctcaaagatttaaattcccgaatgtcccattcgcaaatcatatgcaattgaagtgagcagcatgagcatctgggtcatgagggccttcatttacgtaaatttgtcactaaaacccagtagtagctctacaaaatcttaaactgctgcagtgctcaaggagatggaatatctttgtcattggtgctgaggagagcatttcggtagaagacagttgcgcctgaagattgagtgtaaatcattcaaaccagtggttctcagtgttggctgtatacactttgtagtcactttggaatgttggaagacacatcgatgcttgggttccgtatgccaagattctgatgttggtctggaatatgagctggtcataaggatttttaaaaactttctggtcatttcaatatgctgccaaggttgagaaccactgttgtaaaattcaccttgagttttctcatctgcaaaatagaaaaaaaaaaatccttgctccctcccttcactacctcacaaggatattgagggtaaaggagaaaataatgggaaagtgcttgtgccgtggatgaaaagtgctattaaaagtcaaaggagtgttctgtttcaattcatagtatgatcagggaaagtgtaactgagtatactttgttgacttgggaaacctggagcactttctttggttggttaacgaagcatgcagatgtggaagcagacgttactattatccctactatggtcttctgtcatactgagacaggctgttttaattacctggttttacataggaaagaagaaatattaaggcttaaagtttgtaatgatcaatggctcataattcattaaatcttttcatacaaggaaaaaaaaaaaaaaaaaaaaaaaaaaaaaaaaaaaaaaaaaaaaaaaaaaaaaaaaaaaaaaaaaaaaaagaaaacaaaaaaaaaaaaacaaacagaaagagacaaaaacacaaaaccaacccaacaaaaacaaaaacacacaacgagcgcggcgcgccggcccgcacctcccccggcggcgccaccgcccacccccgctacacggcccgcccccctcggctcttgtagactaacacaagtccacatccggttgttagatgcgggtataaagataaacaacaaacgctggggcgacacaagaacgcaagccgccggtcgatctttaatctccttatattgggaaccccaccatcccctcactccagaggcgacgacaacaaacgacccgccaccacccccactgccaatcattgtctacattccttcaagacactccgcgtcgcgcttactccatacgatcctacaaaaatcaaacca

SEQ ID NO: 21477 - DNA, 4204 bp, Homo sapiens
aaacagtcacatccggggccgagaggaaccgcgaacgagctgggcgtgcgcccttgcttcgtgccctcaacccgcatggcggagccgctggcgcgccgcggagaggccgggcgagtcgggcggtttcggcgcccgcgctgagccgcggaggaggggcggaggacgcccctgcagccggtgcgtctgccctcagtgaggcggggcgcgcggcggacgcccccgggcaggggcgggagtggtggaggcgccggcggttggcactgacaggggcggtgagcgagccgctccggtctccgggcgaggcttggccttccgagcagagacggcgggaagcggcggcggcagcggcggccctagggccggctggtgaggcgatggcggcgccggccccgggggctggggcagcctcgggcggcgctggctgtagcggcggcggcgcgggcgcgggcgcgggctcgggctctggggccgcgggggccgggggccggctgcccagccgggtgctggagttggtgttctcttacctggagctgtccgagctgcggagctgcgccctggtgtgcaagcactggtaccgctgcctgcacggcgatgagaacagcgaggtgtggcggagcctgtgcgcccgcagcctggcagaagaggctctgcgcacggacatcctgtgcaacctgcccagctacaaggccaagatacgtgcttttcaacatgccttcagcactaatgactgctccaggaatgtctacattaagaagaatggctttactttacatcgaaaccccattgctcagagcactgatggtgcaaggaccaagattggtttcagtgagggccgccatgcatgggaagtgtggtgggagggccctctgggcactgtggcagtgattggaattgccacaaaacgggcccccatgcagtgccaaggttatgtggcattgctgggcagtgatgaccagagctggggctggaatctggtggacaataatctactacataatggagaagtcaatggcagttttccacagtgcaacaacgcaccaaaatatcagataggagaaagaattcgagtcatcttggacatggaagataagactttagcttttgaacgtggatatgagttcctgggggttgcttttagaggacttccaaaggtctgcttatacccagcagtttctgctgtatatggcaacacagaagtgactttggtttaccttggaaaacctttggacggatgacagtggctttcttgtgatgacagacagaatggaggagagatctgcttatgggaagtagaaccatgaagtgactgtcacacatgcatgtccaagaaacatcctgaaaacacatgaagtcgtaaactggagaagcagctctacagcagagattatcttcgtgtttcctctttctactgggccagaaaaatcctcagggttgcagttggttgagtgggcagttgacatatgcatgttgcacccgatgttgtctctaagttagcaatgtgttatttccagctttaaaggtgagattgtagagatgctgtcaaagggataaggaaatagcaagatttttaagtagtgtgtttgtgaagactgatcccattttacaactgcctgttctttctccagtccttttttttccagccagcttgactattagaaaagtatgaaactggttgggttttatttaatatttttaatatattgagaagcatggtctgcctggactgcacttctctaaaagtgagatataaaattgtgcagctattttaaaagttgtatataatatgtgtgtaaaaaaaaaaaactgtaaaaaagaaaggacaaacaggttgttttgttctagttctaatttcttaaaaaccactacatggttacaaaattggaataacatttggggacaactgggttaactacaaagaagaggattttaagaggagatgtgttgtattgactcattttgtattatttttggcttacagttcccatagctgttagagtctggtttgtttttgtttttactctcaaaatcatagtaaagatctctcagtctcctggctaaagattgaaggaaggcaaatctatttctaattatacatatatcagtaaggatgatctcaacataatagtaatgtgtatcttttggtatccagttttatttttggccttctaagaaagtgtctcataacacagaacattgccatttgctcttgtaggcctcaaatatgaaagctattagtcatagagcctaggaaaaaaagaattgattaatggtccttttattttgtaaccttataaatgctgtagatattatcaaaaaaattttaatttcatattgtttacatcatgcaactaatctaagcctcaaactcgttattggggctataaagaaaacgtttacttacccagctgaaacaggttaagaatattcttaatctcattatagataattgcccccatgggacttgaaatacaacaccttgtgctgaaaacttcaggttggcaatatttgaaggtttcgttgtagaagagtttaacattaactcctattttgacttacaaatcttgtttctcatcactaaaatgcttttgaattaataatccaacccacatgagctgagagtttttcttttgttagaaaagaaacagacatctttctgtatgaaagtataaattgtatggttttagatacataagaattgacaaaagcgagcgaaatctttgtacttctgagttcttgctgtatgtatgttttgttttaaatctgattagggacacccagcagctggccgggattcttggattgctccttgggagttaagattgtcaatactcctgtgaagcaagggatttcagccatagaacaaagatttattgttgccacctgaaaagtttacaagtatttattgtgtatttgatacattgcttgaaaagatgaaatctgttaaagattcttttcgatgtccaggttaagaagaaacctccttgtattgagtgaaattatatgttaaatgtattagagaatgtaggtggtatagaaattgatttttcttggtgtagaacaactcagttcggcaaagtttaaaatttgattaaacaagagaagtggttcaggttgaagatggacttgttaggaagtgatcaagtcctttaagtacttgtttctttttcaggttgtgatgtggccattccgaattttgttgagagtttggtttataattgtctcttttgtcttgttagtaaacattcatttgcaacagttttgaaggtgctgagtggaaaaccgaaacacatggttattgcgtattggacctagaatgaaataattgcctcaatatttaacaacaagccattcttatctcaaagatttaaattcccgaatgtcccattcgcaaatcatatgcaattgaagtgagcagcatgagcatctgggtcatgagggccttcatttacgtaaatttgtcactaaaacccagtagtagctctacaaaatcttaaactgctgcagtgctcaaggagatggaatatctttgtcattggtgctgaggagagcatttcggtagaagacagttgcgcctgaagattgagtgtaaatcattcaaaccagtggttctcagtgttggctgtatacactttgtagtcactttggaatgttggaagacacatcgatgcttgggttccgtatgccaagattctgatgttggtctggaatatgagctggtcataaggatttttaaaaactttctggtcatttcaatatgctgccaaggttgagaaccactgttgtaaaattcaccttgagttttctcatctgcaaaatagaaaaaaaaaaatccttgctccctcccttcactacctcacaaggatattgagggtaaaggagaaaataatgggaaagtgcttgtgccgtggatgaaaagtgctattaaaagtcaaaggagtgttctgtttcaattcatagtatgatcagggaaagtgtaactgagtatactttgttgacttgggaaacctggagcactttctttggttggttaacgaagcatgcagatgtggaagcagacgttactattatccctactatggtcttctgtcatactgagacaggctgttttaattacctggttttacataggaaagaagaaatattaaggcttaaagtttgtaatgatcaatggctcataattcattaaatcttttcatacaaggaa

SEQ ID NO: 21478 - DNA, 4150 bp, Homo sapiens
aaacagtcacatccggggccgagaggaaccgcgaacgagctgggcgtgcgcccttgcttcgtgccctcaacccgcatggcggagccgctggcgcgccgcggagaggccgggcgagtcgggcggtttcggcgcccgcgctgagccgcggaggaggggcggaggacgcccctgcagccggtgcgtctgccctcagtgaggcggggcgcgcggcggacgcccccgggcaggggcgggagtggtggaggcgccggcggttggcactgacaggggcggtgagcgagccgctccggtctccgggcgaggcttggccttccgagcagagacggcgggaagcggcggcggcagcggcggccctagggccggctggtgaggcgatggcggcgccggccccgggggctggggcagcctcgggcggcgctggctgtagcggcggcggcgcgggcgcgggcgcgggctcgggctctggggccgcgggggccgggggccggctgcccagccgggtgctggagttggtgttctcttacctggagctgtccgagctgcggagctgcgccctggtgtgcaagcactggtaccgctgcctgcacggcgatgagaacagcgaggtgtggcggagcctgtgcgcccgcagcctggcagaagaggctctgcgcacggacatcctgtgcaacctgcccagctacaaggccaagatacgtgcttttcaacatgccttcagcactaatgactgctccaggaatgtctacattaagaagaatggctttactttacatcgaaaccccattgctcagagcactgatggtgcaaggaccaagattggtttcagtgagggccgccatgcatgggaagtgtggtgggagggccctctgggcactgtggcagtgattggaattgccacaaaacgggcccccatgcagtgccaaggttatgtggcattgctgggcagtgatgaccagagctggggctggaatctggtggacaataatctactacataatggagaagtcaatggcagttttccacagtgcaacaacgcaccaaaatatcagataggagaaagaattcgagtcatcttggacatggaagataagactttagcttttgaacgtggatatgagttcctgggggttgcttttagaggacttccaaaggtctgcttatacccagcagtttctgctgtatatggcaacacagaagtgactttggtttaccttggaaaacctttggacggatgacagtggctttcttgtgatgacagacagaatggaggagagatctgcttatgggaagtagaaccatgaagtgactgtcacacatgcatgtccaagaaacatcctgaaaacacatgaagtcgtaaactggagaagcagctctacagcagagattatcttcgtgtttcctctttctactgggccagaaaaatcctcagggttgcagttggttgagtgggcagttgacatatgcatgttgcacccgatgttgtctctaagttagcaatgtgttatttccagctttaaaggtgagattgtagagatgctgtcaaagggataaggaaatagcaagatttttaagtagtgtgtttgtgaagactgatcccattttacaactgcctgttctttctccagtccttttttttccagccagcttgactattagaaaagtatgaaactggttgggttttatttaatatttttaatatattgagaagcatggtctgcctggactgcacttctctaaaagtgagatataaaattgtgcagctattttaaaagttgtatataatatgtgtgtaaaaaaaaaaaactgtaaaaaagaaaggacaaacaggttgttttgttctagttctaatttcttaaaaaccactacatggttacaaaattggaataacatttggggacaactgggttaactacaaagaagaggattttaagaggagatgtgttgtattgactcattttgtattatttttggcttacagttcccatagctgttagagtctggtttgtttttgtttttactctcaaaatcatagtaaagatctctcagtctcctggctaaagattgaaggaaggcaaatctatttctaattatacatatatcagtaaggatgatctcaacataatagtaatgtgtatcttttggtatccagttttatttttggccttctaagaaagtgtctcataacacagaacattgccatttgctcttgtaggcctcaaatatgaaagctattagtcatagagcctaggaaaaaaagaattgattaatggtccttttattttgtaaccttataaatgctgtagatattatcaaaaaaattttaatttcatattgtttacatcatgcaactaatctaagcctcaaactcgttattggggctataaagaaaacgtttacttacccagctgaaacaggttaagaatattcttaatctcattatagataattgcccccatgggacttgaaatacaacaccttgtgctgaaaacttcaggttggcaatatttgaaggtttcgttgtagaagagtttaacattaactcctattttgacttacaaatcttgtttctcatcactaaaatgcttttgaattaataatccaacccacatgagctgagagtttttcttttgttagaaaagaaacagacatctttctgtatgaaagtataaattgtatggttttagatacataagaattgacaaaagcgagcgaaatctttgtacttctgagttcttgctgtatgtatgttttgttttaaatctgattagggacacccagcagctggccgggattcttggattgctccttgggagttaagattgtcaatactcctgtgaagcaagggatttcagccatagaacaaagatttattgttgccacctgaaaagtttacaagtatttattgtgtatttgatacattgcttgaaaagatgaaatctgttaaagattcttttcgatgtccaggttaagaagaaacctccttgtattgagtgaaattatatgttaaatgtattagagaatgtaggtggtatagaaattgatttttcttggtgtagaacaactcagttcggcaaagtttaaaatttgattaaacaagagaagtggttcaggttgaagatggacttgttaggaagtgatcaagtcctttaagtacttgtttctttttcaggttgtgatgtggccattccgaattttgttgagagtttggtttataattgtctcttttgtcttgttagtaaacattcatttgcaacagttttgaaggtgctgagtggaaaaccgaaacacatggttattgcgtattggacctagaatgaaataattgcctcaatatttaacaacaagccattcttatctcaaagatttaaattcccgaatgtcccattcgcaaatcatatgcaattgaagtgagcagcatgagcatctgggtcatgagggccttcatttacgtaaatttgtcactaaaacccagtagtagctctacaaaatgagagcatttcggtagaagacagttgcgcctgaagattgagtgtaaatcattcaaaccagtggttctcagtgttggctgtatacactttgtagtcactttggaatgttggaagacacatcgatgcttgggttccgtatgccaagattctgatgttggtctggaatatgagctggtcataaggatttttaaaaactttctggtcatttcaatatgctgccaaggttgagaaccactgttgtaaaattcaccttgagttttctcatctgcaaaatagaaaaaaaaaaatccttgctccctcccttcactacctcacaaggatattgagggtaaaggagaaaataatgggaaagtgcttgtgccgtggatgaaaagtgctattaaaagtcaaaggagtgttctgtttcaattcatagtatgatcagggaaagtgtaactgagtatactttgttgacttgggaaacctggagcactttctttggttggttaacgaagcatgcagatgtggaagcagacgttactattatccctactatggtcttctgtcatactgagacaggctgttttaattacctggttttacataggaaagaagaaatattaaggcttaaagtttgtaatgatcaatggctcataattcattaaatcttttcatacaaggaa

SEQ ID NO: 21479 - DNA, 406 bp, Homo sapiens
gagacggagtcttgctctgtcaccaggctggagtgtagtggcgcaatctcagctcactgcaccctccgcctcctgagttcaagcaattctcctgcctcagcctcccaagtagctgggactacaggcacgcaccactacgcctagctaatttttgtatttttagtagagatgggttttcaccatgttggccaggatggtcttgatctcttgaccttgtgatccacccgcctcagcctcccaaagtgctggaattacattctctgtctttaattagggaggagagggtagagtgtttcacaagctgttatattaagtcagagatctatcatgtgcaagtgtcagaaacccaactcaaaacggctcaatgcccaactcagagtggtttccctaagggggaagtcctatc

SEQ ID NO: 21480 - DNA, 378 bp, Homo sapiens
aagcaagccctttaaaccccatccctatttttttttaggctgttttatatgacaccctatctcccagatgggaatttgaaactcccttcccaaatgttttgtcctatatggcatcaaatatcccattaaactttaaataaaagaaattgggtaaccaacacctaaccagcgattcccattgtgaagaactacctcattgggcatatctatattttgaaatcagatgtggctatgttaatcagactttaagcatgagagccccttatctataaagaaaaaattatggtcatgctgcagttttttattttttgtatcacacagggtaaacttgtttatcacatttactgtataactaataataaagtctaacttcaaatc

SEQ ID NO: 21481 - DNA, 406 bp, Homo sapiens
gccgttcattcttcaaatattttttctctcttcagcgttccctcccttctctcctgcctgcaggctcgtgagtgtgaagactgctcaatcttctgtgggtcactgggctttgtccagtgtttcctttctgttctagttgaatggcccctgccctttctccttccatctccagtcctctgttaagtgaattcattttcaatctggtactttccaattctagtatttgtgtttggctgggatttctttacaggtttcatttctctgctgagattcacctctgttcactcattaagatcacctgtttttaacagcttcatggagatctagtctgcacagcctctccccgtggacagatagtgggttttcatgtattcagggttctgcaaccatctgcacacgtgtggaa

SEQ ID NO: 21482 - DNA, 562 bp, Homo sapiens
gtaactgacagtggttaagttcattagagcaaatgaagttgaccattgatgcctgtggttcagtaatacctgattaagatatttttccacaaaaaaactgcaccagacttcaaacatcctacattttctcagactttgtaaaatagtccaactaagtatttttctactttaccatcatcagttgtgacatatcttagcagattacacttcaggttgtactaaaatagtttttctcagctgctttgagaatattcttgcctctagttgttccacatagattatttatagagggtaacttttcagtcacttcgaatgaggattggctccccaaataacaagtattggtaatacctgtcatcgagagccaaggaacaccactcagaaccatttggcttgttttttaattgtttactaattttgctcccagtgttctcaactcttcaagcaccgtttttacagaaaggctaatggcgtttaaaagtttattgtctcggctggggtggtggctcacgcctgtaatcccagcactttgggaggccaaggcaggcagatcacgaggtca

SEQ ID NO: 21483 - DNA, 264 bp, Homo sapiens
actggggcaggcaggatcgcagccctagtttccctcacaccacgcacttatctgctccatctacttatttccatttacatatatttatattacagcctttcctcacacagtgaaatttacatcggaagcatgtgtttccatgcttttttttttttttttttaattatcattgtgaatcagactttaaaaaatgggcggttggaaggggacctgttggggagatggggctggcagaggtagccctaggcagctggggaggggcct

SEQ ID NO: 21484 - DNA, 494 bp, Homo sapiens
aagataatagtgctttattgtctctcagtcatctttctctcccacctgctggaaggagagacaagtccaatttatccaattacaaaatagcaacattggcatcatgagatcagctaacaaaactttcagaggcaatctatcttcctaccaaaagtaaccaacatctgtggagcacttaccatgactaagggtcaacataagtggtttgcatgctgcatgcatcaggatggactaggttatgctgcagtaacaaattaaccacagagactcagcagcttagcaaccaaggttgatttcttacattccatccccactaaacctagtgggtcacatctggtgtttcactttggggatgttttagtggtcatggtagattgttgtctgactgctggctgtttctaccatgtttcaggaatatagagatgtgtacagatgacccctaaaattaattagtatgcaattctcaaagagacaaactgtatcccagaagctac

SEQ ID NO: 21485 - DNA, 346 bp, Homo sapiens
tgagacagggcttctctgttgcccatgctggagtgcagtggcatgatcacagctcactgcagccttgacctctgcaggttcccaagtagctgggaccacaggtacatgccaccatgtccagctttttgtatttttgtcaagatggggttttgactttgccatgttgcccaggctgttatacaactcctgggttcgagaaatctacctgcttcagcctcccaaagtgctgggattacaagcgtaagccaccgtgcctggccctgtgcaggtttttaacttgatgtaatcccattcgttcatttttgctttggttgcctgtgcttgtagggcattattcaaaaaatct

SEQ ID NO: 21486 - DNA, 813 bp, Homo sapiens
gcgatctagaactagtctgagaaggacttggtggataaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcaggtttctgtgcccctgtggtggaagagggcacgacagtgccagcgcagcgttctgggctcctcagtcgcaggggtgggatgtgagtcatgcggattatccactcgccacagttatcagctgccattgctccctgtctgtttccccactctcttatttgtgcattcggtttggtttctgtagttttaatttttaataaagttgaataaaatataaa

SEQ ID NO: 21487 - DNA, 468 bp, Homo sapiens
caagtaacttgtctcagtttacacgcacagcttgtacagcagagatttgaagccccttaatcggcctctccacccctggatattttcctcccataaatggaggtgatggtgtctgaaagtgcactgtaactggggcgctctggaaacagcctgttctcacaccactgatggctcactggacacttcctccttgcaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgttt

SEQ ID NO: 21488 - DNA, 1155 bp, Homo sapiens
cggggcgggccgccggctgccagcccagggcggggcggagccctacttctggccgaccgcgtaggcggtgcttgaacttagggctgcttgtggctgggcactcgcgcagaggccggcccgacgagccatggttgctgggagcgacgcggggcgggccctgggggtcctcagcgtggtctgcctgctgcactgctttggtttcatcagctgtttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctcttccatctcccacactaacttgtgcattgactaatggaagcattgaagtccaatgcatgataccagagcattacaacagccatcgaggacttataatgtactcatgggattgtcctatggagcaatgtaaacgtaactcaaccagtatatattttaagatggaaaatgatcttccacaaaaaatacagtgtactcttagcaatccattatttaatacaacatcatcaatcattttgacaacctgtatcccaagcagcggtcattcaagacacagatatgcacttatacccataccattagcagtaattacaacatgtattgtgctgtatatgaatggtattctgaaatgtgacagaaaaccagacagaaccaactccaattgattggtaacagaagatgaagacaacagcataactaaattattttaaaaactaaaaagccatctgatttctcatttgagtattacaatttttgaacaactgttggaaatgtaacttgaagcagctgctttaagaagaaatacccactaacaaagaacaagcattagttttggctgtcatcaacttattatatgactaggtgcttgctttttttgtcagtaaattgtttttactgatgatgtagatacttttgtaaataaatgtaaatatgtacacaa

SEQ ID NO: 21489 - DNA, 3292 bp, Homo sapiens
  misc_feature (1386)..(1386): n is a, c, g, or t
ctctaatgttactttgtctttgtggtgaggagtggttttccaaaaggactttctcagtatttgctccaccctcagatttagatcttctttttgtgcctgtaccacagagacaacttctttttttgtctgtctcccaaattttgcactgttggtgggaatgtaaattagttttgtggttgaacttgattgctgttactttttacttgatgcttttgaggcagagggacattttctgctgttaccttcagttttagagaggcagcgtggctgtgagtctccgaagcaggctgtttcagtgatcctgcctctccccgggactaaaatcacttcttattcttttcccctacctatgatgagttatcactggtgccctaagagccacaagactcactgttattttcctggggctgaagacctttattccaaagggacaatccgggagaagtatatgggcagggcattaagcctttcccagagctgctgctgttccgctcctgaagcctgcaccacaacagatactttatcagtactcttttttgctttttattttattctattttactttaagttccaggatacatgtgcagaacatgcaggtttgttacacaggtatatgtgtgccctggcggtttgctgcacctatcaacccgttgtctagttttaagccccacatacattagctatttgtcctgatggtctccctccctttgcccccatcccccaacaggctcagatgtatgttgtgcttctccctgtgtccatgtgatctcattgttaaaactcccacttataagtgagaacatgcagtgtttggttttctgttcctgtgttagtttgctgaggatgatggcttccagcttcatccatgtcactgcaaaggacatgacctcattcctttttatggctgcatagtattccatggtgtacatgtaccacattttctttatccagtctattattgatggacatttgggttggttccatgtctttgctattgaaaaatagtgctgcagtaaacatacaggtacatgtgtctttatagtagaatgatttatattcctttggatatatatccagtaatgagattattggatcaaatggtatttctggttctagatccttgaggaatcaccacactgtcttccacaatggctgaactaatttacattcccaacaacagtgtaaaaatgttcctatttctccacagcctggccagcatattgttaaaaggttctgtatatggtggagatggaggagatcgggggaggagatgagaaaggggcaagcataagtaggaacaaatgcaatatttccccagctgcgcgagggcaggagcaggaagaactaaacccaattaggaacaacagaggacagatgagtagatancagacatctgacgggaaatggccacgccacacttctcacccaggcagttcaacgtaggcaatttctgagtgccctggtattttttgtgtaagtgtctagaaaacagatcacaaagttagccaaattaaaaaggaagcagggagtcctatttctccgagaagaaagatttacaggtgggatctcaggcaggagccaagctggagaagcaggcttgattccttgtagtgggtgaggagactgctgggagagggcagggaagcagagaccggcaaaaagctgccccaacaagaatcctgtgcctgccaacctggtttacaaacatttcccactttatccccctcagaaagtcacagcacccatttcatgttctgtgaggctcccaaggagggaaacttctagtttgctgtcctttacctcacccctgtgaccacagcactaatttctcatgaattcttgttaccaatgagatacaaatgtttggggagctctggcctggtctgattttgagctctgtggaaatacgcagaccacgggggaggaggccgggaaatggactcggtttgagggcttgctcaaggatgcggttttgtttttcggctgatttactccaagacagccagagattgttctgtcgttgccacagaggtgactaaacaggaaggtaagtttgaggtaggaagaaaaccatccccaggagtttcatgtagcaaagaaggaagtagctgttacaaatgggtgacagtttacatgtgggtctaacagtctcagctctgttgttcaatctttcagttatactcagagagtaagcgggaggagccttggggctgctattgagtgcagcatcctgaaggctgttcttcaagtgttactcagactactatcccaagagcactcaaggcagttcttcctccatccctgctccctagctcccttggctttgatgagtttattacaaaagggctattcactttagaataggagggtaattaagactcctggtctgcagcccagatttactgcattttacaagttaataatatgatttttttttgtagctccaattgattggtaacagaagatgaagacaacagcataactaaattattttaaaaactaaaaagccatctgatttctcatttgagtattacaatttttgaacaactgttggaaatgtaacttgaagcagctgctttaagaagaaatacccactaacaaagaacaagcattagttttggctgtcatcaacttattatatgactaggtgcttgctttttttgtcagtaaattgtttttactgatgatgtagatacttttgtaaataaatgtaaatatgtacacaagtgactaggtggtttggctactgttttcctaagatagaaaaataagggtcacatacccttttaaaatctatactctttctcccttgctttaggggaaaaataattcattgtagggtcattcatggagtgagggagaaaagtactgtccctcactgggttccaactgctgtcagtacgaaggcaagtgaacacatgggtctttacttctagctgcttttgaaaagagcagatcaccaccatccagtgcagttgtataacacaggtggggcagggagacttctctcgctgccattaattagcctacttagtttgttgcattggttagctgtcacattgggaggtcaacagcagacagtagctggaaaaccgtagtcataacaaatacagagtggcagccactcctgaagtggtggatggtgccagttgcctctagcagccatgtaaacccaagtcaatacatagacgctttagcttgtgcctgcactgtccctggaattcctgtcacatgagagtctccaggctgaaggaagaaatcaatatttcttgactccaagatgggcctgtca

SEQ ID NO: 21490 - DNA, 936 bp, Homo sapiens
cggggcgggccgccggctgccagcccagggcggggcggagccctacttctggccgaccgcgtaggcggtgcttgaacttagggctgcttgtggctgggcactcgcgcagaggccggcccgacgagccatggttgctgggagcgacgcggggcgggccctgggggtcctcagcgtggtctgcctgctgcactgctttggtttcatcagctgtttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctcttccatctcccacactaacttgtgcattgactaatggaagcattgaagtccaatgcatgataccagagcattacaacagccatcgaggacttataatgtactcatgggattgtcctatggagcaatgtaaacgtaactcaaccagtatatattttaagatggaaaatgatcttccacaaaaaatacagtgtactcttagcaatccattatttaatacaacatcatcaatcattttgacaacctgtatcccaagcagcggtcattcaagacacagatatgcacttatacccataccattagcagtaattacaacatgtattgtgctgtatatgaatggtatgtatgctttttaaaacaaaatagtttgaaaacttgcattgttttccaaaggtcagaaaatagtttaaggatgaaaataaagtttgaaattttagacatt

SEQ ID NO: 21491 - DNA, 436 bp, Homo sapiens
agagagagaactgccacacacttttaaaccaacagatgtcatgagaactcactctctatcactagaatagcatggggaaaccatcccccatggtacaatcacctcccacccaggtccctctctcgacacatgggaattacaattcaagatgagatttgggtgaggacccagagccaaaccatatcagggtctgaatttattctgttaaatttgaacaggtagatctgacctagcaaaagaaagaattctcgctccttgatgctcaaggagtttgtctgctcatcctttcaagcttgtaaggaggttgcgagctcttcataaatttgcagatgataagtctaaatattactattttccccagctcctttctgaaagaagaaccagtgcggcggcctttactttcaatttctcatcttgggaggggtcctctagacgg

SEQ ID NO: 21492 - DNA, 1450 bp, Homo sapiens
  misc_feature (1261)..(1261): n is a, c, g, or t
  misc_feature (1321)..(1321): n is a, c, g, or t
  misc_feature (1339)..(1339): n is a, c, g, or t
  misc_feature (1354)..(1354): n is a, c, g, or t
  misc_feature (1361)..(1361): n is a, c, g, or t
  misc_feature (1397)..(1397): n is a, c, g, or t
cggggcgggccgccggctgccagcccagggcggggcggagccctacttctggccgaccgcgtaggcggtgcttgaacttagggctgcttgtggctgggcactcgcgcagaggccggcccgacgagccatggttgctgggagcgacgcggggcgggccctgggggtcctcagcgtggtctgcctgctgcactgctttggtttcatcagctgtttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctcttccatctcccacactaacttgtgcattgactaatggaagcattgaagtccaatgcatgataccagagcattacaacagccatcgaggacttataatgtactcatgggattgtcctatggagcaatgtaaacgtaactcaaccagtatatattttaagatggaaaatgatcttccacaaaaaatacagtgtactcttagcaatccattatttaatacaacatcatcaatcattttgacaacctgtatcccaagcagcggtcattcaagacacagatatgcacttatacccataccattagcagtaattacaacatgtattgtgctgtatatgaatggtattctgaaatgtgacagaaaaccagacagaaccaactccaattgattggtaacagaagatgaagacaacagcataactaaattattttaaaaactaaaaagccatctgatttctcatttgagtattacaatttttgaacaactgttggaaatgtaacttgaagcagctgctttaagaagaaatacccactaacaaagaacaagcattagttttggctgtcatcaacttattatatgactaggtgcttgctttttttgtcagtaaattgtttttactgatgatgtagatacttttgtaaataaatgtaaatatgtacacaaaaaaaaaaaaaaaaaaaaaaaaaaaaaaaaaaaaaaaaaaaaaaaaaaaaaaaaaaaaaaaaaaaaaaaaatttatataataaataaaaaaaaaaattttattttnataaattattttttatattttttaaattaaatattttttttttttatttttattaaaaanttattaaaaaaataatanttttagtttttttanatttttnaaaaaaatttttttttatataaatatttttaatttnaaataaattaataaattttttttatttaaatctaataaaatggttataataaa

SEQ ID NO: 21493 - DNA, 1049 bp, Homo sapiens
agagagagaactgccacacacttttaaaccaacagatgtcatgagaactcactctctatcactagaatagcatggggaaaccatcccccatggtacaatcacctcccacccaggtccctctctcgacacatgggaattacaattcaagatgagatttgggtgaggacccagagccaaaccatatcagggtctgaatttattctgttaaatttgaacaggtagatctgacctagcaaaagaaagaattctcgctccttgatgctcaaggagtttgtctgctcatcctttcaagcttgtaaggaggttgcgagctcttcataaatttgcagatgataagtctaaatattactattttctgtactaaatattatacttttttttccagagtctcttccatctcccacactaacttgtgcattgactaatggaagcattgaagtccaatgcatgataccagagcattacaacagccatcgaggacttataatgtactcatgggattgtcctatggagcaatgtaaacgtaactcaaccagtatatattttaagatggaaaatgatcttccacaaaaaatacagtgtactcttagcaatccattatttaatacaacatcatcaatcattttgacaacctgtatcccaagcagcggtcattcaagacacagatatgcacttatacccataccattagcagtaattacaacatgtattgtgctgtatatgaatggtattctgaaatgtgacagaaaaccagacagaaccaactccaattgattggtaacagaagatgaagacaacagcataactaaattattttaaaaactaaaaagccatctgatttctcatttgagtattacaatttttgaacaactgttggaaatgtaacttgaagcagctgctttaagaagaaatacccactaacaaagaacaagcattagttttggctgtcatcaacttattatatgactaggtgcttgctttttttgtcagtaaattgtttttactgatgatgtagatacttttgtaaataaatgtaaatatgtacacaa

SEQ ID NO: 21494 - DNA, 891 bp, Homo sapiens
cggggcgggccgccggctgccagcccagggcggggcggagccctacttctggccgaccgcgtaggcggtgcttgaacttagggctgcttgtggctgggcactcgcgcagaggccggcccgacgagccatggttgctgggagcgacgcggggcgggccctgggggtcctcagcgtggtctgcctgctgcactgctttggtttcatcagctgtttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttggtcattcaagacacagatatgcacttatacccataccattagcagtaattacaacatgtattgtgctgtatatgaatggtattctgaaatgtgacagaaaaccagacagaaccaactccaattgattggtaacagaagatgaagacaacagcataactaaattattttaaaaactaaaaagccatctgatttctcatttgagtattacaatttttgaacaactgttggaaatgtaacttgaagcagctgctttaagaagaaatacccactaacaaagaacaagcattagttttggctgtcatcaacttattatatgactaggtgcttgctttttttgtcagtaaattgtttttactgatgatgtagatacttttgtaaataaatgtaaatatgtacacaa

SEQ ID NO: 21495 - DNA, 2726 bp, Homo sapiens
  misc_feature (1386)..(1386): n is a, c, g, or t
ctctaatgttactttgtctttgtggtgaggagtggttttccaaaaggactttctcagtatttgctccaccctcagatttagatcttctttttgtgcctgtaccacagagacaacttctttttttgtctgtctcccaaattttgcactgttggtgggaatgtaaattagttttgtggttgaacttgattgctgttactttttacttgatgcttttgaggcagagggacattttctgctgttaccttcagttttagagaggcagcgtggctgtgagtctccgaagcaggctgtttcagtgatcctgcctctccccgggactaaaatcacttcttattcttttcccctacctatgatgagttatcactggtgccctaagagccacaagactcactgttattttcctggggctgaagacctttattccaaagggacaatccgggagaagtatatgggcagggcattaagcctttcccagagctgctgctgttccgctcctgaagcctgcaccacaacagatactttatcagtactcttttttgctttttattttattctattttactttaagttccaggatacatgtgcagaacatgcaggtttgttacacaggtatatgtgtgccctggcggtttgctgcacctatcaacccgttgtctagttttaagccccacatacattagctatttgtcctgatggtctccctccctttgcccccatcccccaacaggctcagatgtatgttgtgcttctccctgtgtccatgtgatctcattgttaaaactcccacttataagtgagaacatgcagtgtttggttttctgttcctgtgttagtttgctgaggatgatggcttccagcttcatccatgtcactgcaaaggacatgacctcattcctttttatggctgcatagtattccatggtgtacatgtaccacattttctttatccagtctattattgatggacatttgggttggttccatgtctttgctattgaaaaatagtgctgcagtaaacatacaggtacatgtgtctttatagtagaatgatttatattcctttggatatatatccagtaatgagattattggatcaaatggtatttctggttctagatccttgaggaatcaccacactgtcttccacaatggctgaactaatttacattcccaacaacagtgtaaaaatgttcctatttctccacagcctggccagcatattgttaaaaggttctgtatatggtggagatggaggagatcgggggaggagatgagaaaggggcaagcataagtaggaacaaatgcaatatttccccagctgcgcgagggcaggagcaggaagaactaaacccaattaggaacaacagaggacagatgagtagatancagacatctgacgggaaatggccacgccacacttctcacccaggcagttcaacgtaggcaatttctgagtgccctggtattttttgtgtaagtgtctagaaaacagatcacaaagttagccaaattaaaaaggaagcagggagtcctatttctccgagaagaaagatttacaggtgggatctcaggcaggagccaagctggagaagcaggcttgattccttgtagtgggtgaggagactgctgggagagggcagggaagcagagaccggcaaaaagctgccccaacaagaatcctgtgcctgccaacctggtttacaaacatttcccactttatccccctcagaaagtcacagcacccatttcatgttctgtgaggctcccaaggagggaaacttctagtttgctgtcctttacctcacccctgtgaccacagcactaatttctcatgaattcttgttaccaatgagatacaaatgtttggggagctctggcctggtctgattttgagctctgtggaaatacgcagaccacgggggaggaggccgggaaatggactcggtttgagggcttgctcaaggatgcggttttgtttttcggctgatttactccaagacagccagagattgttctgtcgttgccacagaggtgactaaacaggaaggtaagtttgaggtaggaagaaaaccatccccaggagtttcatgtagcaaagaaggaagtagctgttacaaatgggtgacagtttacatgtgggtctaacagtctcagctctgttgttcaatctttcagttatactcagagagtaagcgggaggagccttggggctgctattgagtgcagcatcctgaaggctgttcttcaagtgttactcagactactatcccaagagcactcaaggcagttcttcctccatccctgctccctagctcccttggctttgatgagtttattacaaaagggctattcactttagaataggagggtaattaagactcctggtctgcagcccagatttactgcattttacaagttaataatatgatttttttttgtagctccaattgattggtaacagaagatgaagacaacagcataactaaattattttaaaaactaaaaagccatctgatttctcatttgagtattacaatttttgaacaactgttggaaatgtaacttgaagcagctgctttaagaagaaatacccactaacaaagaacaagcattagttttggctgtcatcaacttattatatgactaggtgcttgctttttttgtcagtaaattgtttttactgatgatgtagatacttttgtaaataaatgtaaatatgtacacaa

SEQ ID NO: 21496 - DNA, 802 bp, Homo sapiens
gcctgggaacacagcctggacctgttgcatagcctccttttacctgtgatctgcttcaaaatatagttaaacttctggtctccaagtcagagtttgctaaagacctctttaggctgccacctctgtaattttcatgtcatataacacgaatggggctcccaggtaggaagggagttttggttgagttaagtgacttacgtaatacaagtaattgtgcttgtattacttcctgagccttctcagtcccctagcaatcttgggcagtcatacagcttggagaactgatgacttggagaatttgttcccagcctgttcattcctggtaatgagtaatccctctcaaatcccaaaggacagggagcaggctgtaattctgaagagtggatattcttgatgccacagcagtttccataccagccttcaccaaaaggaaatatgccagacagggaatgccgaagagtaaactttctacaagtgatagtatctaggatccattgtgtcatgaatcaagtttataaactagatttcagtttccttagacctgcactgtttagtatagtagccaattagccacatatgattatttaaatatatcatttaaaatgaaataccattaaatttaagattcattcctcagttacactaaccacctttcaagtgctcaatacctacatctggctagtggctaccatactggatagcccagataaggaataatcctatcattgcagaaagttttcttggtcagtgcagaactagactattttgcgatatcagtgctaaatataatttcctgatgata

SEQ ID NO: 21497 - DNA, 1756 bp, Homo sapiens
cggggcgggccgccggctgccagcccagggcggggcggagccctacttctggccgaccgcgtaggcggtgcttgaacttagggctgcttgtggctgggcactcgcgcagaggccggcccgacgagccatggttgctgggagcgacgcggggcgggccctgggggtcctcagcgtggtctgcctgctgcactgctttggtttcatcagctgtttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctcttccatctcccacactaacttgtgcattgactaatggaagcattgaagtccaatgcatgataccagagcattacaacagccatcgaggacttataatgtactcatgggattgtcctatggagcaatgtaaacgtaactcaaccagtatatattttaagatggaaaatgatcttccacaaaaaatacagtgtactcttagcaatccattatttaatacaacatcatcaatcattttgacaacctgtatcccaagcagcggtcattcaagacacagatatgcacttatacccataccattagcagtaattacaacatgtattgtgctgtatatgaatgttctttaattgagaagacaatttcttcatttttaggtattctgaaatgtgacagaaaaccagacagaaccaactccaattgattggtaacagaagatgaagacaacagcataactaaattattttaaaaactaaaaagccatctgatttctcatttgagtattacaatttttgaacaactgttggaaatgtaacttgaagcagctgctttaagaagaaatacccactaacaaagaacaagcattagttttggctgtcatcaacttattatatgactaggtgcttgctttttttgtcagtaaattgtttttactgatgatgtagatacttttgtaaataaatgtaaatatgtacacaagtgactaggtggtttggctactgttttcctaagatagaaaaataagggtcacatacccttttaaaatctatactctttctcccttgctttaggggaaaaataattcattgtagggtcattcatggagtgagggagaaaagtactgtccctcactgggttccaactgctgtcagtacgaaggcaagtgaacacatgggtctttacttctagctgcttttgaaaagagcagatcaccaccatccagtgcagttgtataacacaggtggggcagggagacttctctcgctgccattaattagcctacttagtttgttgcattggttagctgtcacattgggaggtcaacagcagacagtagctggaaaaccgtagtcataacaaatacagagtggcagccactcctgaagtggtggatggtgccagttgcctctagcagccatgtaaacccaagtcaatacatagacgctttagcttgtgcctgcactgtccctggaattcctgtcacatgagagtctccaggctgaaggaagaaatcaatatttcttgactccaagatgggcctgtca

SEQ ID NO: 21498 - DNA, 2549 bp, Homo sapiens
cggggcgggccgccggctgccagcccagggcggggcggagccctacttctggccgaccgcgtaggcggtgcttgaacttagggctgcttgtggctgggcactcgcgcagaggccggcccgacgagccatggttgctgggagcgacgcggggcgggccctgggggtcctcagcgtggtctgcctgctgcactgctttggtttcatcagctgtttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctcttccatctcccacactaacttgtgcattgactaatggaagcattgaagtccaatgcatgataccagagcattacaacagccatcgaggacttataatgtactcatgggattgtcctatggagcaatgtaaacgtaactcaaccagtatatattttaagatggaaaatgatcttccacaaaaaatacagtgtactcttagcaatccattatttaatacaacatcatcaatcattttgacaacctgtatcccaagcagcggtcattcaagacacagatatgcacttatacccataccattagcagtaattacaacatgtattgtgctgtatatgaatggtatgtatgctttttaaaacaaaatagtttgaaaacttgcattgttttccaaaggtcagaaaatagtttaaggatgaaaataaagtttgaaattttagacatttgaaaagaaacaaaaacttttttgctttacgtgtgtgggactgctgagcatgctaggttcctccaaagatccacattatctcaaggtagaatgaatccttaggccacagagagctttacaggcctgggaacacagcctggacctgttgcatagcctccttttacctgtgatctgcttcagctgccacctctgtaattttcatgtcatataacacgaatggggctcccaggtaggaagggagttttggttgagttaagtgacttacgtaatacaagtaattgtgcttgtattacttcctgagccttctcagtcccctagcaatcttgggcagtcatacagcttggagaactgatgacttggagaatttgttcccagcctgttcattcctggtaatgagtaatccctctcaaatcccaaaggacagggagcaggctgtaattctgaagagtggatattcttgatgccacagcagtttccataccagccttcaccaaaaggaaatatgccagacagggaatgccgaagagtaaactttctacaagtgatagtatctaggatccattgtgtcatgaatcaagtttataaactagatttcagtttccttagacctgcactgtttagtatagtagccaattagccacatatgattatttaaatatatcatttaaaatgaaataccattaaatttaagattcattcctcagttacactaaccacctttcaagtgctcaatacctacatctggctagtggctaccatactggatagcccagataaggaataatcctatcattgcagaaagttttcttggtcagtgcagaactagactattttgcgatatcagtgctaaatataatttcctgatgataacattttcatattataagttgtaaataccatgaaaatccatccctaagtaatagattatcagtcagttgactctccactaaacagtattataacgatcagctgaagaaagttttcagctattgcccaatgcataaaatattttgggagctcaaattttttaaaaatctattttaatccccaaatagcagtataatagttaatcatctcctgaacaggttggttcccagaaaccaaaatcattttccactcagtgttgttgtagatctcaattaaagaactaacccaggatacctgaactaaagagaggtggcactgagtttccatagaacttcaaaacaattggttgatttcacttaaaaaaaaaaaaaaaagtcattcaatatacagaaaattactcccctggtcagtactgttagccccagataatctgaaaaaatttgttcttaaaaaaaaaaaacaatttggaggccaggcatggtggctcatgcctgtaatcccagcacattgagaggtcgagttgtgtgcatcacttgagcccaggagtttgagaccagcctggacaacatggtgaaacactatctctacaaaaaaatacaaaaattagccaggcatggtggtgcatgcctgtagtcccagctactcaggaggctgaggcgggagggaggcagatgttgcagtgagctgagattgtgccactgcactccagcctgggtgatggagtgagaccctgtctcaaaaaacaa

SEQ ID NO: 21499 - DNA, 479 bp, Homo sapiens
cttagcacagggagaggcatcagggtgatactcgtaagtatgccagaggttaatggtggtgatttttctgctgagaaactcagtgtcccttttaagtgtcttggcttctgttctctttctgtgagggaaataaatttgttttagttgtttgcacactagtcactataaaatgccactatgaggttgtctttccttcacttcctcaagcttctttcctgtctttagttattgtcctttagttactgtttgagatcaagccctacagtctaattttttacatttttatgtcctttttatacagcttatcttggctcttattagccgtgggtactggtggggattattcgccagtgtttcctctatttaaaaaaattaataggactttattttttagagcagcagtaagcgtatagaaaaattgagtgcagagtaggagttcccgtatacctcctcactccacccctactcacaatttcctt

SEQ ID NO: 21500 - DNA, 571 bp, Homo sapiens
acacaggaccccagccaccttatgattctaaaagccttgctcaaagccgctgcagatgagttagctaggtctctaccacctcctcagcatcaactgactttccataatactcctctgcagagaaataaaggtctttcacgcctcccaggaagggatttgcttagcctcaaatgtgcacattcagaaatagctgtcataagaaagagaggatagtttgcagagaaataaccctcctaagtccacatcctattccttttaaataagagagtggtgccaagggaagagccctagaatgtcaaagccaacagggtgctcagataccacccaagtacagttccatctttggccataaggagacaatggtgtcaagaggctaaggccatatgatctgtaggtgaaaaacctgggatgagaatcaaggcctcgaaactttttccactacatcacagatttaggagcagttagagggaaggcttcaatctggagaacactaacaggctctagagattattgggtcatggtggcaggaagacatcctaagtggcccctacactaggatacagtagggaga

SEQ ID NO: 21501 - DNA, 438 bp, Homo sapiens
acttgccccactgttgtttctaggtacaacccacctgtgttcactggagttgctctctctcaggtaggacttcctgcagaaccacgcagcttcaggatctgccgggttgcgtgtttctgttacagtgttgtgactcttggatgtctgcatgtgtttttgtggcatttgtgtgtgtgggggtgtgtatgtatgtgtgcacctgtaagtagagtctacttaaagaaatgtggctaacacactacatggctttattgttttgagtgtcctaacattctggtagcctatatgtgtgactctgcttgggctgcagtgttctatgtttttttcttttctcttttttttctgtggatcataaatcctcagtgaattgggagggggtccaagaacctctggcatcctaatcacctaatactgcaaaaaaataaaaagccataacaa

SEQ ID NO: 21502 - DNA, 662 bp, Homo sapiens
tggaagtgcagcccagccagcagcttgcttttctcaccctgccttgtcgcagccagcctgactcttacttatacatctgagaagtgccagtctctataattcacatggctccaaatcctcataagtggttcaggttatgttctcccaagaatcctccatgccacattccaccctggtggccagatggagatgggtctgtacatttctgagcttaccaagtctctatctagagaatataatgctgaatgaatgtaatgcctctccctcacatgggaacactaaatatctacaaatggttctattggagccctcctcactcagtttagaatgaagggagtgcactactccttttgtcttgcagggagaagttatccctattcctaaagattcccatcaatgaatcttttatttctaatctcacatataatagaaagtgtagtggtctgtggatcagctttactatcttagaataaacttcatgtggatatatctagtacctttatttggaatgtgttggttcctatcacctcttgtcctcagtttcggtatgttatccaaagatcttagataactgaaaaactctaatttaactttctcttttatgcagatattcttattatatgtggtttccttttttgtgtgtgctttatttctgtggagta

SEQ ID NO: 21503 - DNA, 448 bp, Homo sapiens
tgaacgaagcttacctaacacatgtatttctcccataaggcacatcatagcccgcttgcactaaaggacactagacagcactacagcactgatgcttgggggccattttaaagagtgaattcaccaataaaaagcacaaaaatgcaaaaaacacggcagtaaatatactgtgaaaataacacggcttacggtatgagagctgaaacaaggcagcagagcatctccttgatcaacctcacctgggtactgtgcgtgtctgcaaaagatcctgaaagtgctgcgactttattggtaaccttttgaggttaccaatacattttagtgaataggcaaattctcagatacgaataatgaagaatgaagatcaactatacttcctggcaatatcaagggctgcccatatctcactttgcaggattcaatgtccaagtccatgttttccttcttc

SEQ ID NO: 21504 - DNA, 438 bp, Homo sapiens
gctgtaagctggaaatttcaaggcagaaacagcagataccacaactataactgggtctccttgttttttgttttatgtgtatacgtgagattatggggaaagacaaaagtaatgcatagagatttattttttaacattcaattcataagcagtgtttatacctctttgtacttacttgaaaagtgtatattatgtaaatttagtataaaaacacttggactaattcataccatgtggtaaaatttcacattcaaaagaaatacccttctgttattaaaaataaaaaaaaaaaggagccaggagggtggctcatgactgtaatcccagtgctctgggaagccaaggtggagggatcatttgaggccaggactacttgagaacagcctgggcaacatagctagatcccttctctacaaaaagtaaaaaaaaaaaaaaaaa

SEQ ID NO: 21505 - DNA, 738 bp, Homo sapiens
cttgatccagccatcagctctctccaaagagccttaagcagaggcgtacagtcccagaaggtggattgtcagggctgccagcaaattcatagaccccagcagcccaggcctctctctcttacaggcactactgaaatcagggggccaggcgggttttaattcacacacccactctgatcatttgctcgttggctgcctcagcactatgcagagacagatgctggagcctcttttgggcccagtgggaaatgtactgtgatcaattagagatacatgccatgagcctgagctttgccattcctgatttttaacagtattcaggccaggaaataatactcctgtatctttcagaggcaaaaattgatccatctgatagccataaatagaagtagatggaaatatacaaaaatacagtcctgtgagatatatacatacatatatatgtatatacatacagatgtatatgctatttttttaaagattcatagattcctgtcatctgatttctgatttagctaactatttatagttcagttgcctgtgggccaacactgatttgcttcactgatgagcagacaagattttaaaaatgagttttgagaaaagctctctcaagccagatgtggtagctagcatgcacctgtagtcccaggcactcggcaggaatgcttgtgcccaggagttcggtctggcctgggcaacgtactgagaccctgtgtcttaaaaaaagaaaaagag

SEQ ID NO: 21506 - DNA, 206 bp, Homo sapiens
gcgaaagtgaagtgtcaataggctctctctgtgtccttcaaaccacccatatggtcgttacaaacggcggcttgaggaaaggtggttttggaatcggtttctctctggtcttacatgatgcatctatactatactgcattataatacaggaaagggtcacttgctgacataaagcacagcaggcaggaatagaagagtcaacttag

SEQ ID NO: 21507 - DNA, 295 bp, Homo sapiens
cagccacagaagagcatgaagcagtgtgaccacagaggcagattggagtgatatggtcacaagccaaggcatactggcatttgccccaacctgaaagaggtaaggaacagattctcccctagggcctctggaagccaagtgcaatcctgccagtacttttattttggcccagtgatattgaattaggacttctggccttcagaactgtgagagaataacttactgttgttataagccttcaaatttgtgataatgttacagtagccatagaaaactaatatagcaatcattgttc

SEQ ID NO: 21508 - DNA, 239 bp, Homo sapiens
gtgtcttttattgtcctctaatgtttcccggtttcctttctttcctctcaatgagcttgtaaattccttaaggacaaagctctccttcttagtctctttttgatggtccccacagtgcctgcaactaataggaattcactaatcacttgttccttcagatggggaagcatgtccatgagcccccacctgggagcagagagaatgccaattaggtcaacaaacctgccaagaagttggaa

SEQ ID NO: 21509 - DNA, 1378 bp, Homo sapiens
tagtttaaataaatacatttaaatcttgttaaaatttaattgtttctggctgggcacggtggctcacacctgtaaccccaacactttgggtggctgaggcaggaggatcacttgaggtcaggagttcaaagccagcctggccaacatggcaaaacctcatctgtattaaaaatacaaaaattagccaaatgtggtggtacacgcctgtaatcccagctacttgggcatctgattcacaagagtcgtttgaccccaggaggtagaggttgcagtgagctgagatcgcaccactgcactccagcctggacgatagagtgagactctgtctcaaaaaaaaaaaaaaaaaaaaaaaaaattatttccataaagaatagatcaacatgtaggtataatgcctgctgttacttaataggcaagatcacgtctctggataccagcaccatgagagcagccatgaaaccaggctgggaggacctggtaagaaggtgtattcagaagttccatgcgcagcatgaaggagaatctgtgtcctatgctaagaggcatcatcatgaaggtaagcatctctaaatgatttttcttaaattattgcttcctgtgggagctttctgtcaatgattcctggagttcaccttgggaacagagctggtgactgttctcgtgagctgtctcatctggccccagtgttgccatctaaaggaaaatttaacaggagaacctgtaggacagaagagtgatgaaagtagaacaggagatgatagtgtcacagaggcaggcaaaaggaggaagaggtcattttctttgatccaggggcttctagatatgtgacaagattataagtaccatctaatgaaaagaaatattaacgattcagttagaatctgaatataagagtaagtggaattttggagagtgagtgaacccctggtgaaggtaacagtgggaccccaagcccttcttcaaggtggtaaccaacaaagactatccaggtgtttctagagggcccaaaagttgacacgacttgtctcagctcacagacttaagcaataggacagctggaactgagcccaagacttcagtaataacagcagcccttattgagcacctggtctttgtgtggcattatcccttttgcctcctctcactggccctcacagcaagcctgtgatgtgaacatcacgtctctcactctggacaaggggacgaggaggttcaggcaagtgaaatgactgactctctagcattcagtgtcagtgcaggacgtccatctgagctcattttggtcactgtcatgctgcttccgaaggtcttcccaaagaatcactttttctcaagtgcattgttgttttctgttaaagaggtaggaaccaaaaaaaaa

SEQ ID NO: 21510 - DNA, 8599 bp, Homo sapiens
ggcggccgcagcctcggctacagcttcggcggcgaaggtcagcgccgacggcagccggcacctgacggcgtgaccgacccgagccgatttctcttggatttggctacacacttatagatcttctgcactgtttacaggcacagttgctgatatgtgttcaagatgagtgggatgggagaaaatacctctgacccctccagggcagagacaagaaagcgcaaggaatgtcctgaccaacttggacccagccccaaaaggaacactgaaaaacgtaatcgtgaacaggaaaataaatatatagaagaacttgcagagttgatttttgcaaattttaatgatatagacaactttaacttcaaacctgacaaatgtgcaatcttaaaagaaactgtgaagcaaattcgtcagatcaaagaacaagagaaagcagcagctgccaacatagatgaagtgcagaagtcagatgtatcctctacagggcagggtgtcatcgacaaggatgcgctggggcctatgatgcttgaggcccttgatgggttcttctttgtagtgaacctggaaggcaacgttgtgtttgtgtcagagaatgtgacacagtatctaaggtataaccaagaagagctgatgaacaaaagtgtatatagcatcttgcatgttggggaccacacggaatttgtcaaaaacctgctgccaaagtctatagtaaatgggggatcttggtctggcgaacctccgaggcggaacagccataccttcaattgtcggatgctggtaaaacctttacctgattcagaagaggagggtcatgataaccaggaagctcatcagaaatatgaaactatgcagtgcttcgctgtctctcaaccaaagtccatcaaagaagaaggagaagatttgcagtcctgcttgatttgcgtggcaagaagagttcccatgaaggaaagaccagttcttccctcatcagaaagttttactactcgccaggatctccaaggcaagatcacgtctctggataccagcaccatgagagcagccatgaaaccaggctgggaggacctggtaagaaggtgtattcagaagttccatgcgcagcatgaaggagaatctgtgtcctatgctaagaggcatcatcatgaagtactgagacaaggattggcattcagtcaaatctatcgtttttccttgtctgatggcactcttgttgctgcacaaacgaagagcaaactcatccgttctcagactactaatgaacctcaacttgtaatatctttacatatgcttcacagagagcagaatgtgtgtgtgatgaatccggatctgactggacaaacgatggggaagccactgaatccaattagctctaacagccctgcccatcaggccctgtgcagtgggaacccaggtcaggacatgaccctcagtagcaatataaattttcccataaatggcccaaaggaacaaatgggcatgcccatgggcaggtttggtggttctgggggaatgaaccatgtgtcaggcatgcaagcaaccactcctcagggtagtaactatgcactcaaaatgaacagcccctcacaaagcagccctggcatgaatccaggacagcccacctccatgctttcaccaaggcatcgcatgagccctggagtggctggcagccctcgaatcccacccagtcagttttcccctgcaggaagcttgcattcccctgtgggagtttgcagcagcacaggaaatagccatagttataccaacagctccctcaatgcacttcaggccctcagcgaggggcacggggtctcattagggtcatcgttggcttcaccagacctaaaaatgggcaatttgcaaaactccccagttaatatgaatcctcccccactcagcaagatgggaagcttggactcaaaagactgttttggactatatggggagccctctgaaggtacaactggacaagcagagagcagctgccatcctggagagcaaaaggaaacaaatgaccccaacctgcccccggccgtgagcagtgagagagctgacgggcagagcagactgcatgacagcaaagggcagaccaaactcctgcagctgctgaccaccaaatctgatcagatggagccctcgcccttagccagctctttgtcggatacaaacaaagactccacaggtagcttgcctggttctgggtctacacatggaacctcgctcaaggagaagcataaaattttgcacagactcttgcaggacagcagttcccctgtggacttggccaagttaacagcagaagccacaggcaaagacctgagccaggagtccagcagcacagctcctggatcagaagtgactattaaacaagagccggtgagccccaagaagaaagagaatgcactacttcgctatttgctagataaagatgatactaaagatattggtttaccagaaataacccccaaacttgagagactggacagtaagacagatcctgccagtaacacaaaattaatagcaatgaaaactgagaaggaggagatgagctttgagcctggtgaccagcctggcagtgagctggacaacttggaggagattttggatgatttgcagaatagtcaattaccacagcttttcccagacacgaggccaggcgcccctgctggatcagttgacaagcaagccatcatcaatgacctcatgcaactcacagctgaaaacagccctgtcacacctgttggagcccagaaaacagcactgcgaatttcacagagcacttttaataacccacgaccagggcaactgggcaggttattgccaaaccagaatttaccacttgacatcacattgcaaagcccaactggtgctggacctttcccaccaatcagaaacagtagtccctactcagtgatacctcagccaggaatgatgggtaatcaagggatgataggaaaccaaggaaatttagggaacagtagcacaggaatgattggtaacagtgcttctcggcctactatgccatctggagaatgggcaccgcagagttcggctgtgagagtcacctgtgctgctaccaccagtgccatgaaccggccagtccaaggaggtatgattcggaacccagcagccagcatccccatgaggcccagcagccagcctggccaaagacagacgcttcagtctcaggtcatgaatatagggccatctgaattagagatgaacatggggggacctcagtatagccaacaacaagctcctccaaatcagactgccccatggcctgaaagcatcctgcctatagaccaggcgtcttttgccagccaaaacaggcagccatttggcagttctccagatgacttgctatgtccacatcctgcagctgagtctccgagtgatgagggagctctcctggaccagctgtatctggccttgcggaattttgatggcctggaggagattgatagagccttaggaatacccgaactggtcagccagagccaagcagtagatccagaacagttctcaagtcaggattccaacatcatgctggagcagaaggcgcccgttttcccacagcagtatgcatctcaggcacaaatggcccagggtagctattctcccatgcaagatccaaactttcacaccatgggacagcggcctagttatgccacactccgtatgcagcccagaccgggcctcaggcccacgggcctagtgcagaaccagccaaatcaactaagacttcaacttcagcatcgcctccaagcacagcagaatcgccagccacttatgaatcaaatcagcaatgtttccaatgtgaacttgactctgaggcctggagtaccaacacaggcacctattaatgcacagatgctggcccagagacagagggaaatcctgaaccagcatcttcgacagagacaaatgcatcagcaacagcaagttcagcaacgaactttgatgatgagaggacaagggttgaatatgacaccaagcatggtggctcctagtggtatgccagcaactatgagcaaccctcggattccccaggcaaatgcacagcagtttccatttcctccaaactacggaataagtcagcaacctgatccaggctttactggggctacgactccccagagcccacttatgtcaccccgaatggcacatacacagagtcccatgatgcaacagtctcaggccaacccagcctatcaggccccctccgacataaatggatgggcgcaggggaacatgggcggaaacagcatgttttcccagcagtccccaccacactttgggcagcaagcaaacaccagcatgtacagtaacaacatgaacatcaatgtgtccatggcgaccaacacaggtggcatgagcagcatgaaccagatgacaggacagatcagcatgacctcagtgacctccgtgcctacgtcagggctgtcctccatgggtcccgagcaggttaatgatcctgctctgaggggaggcaacctgttcccaaaccagctgcctggaatggatatgattaagcaggagggagacacaacacggaaatattgctgacactgctgaagccagttgcttcttcagctgaccgggctcacttgctcaaaacacttccagtctggagagctgtgtctatttgtttcaacccaactgacctgccagccggttctgctagagcagacaggcctggccctggttcccagggtggcgtccactcggctgtggcaggaggagctgcctcttctcttgacagtctgaagctcgcatccagacagtcgctcagtctgttcactgcattcaccttagtgcaacttagatctctcctgcaaaagtaaatgttgacaggcaaatttcatacccatgtcagattgaatgtatttaaatgtatgtatttaaggagaaccatgctcttgttctgttcctgttcggttccagacactggtttcttgctttgttttccctggctaacagtctagtgcaaaagattaagattttatctgggggaaagaaaagaattttttaaaaaattaaactaaagatgttttaagctaaagcctgaatttgggatggaagcaggacagacaccgtggacagcgctgtatttacagacacacccagtgcgtgaagaccaacaaagtcacagtcgtatctctagaaagctctaaagaccatgttggaaagagtctccagttactgaacagatgaaaaggagcctgtgagagggctgttaacattagcaaatattttttccttgttttttctttgttaaaaccaaactggttcacctgaatcatgaattgagaagaaataattttcatttctaaattaagtcccttttagtttgatcagacagcttgaatcagcatctcttcttccctgtcagcctgactcttcccttcccctctctcattccccatactccctattttcattccttttttaaaaaataatataagctacagaaaccaggtaagccctttatttccttaaatgttttgccagccacttaccaattgctaagtattgaatttcagaaaaaaaaaatgcatttactggcaaggagaagagcaaagttaaggcttgataccaatcgagctaaggatacctgctttggaagcatgtttattctgttccccagcaactctggcctccaaaatgggagaaaacgccagtgtgtttaaattgatagcagatatcacgacagatttaacctctgccatgtgttttttattttgttttttagcagtgctgactaagccgaagttttgtaaggtacataaaatccaatttatatgtaaacaagcaataatttaagttgagaacttatgtgttttaattgtataatttttgtgaggtatacatattgtggaattgactcaaaaatgaggtacttcagtattaaattagatatcttcatagcaatgtctcctaaaggtgttttgtaaaggatatcaatgccttgattagacctaatttgtagacttaagactttttattttctaaaccttgtgattctgcttataagtcatttatctaatctatatgatatgcagccgctgtaggaaccaattcttgatttttatatgtttatattctttcttaatgaaccttagaaagactacatgttactaagcaggccacttatggttgtttttcttgcccactctggtaggggaaaaatcttttattaataggtgtcagtttcagacaactccaataccaagaaactgatgaccttttttgagctatttctccttaacccctaatacctttcttacctaaatttcagaatgatatctttttgatgtctaaaaagcaaagcattttataatatctcattagccaggctttttaggaacagagaagtttttccttgaaatttgattgtttgtttatttgtggcagggtgaaaaatgtacaaactacccctatttatacttatatctctctctatatgtacgcattatggaaatataggaagagatatagcccaaagatagatggtaagtagacagtctgaaaatgttgctccatactaaagaacctttctggaaatttgcatttcgctacttttttccacttgagaggggtctcaatacagggaggtggccaaggaacaacacttctcagtggccaccagttcatatatcccctcaaaaggctctacttttctccaccaaaccattgggttgcccaactgtgatggaaaaaacaagcagatgttggcccagaactccaggacctccccgtgggctgaggctcatgtggcatacaattcagtgtgaccagttttaatgttcagaaatatgtgaattagaatgacttttaacttcacacagcacaaaagagaaatggagtttaaactggatttgttttgttttgagtttcaagtcccttttcactacaacaccgtccaaaactatctacctatctcttcttttttatccatctgcccgctgtattttaatgtcaatcctaattcagacaaatccgcaacttcatgatactggtaatttataataattcgtgatcattgctgttttgaaggaaaagagatgataaattctcttacggtttcaatcaggtaatggattttgttttacatctagttaggagaagaaaagtaagtgaaggaatcctctgatcatattgatcactatagaagcaaaagccaaatcagttcccttcattatcagtatttctcatgctgtacacaataaatttgttagactgagtacttggtttttgtttaatagaacaaataatcagtgtttcacttatattactaaatgtgaaaaacataatgtgaaaagtatacatacattaacttggttgtaaaactcattttaagtgttcatgtaatgtggtaagtttaaaaagtgaagtgagctgttttactacaatgaattcgtttgactcaaagattaaaatgcccctccccctatgtgtatctcttatggcctgtaataattgaaagcaatgtttttgcagtttatataatgcaatttttaatctgtgttcaaaaatggagttcatatgggcttaacacatgaaatgggtggcacagatccacttgcagaacccaaagatacacaatcagttttgaaatgcaacttaagccattaattgttggtgtgaatttaaaattttctagtgtttgtatggtggtatgctgcctaagagcaaagcatcctctgcacaaaagaaaattactgtagtggcttcgattttaattagaattttctccctggtgtttctttatagactaaagcaaaatcttttaagtttcttactacaggtaaaagctatgtgcaagaacctcaaaatgctaaaatctagcataatgccttagatctgtttttaagtcttgtatattcctacatagctgtccgatgtattatatttgtatagtgaattgtgtacaatttttgaataagtgcatcatcacttaacctttatgttgtttgaatagtgatgatgatacatttcttcagacatttaactgtcatttttttcctttgtcatttgtgagttttatttgtacagttcctcatgaagttgcatctgagatgtgtgtatatgaaaagattatacaagggtaaaattaagcaatatattaactatggttcttcaggagaaagcttacagtgtttcaggttgtgatttattttcaaaatggagttgactctgaacatcactttgttcacctgcattgatgtttgtatttctagtgtgagcagtttatgcaaaggtagatatattcagagaaattttaaatacatttatgcaagttaatattgctttgctgatgctatttgcttatttgatgttaaataatgctattgtaaataaagaattctgttgttattgcatcatttaataaattttaatgccttcgggttttacatggctttagagattttaatgtgtttatattgtatcttctttcataattgcatttaaaaagaccttgtaatttaataatttattatatttatatggtagttgacactgttgacagcaccttaacatttaattcttccaataacccattttataaatttttacatttgaaataaaggattatctaataacttaa

SEQ ID NO: 21511 - DNA, 8171 bp, Homo sapiens
ggcggccgcagcctcggctacagcttcggcggcgaaggtcagcgccgacggcagccggcacctgacggcgtgaccgacccgagccgatttctcttggatttggctacacacttatagatcttctgcactgtttacaggcacagttgctgatatgtgttcaagatgagtgggatgggagaaaatacctctgacccctccagggcagagacaagaaagcgcaaggaatgtcctgaccaacttggacccagccccaaaaggaacactgaaaaacgtaatcgtgaacaggaaaataaatatatagaagaacttgcagagttgatttttgcaaattttaatgatatagacaactttaacttcaaacctgacaaatgtgcaatcttaaaagaaactgtgaagcaaattcgtcagatcaaagaacaagagaaagcagcagctgccaacatagatgaagtgcagaagtcagatgtatcctctacagggcagggtgtcatcgacaaggatgcgctggggcctatgatgcttgaggcccttgatgggttcttctttgtagtgaacctggaaggcaacgttgtgtttgtgtcagagaatgtgacacagtatctaaggtataaccaagaagagctgatgaacaaaagtgtatatagcatcttgcatgttggggaccacacggaatttgtcaaaaacctgctgccaaagtctatagtaaatgggggatcttggtctggcgaacctccgaggcggaacagccataccttcaattgtcggatgctggtaaaacctttacctgattcagaagaggagggtcatgataaccaggaagctcatcagaaatatgaaactatgcagtgcttcgctgtctctcaaccaaagtccatcaaagaagaaggagaagatttgcagtcctgcttgatttgcgtggcaagaagagttcccatgaaggaaagaccagttcttccctcatcagaaagttttactactcgccaggatctccaaggcaagatcacgtctctggataccagcaccatgagagcagccatgaaaccaggctgggaggacctggtaagaaggtgtattcagaagttccatgcgcagcatgaaggagaatctgtgtcctatgctaagaggcatcatcatgaagtactgagacaaggattggcattcagtcaaatctatcgtttttccttgtctgatggcactcttgttgctgcacaaacgaagagcaaactcatccgttctcagactactaatgaacctcaacttgtaatatctttacatatgcttcacagagagcagaatgtgtgtgtgatgaatccggatctgactggacaaacgatggggaagccactgaatccaattagctctaacagccctgcccatcaggccctgtgcagtgggaacccaggtcaggacatgaccctcagtagcaatataaattttcccataaatggcccaaaggaacaaatgggcatgcccatgggcaggtttggtggttctgggggaatgaaccatgtgtcaggcatgcaagcaaccactcctcagggtagtaactatgcactcaaaatgaacagcccctcacaaagcagccctggcatgaatccaggacagcccacctccatgctttcaccaaggcatcgcatgagccctggagtggctggcagccctcgaatcccacccagtcagttttcccctgcaggaagcttgcattcccctgtgggagtttgcagcagcacaggaaatagccatagttataccaacagctccctcaatgcacttcaggccctcagcgaggggcacggggtctcattagggtcatcgttggcttcaccagacctaaaaatgggcaatttgcaaaactccccagttaatatgaatcctcccccactcagcaagatgggaagcttggactcaaaagactgttttggactatatggggagccctctgaaggtacaactggacaagcagagagcagctgccatcctggagagcaaaaggaaacaaatgaccccaacctgcccccggccgtgagcagtgagagagctgacgggcagagcagactgcatgacagcaaagggcagaccaaactcctgcagctgctgaccaccaaatctgatcagatggagccctcgcccttagccagctctttgtcggatacaaacaaagactccacaggtagcttgcctggttctgggtctacacatggaacctcgctcaaggagaagcataaaattttgcacagactcttgcaggacagcagttcccctgtggacttggccaagttaacagcagaagccacaggcaaagacctgagccaggagtccagcagcacagctcctggatcagaagtgactattaaacaagagccggtgagccccaagaagaaagagaatgcactacttcgctatttgctagataaagatgatactaaagatattggtttaccagaaataacccccaaacttgagagactggacagtaagacagatcctgccagtaacacaaaattaatagcaatgaaaactgagaaggaggagatgagctttgagcctggtgaccagcctggcagtgagctggacaacttggaggagattttggatgatttgcagaatagtcaattaccacagcttttcccagacacgaggccaggcgcccctgctggatcagttgacaagcaagccatcatcaatgacctcatgcaactcacagctgaaaacagccctgtcacacctgttggagcccagaaaacagcactgcgaatttcacagagcacttttaataacccacgaccagggcaactgggcaggttattgccaaaccagaatttaccacttgacatcacattgcaaagcccaactggtgctggacctttcccaccaatcagaaacagtagtccctactcagtgatacctcagccaggaatgatgggtaatcaagggatgataggaaaccaaggaaatttagggaacagtagcacaggaatgattggtaacagtgcttctcggcctactatgccatctggagaatgggcaccgcagagttcggctgtgagagtcacctgtgctgctaccaccagtgccatgaaccggccagtccaaggaggtatgattcggaacccagcagccagcatccccatgaggcccagcagccagcctggccaaagacagacgcttcagtctcaggtcatgaatatagggccatctgaattagagatgaacatggggggacctcagtatagccaacaacaagctcctccaaatcagactgccccatggcctgaaagcatcctgcctatagaccaggcgtcttttgccagccaaaacaggcagccatttggcagttctccagatgacttgctatgtccacatcctgcagctgagtctccgagtgatgagggagctctcctggaccagctgtatctggccttgcggaattttgatggcctggaggagattgatagagccttaggaatacccgaactggtcagccagagccaagcagtagatccagaacagttctcaagtcaggattccaacatcatgctggagcagaaggcgcccgttttcccacagcagtatgcatctcaggcacaaatggcccagggtagctattctcccatgcaagatccaaactttcacaccatgggacagcggcctagttatgccacactccgtatgcagcccagaccgggcctcaggcccacgggcctagtgcagaaccagccaaatcaactaagacttcaacttcagcatcgcctccaagcacagcagaatcgccagccacttatgaatcaaatcagcaatgtttccaatgtgaacttgactctgaggcctggagtaccaacacaggcacctattaatgcacagatgctggcccagagacagagggaaatcctgaaccagcatcttcgacagagacaaatgcatcagcaacagcaagttcagcaacgaactttgatgatgagaggacaagggttgaatatgacaccaagcatggtggctcctagtggtatgccagcaactatgagcaaccctcggattccccaggcaaatgcacagcagtttccatttcctccaaactacggaataagtcagcaacctgatccaggctttactggggctacgactccccagagcccacttatgtcaccccgaatggcacatacacagagtcccatgatgcaacagtctcaggccaacccagcctatcaggccccctccgacataaatggatgggcgcaggggaacatgggcggaaacagcatgttttcccagcagtccccaccacactttgggcagcaagcaaacaccagcatgtacagtaacaacatgaacatcaatgtgtccatggcgaccaacacaggtggcatgagcagcatgaaccagatgacaggacagatcagcatgacctcagtgacctccgtgcctacgtcagggctgtcctccatgggtcccgagcaggttaatgatcctgctctgaggggaggcaacctgttcccaaaccagctgcctggaatggatatgattaagcaggagggagacacaacacggaaatattgctgacactgctgaagccagttgcttcttcagctgaccgggctcacttgctcaaaacacttccagtctggagagctgtgtctatttgtttcaacccaactgacctgccagccggttctgctagagcagacaggcctggccctggttcccagggtggcgtccactcggctgtggcaggaggagctgcctcttctcttgacagtctgaagctcgcatccagacagtcgctcagtctgttcactgcattcaccttagtgcaacttagatctctcctgcaaaagtaaatgttgacaggcaaatttcatacccatgtcagattgaatgtatttaaatgtatgtatttaaggagaaccatgctcttgttctgttcctgttcggttccagacactggtttcttgctttgttttccctggctaacagtctagtgcaaaagattaagattttatctgggggaaagaaaagaattttttaaaaaattaaactaaagatgttttaagctaaagcctgaatttgggatggaagcaggacagacaccgtggacagcgctgtatttacagacacacccagtgcgtgaagaccaacaaagtcacagtcgtatctctagaaagctctaaagaccatgttggaaagagtctccagttactgaacagatgaaaaggagcctgtgagagggctgttaacattagcaaatattttttccttgttttttctttgttaaaaccaaactggttcacctgaatcatgaattgagaagaaataattttcatttctaaattaagtcccttttagtttgatcagacagcttgaatcagcatctcttcttccctgtcagcctgactcttcccttcccctctctcattccccatactccctattttcattccttttttaaaaaataatataagctacagaaaccaggtaagccctttatttccttaaatgttttgccagccacttaccaattgctaagtattgaatttcagaaaaaaaaaatgcatttactggcaaggagaagagcaaagttaaggcttgataccaatcgagctaaggatacctgctttggaagcatgtttattctgttccccagcaactctggcctccaaaatgggagaaaacgccagtgtgtttaaattgatagcagatatcacgacagatttaacctctgccatgtgttttttattttgttttttagcagtgctgactaagccgaagttttgtaaggtacataaaatccaatttatatgtaaacaagcaataatttaagttgagaacttatgtgttttaattgtataatttttgtgaggtatacatattgtggaattgactcaaaaatgaggtacttcagtattaaattagatatcttcatagcaatgtctcctaaaggtgttttgtaaaggatatcaatgccttgattagacctaatttgtagacttaagactttttattttctaaaccttgtgattctgcttataagtcatttatctaatctatatgatatgcagccgctgtaggaaccaattcttgatttttatatgtttatattctttcttaatgaaccttagaaagactacatgttactaagcaggccacttatggttgtttttcttgcccactctggtaggggaaaaatcttttattaataggtgtcagtttcagacaactccaataccaagaaactgatgaccttttttgagctatttctccttaacccctaatacctttcttacctaaatttcagaatgatatctttttgatgtctaaaaagcaaagcattttataatatctcattagccaggctttttaggaacagagaagtttttccttgaaatttgattgtttgtttatttgtggcagggtgaaaaatgtacaaactacccctatttatacttatatctctctctatatgtacgcattatggaaatataggaagagatatagcccaaagatagatggtaagtagacagtctgaaaatgttgctccatactaaagaacctttctggaaatttgcatttcgctacttttttccacttgagaggggtctcaatacagggaggtggccaaggaacaacacttctcagtggccaccagttcatatatcccctcaaaaggctctacttttctccaccaaaccattgggttgcccaactgtgatggaaaaaacaagcagatgttggcccagaactccaggacctccccgtgggctgaggctcatgtggcatacaattcagtgtgaccagttttaatgttcagaaatatgtgaattagaatgacttttaacttcacacagcacaaaagagaaatggagtttaaactggatttgttttgttttgagtttcaagtcccttttcactacaacaccgtccaaaactatctacctatctcttcttttttatccatctgcccgctgtattttaatgtcaatcctaattcagacaaatccgcaacttcatgatactggtaatttataataattcgtgatcattgctgttttgaaggaaaagagatgataaattctcttacggtttcaatcaggtaatggattttgttttacatctagttaggagaagaaaagtaagtgaaggaatcctctgatcatattgatcactatagaagcaaaagccaaatcagttcccttcattatcagtatttctcatgctgtacacaataaatttgttagactgagtacttggtttttgtttaatagaacaaataatcagtgtttcacttatattactaaatgtgaaaaacataatgtgaaaagtatacatacattaacttggttgtaaaactcattttaagtgttcatgtaatgtggtaagtttaaaaagtgaagtgagctgttttactacaatgaattcgtttgactcaaagattaaaatgcccctccccctatgtgtatctcttatggcctgtaataattgaaagcaatgtttttgcagtttatataatgcaatttttaatctgtgttcaaaaatggagttcatatgggcttaacacatgaaatgggtggcacagatccacttgcagaacccaaagatacacaatcagttttgaaatgcaacttaagccattaattgttggtgtgaatttaaaattttctagtgtttgtatggtggtatgctgcctaagagcaaagcatcctctgcacaaaagaaaattactgtagtggcttcgattttaattagaattttctccctggtgtttctttatagactaaagcaaaatcttttaagtttcttactacaggtaaaagctatgtgcaagaacctcaaaatgctaaaatctagcataatgccttagatctgtttttaagtcttgtatattcctacatagctgtccgatgtattatatttgtatagtgaattgtgtacaatttttgaataagtgcatcatcacttaacctttatgttgtttgaatagtgatgatgatacatttcttcagacatttaactgtcatttttttcctttgtcatttgtgagttttatttgtacagttcctcatgaagttgcatctgagatgtgtgtatatgaaaagattatacaagggtaaaattaagcaatatattaactatggttcttcaggagaaagcttaccatttaggtaaaatcctgggaagtc

SEQ ID NO: 21512 - DNA, 8213 bp, Homo sapiens
ggcggccgcagcctcggctacagcttcggcggcgaaggtcagcgccgacggcagccggcacctgacggcgtgaccgacccgagccgatttctcttggatttggctacacacttatagatcttctgcactgtttacaggcacagttgctgatatgtgttcaagatgagtgggatgggagaaaatacctctgacccctccagggcagagacaagaaagcgcaaggaatgtcctgaccaacttggacccagccccaaaaggaacactgaaaaacgtaatcgtgaacaggaaaataaatatatagaagaacttgcagagttgatttttgcaaattttaatgatatagacaactttaacttcaaacctgacaaatgtgcaatcttaaaagaaactgtgaagcaaattcgtcagatcaaagaacaagagaaagcagcagctgccaacatagatgaagtgcagaagtcagatgtatcctctacagggcagggtgtcatcgacaaggatgcgctggggcctatgatgcttgaggcccttgatgggttcttctttgtagtgaacctggaaggcaacgttgtgtttgtgtcagagaatgtgacacagtatctaaggtataaccaagaagagctgatgaacaaaagtgtatatagcatcttgcatgttggggaccacacggaatttgtcaaaaacctgctgccaaagtctatagtaaatgggggatcttggtctggcgaacctccgaggcggaacagccataccttcaattgtcggatgctggtaaaacctttacctgattcagaagaggagggtcatgataaccaggaagctcatcagaaatatgaaactatgcagtgcttcgctgtctctcaaccaaagtccatcaaagaagaaggagaagatttgcagtcctgcttgatttgcgtggcaagaagagttcccatgaaggaaagaccagttcttccctcatcagaaagttttactactcgccaggatctccaaggcaagatcacgtctctggataccagcaccatgagagcagccatgaaaccaggctgggaggacctggtaagaaggtgtattcagaagttccatgcgcagcatgaaggagaatctgtgtcctatgctaagaggcatcatcatgaagtactgagacaaggattggcattcagtcaaatctatcgtttttccttgtctgatggcactcttgttgctgcacaaacgaagagcaaactcatccgttctcagactactaatgaacctcaacttgtaatatctttacatatgcttcacagagagcagaatgtgtgtgtgatgaatccggatctgactggacaaacgatggggaagccactgaatccaattagctctaacagccctgcccatcaggccctgtgcagtgggaacccaggtcaggacatgaccctcagtagcaatataaattttcccataaatggcccaaaggaacaaatgggcatgcccatgggcaggtttggtggttctgggggaatgaaccatgtgtcaggcatgcaagcaaccactcctcagggtagtaactatgcactcaaaatgaacagcccctcacaaagcagccctggcatgaatccaggacagcccacctccatgctttcaccaaggcatcgcatgagccctggagtggctggcagccctcgaatcccacccagtcagttttcccctgcaggaagcttgcattcccctgtgggagtttgcagcagcacaggaaatagccatagttataccaacagctccctcaatgcacttcaggccctcagcgaggggcacggggtctcattagggtcatcgttggcttcaccagacctaaaaatgggcaatttgcaaaactccccagttaatatgaatcctcccccactcagcaagatgggaagcttggactcaaaagactgttttggactatatggggagccctctgaaggtacaactggacaagcagagagcagctgccatcctggagagcaaaaggaaacaaatgaccccaacctgcccccggccgtgagcagtgagagagctgacgggcagagcagactgcatgacagcaaagggcagaccaaactcctgcagctgctgaccaccaaatctgatcagatggagccctcgcccttagccagctctttgtcggatacaaacaaagactccacaggtagcttgcctggttctgggtctacacatggaacctcgctcaaggagaagcataaaattttgcacagactcttgcaggacagcagttcccctgtggacttggccaagttaacagcagaagccacaggcaaagacctgagccaggagtccagcagcacagctcctggatcagaagtgactattaaacaagagccggtgagccccaagaagaaagagaatgcactacttcgctatttgctagataaagatgatactaaagatattggtttaccagaaataacccccaaacttgagagactggacagtaagacagatcctgccagtaacacaaaattaatagcaatgaaaactgagaaggaggagatgagctttgagcctggtgaccagcctggcagtgagctggacaacttggaggagattttggatgatttgcagaatagtcaattaccacagcttttcccagacacgaggccaggcgcccctgctggatcagttgacaagcaagccatcatcaatgacctcatgcaactcacagctgaaaacagccctgtcacacctgttggagcccagaaaacagcactgcgaatttcacagagcacttttaataacccacgaccagggcaactgggcaggttattgccaaaccagaatttaccacttgacatcacattgcaaagcccaactggtgctggacctttcccaccaatcagaaacagtagtccctactcagtgatacctcagccaggaatgatgggtaatcaagggatgataggaaaccaaggaaatttagggaacagtagcacaggaatgattggtaacagtgcttctcggcctactatgccatctggagaatgggcaccgcagagttcggctgtgagagtcacctgtgctgctaccaccagtgccatgaaccggccagtccaaggaggtatgattcggaacccagcagccagcatccccatgaggcccagcagccagcctggccaaagacagacgcttcagtctcaggtcatgaatatagggccatctgaattagagatgaacatggggggacctcagtatagccaacaacaagctcctccaaatcagactgccccatggcctgaaagcatcctgcctatagaccaggcgtcttttgccagccaaaacaggcagccatttggcagttctccagatgacttgctatgtccacatcctgcagctgagtctccgagtgatgagggagctctcctggaccagctgtatctggccttgcggaattttgatggcctggaggagattgatagagccttaggaatacccgaactggtcagccagagccaagcagtagatccagaacagttctcaagtcaggattccaacatcatgctggagcagaaggcgcccgttttcccacagcagtatgcatctcaggcacaaatggcccagggtagctattctcccatgcaagatccaaactttcacaccatgggacagcggcctagttatgccacactccgtatgcagcccagaccgggcctcaggcccacgggcctagtgcagaaccagccaaatcaactaagacttcaacttcagcatcgcctccaagcacagcagaatcgccagccacttatgaatcaaatcagcaatgtttccaatgtgaacttgactctgaggcctggagtaccaacacaggcacctattaatgcacagatgctggcccagagacagagggaaatcctgaaccagcatcttcgacagagacaaatgcatcagcaacagcaagttcagcaacgaactttgatgatgagaggacaagggttgaatatgacaccaagcatggtggctcctagtggtatgccagcaactatgagcaaccctcggattccccaggcaaatgcacagcagtttccatttcctccaaactacggaataagtcagcaacctgatccaggctttactggggctacgactccccagagcccacttatgtcaccccgaatggcacatacacagagtcccatgatgcaacagtctcaggccaacccagcctatcaggccccctccgacataaatggatgggcgcaggggaacatgggcggaaacagcatgttttcccagcagtccccaccacactttgggcagcaagcaaacaccagcatgtacagtaacaacatgaacatcaatgtgtccatggcgaccaacacaggtggcatgagcagcatgaaccagatgacaggacagatcagcatgacctcagtgacctccgtgcctacgtcagggctgtcctccatgggtcccgagcaggttaatgatcctgctctgaggggaggcaacctgttcccaaaccagctgcctggaatggatatgattaagcaggagggagacacaacacggaaatattgctgacactgctgaagccagttgcttcttcagctgaccgggctcacttgctcaaaacacttccagtctggagagctgtgtctatttgtttcaacccaactgacctgccagccggttctgctagagcagacaggcctggccctggttcccagggtggcgtccactcggctgtggcaggaggagctgcctcttctcttgacagtctgaagctcgcatccagacagtcgctcagtctgttcactgcattcaccttagtgcaacttagatctctcctgcaaaagtaaatgttgacaggcaaatttcatacccatgtcagattgaatgtatttaaatgtatgtatttaaggagaaccatgctcttgttctgttcctgttcggttccagacactggtttcttgctttgttttccctggctaacagtctagtgcaaaagattaagattttatctgggggaaagaaaagaattttttaaaaaattaaactaaagatgttttaagctaaagcctgaatttgggatggaagcaggacagacaccgtggacagcgctgtatttacagacacacccagtgcgtgaagaccaacaaagtcacagtcgtatctctagaaagctctaaagaccatgttggaaagagtctccagttactgaacagatgaaaaggagcctgtgagagggctgttaacattagcaaatattttttccttgttttttctttgttaaaaccaaactggttcacctgaatcatgaattgagaagaaataattttcatttctaaattaagtcccttttagtttgatcagacagcttgaatcagcatctcttcttccctgtcagcctgactcttcccttcccctctctcattccccatactccctattttcattccttttttaaaaaataatataagctacagaaaccaggtaagccctttatttccttaaatgttttgccagccacttaccaattgctaagtattgaatttcagaaaaaaaaaatgcatttactggcaaggagaagagcaaagttaaggcttgataccaatcgagctaaggatacctgctttggaagcatgtttattctgttccccagcaactctggcctccaaaatgggagaaaacgccagtgtgtttaaattgatagcagatatcacgacagatttaacctctgccatgtgttttttattttgttttttagcagtgctgactaagccgaagttttgtaaggtacataaaatccaatttatatgtaaacaagcaataatttaagttgagaacttatgtgttttaattgtataatttttgtgaggtatacatattgtggaattgactcaaaaatgaggtacttcagtattaaattagatatcttcatagcaatgtctcctaaaggtgttttgtaaaggatatcaatgccttgattagacctaatttgtagacttaagactttttattttctaaaccttgtgattctgcttataagtcatttatctaatctatatgatatgcagccgctgtaggaaccaattcttgatttttatatgtttatattctttcttaatgaaccttagaaagactacatgttactaagcaggccacttatggttgtttttcttgcccactctggtaggggaaaaatcttttattaataggtgtcagtttcagacaactccaataccaagaaactgatgaccttttttgagctatttctccttaacccctaatacctttcttacctaaatttcagaatgatatctttttgatgtctaaaaagcaaagcattttataatatctcattagccaggctttttaggaacagagaagtttttccttgaaatttgattgtttgtttatttgtggcagggtgaaaaatgtacaaactacccctatttatacttatatctctctctatatgtacgcattatggaaatataggaagagatatagcccaaagatagatggtaagtagacagtctgaaaatgttgctccatactaaagaacctttctggaaatttgcatttcgctacttttttccacttgagaggggtctcaatacagggaggtggccaaggaacaacacttctcagtggccaccagttcatatatcccctcaaaaggctctacttttctccaccaaaccattgggttgcccaactgtgatggaaaaaacaagcagatgttggcccagaactccaggacctccccgtgggctgaggctcatgtggcatacaattcagtgtgaccagttttaatgttcagaaatatgtgaattagaatgacttttaacttcacacagcacaaaagagaaatggagtttaaactggatttgttttgttttgagtttcaagtcccttttcactacaacaccgtccaaaactatctacctatctcttcttttttatccatctgcccgctgtattttaatgtcaatcctaattcagacaaatccgcaacttcatgatactggtaatttataataattcgtgatcattgctgttttgaaggaaaagagatgataaattctcttacggtttcaatcaggtaatggattttgttttacatctagttaggagaagaaaagtaagtgaaggaatcctctgatcatattgatcactatagaagcaaaagccaaatcagttcccttcattatcagtatttctcatgctgtacacaataaatttgttagactgagtacttggtttttgtttaatagaacaaataatcagtgtttcacttatattactaaatgtgaaaaacataatgtgaaaagtatacatacattaacttggttgtaaaactcattttaagtgttcatgtaatgtggtaagtttaaaaagtgaagtgagctgttttactacaatgaattcgtttgactcaaagattaaaatgcccctccccctatgtgtatctcttatggcctgtaataattgaaagcaatgtttttgcagtttatataatgcaatttttaatctgtgttcaaaaatggagttcatatgggcttaacacatgaaatgggtggcacagatccacttgcagaacccaaagatacacaatcagttttgaaatgcaacttaagccattaattgttggtgtgaatttaaaattttctagtgtttgtatggtggtatgctgcctaagagcaaagcatcctctgcacaaaagaaaattactgtagtggcttcgattttaattagaattttctccctggtgtttctttatagactaaagcaaaatcttttaagtttcttactacaggtaaaagctatgtgcaagaacctcaaaatgctaaaatctagcataatgccttagatctgtttttaagtcttgtatattcctacatagctgtccgatgtattatatttgtatagtgaattgtgtacaatttttgaataagtgcatcatcacttaacctttatgttgtttgaatagtgatgatgatacatttcttcagacatttaactgtcatttttttcctttgtcattttgtggtctttcctccttgcttcccttcctgtcttccttttagtgaaggttattttctcgggtcatatgttttaatttctagctttttatttttgtgtgtttgttgtatgttatttttgatctcgaggttaccgtgaggcttgcaaatgatataactctattttcaactgctgacacgcggacgctt

SEQ ID NO: 21513 - DNA, 4610 bp, Homo sapiens
acaaaaccccaggagtcaaaacccatcatgatctagcttgctgaagccagggagaacacacccagagaaccttgggagtatctgattagggaaaatcaggagggccattttatagaagaagggtttgtactggatgaatttgaggaagaattaggaagcagtggccccttctggatcggatgctgccaaaaagcagctgggtgaattgttctgtcatctttattgaaggtgggagaaatgaaattgagctaggatgttgttggttggagagcggtcattaaggagagattcatcatccatttgcagacgatggcctgcgagaaatagcatgtaggattcgctgggctcctccttggctcctggaagcgttgtgtggagggaggaatggcgccctctgcctgttcacctccacatcgaatgtactcatccagatgcggcctctgtgatttgctttattgaaaacagtcaggaattttgatgtttttgtggtgggctttatgatgtttttttcaaaacctcaaagatgtttcacaactttttatctgttttcctacagaaatattgctgacactgctgaagccagttgcttcttcagctgaccgggctcacttgctcaaaacacttccagtctggagagctgtgtctatttgtttcaacccaactgacctgccagccggttctgctagagcagacaggcctggccctggttcccagggtggcgtccactcggctgtggcaggaggagctgcctcttctcttgacagtctgaagctcgcatccagacagtcgctcagtctgttcactgcattcaccttagtgcaacttagatctctcctgcaaaagtaaatgttgacaggcaaatttcatacccatgtcagattgaatgtatttaaatgtatgtatttaaggagaaccatgctcttgttctgttcctgttcggttccagacactggtttcttgctttgttttccctggctaacagtctagtgcaaaagattaagattttatctgggggaaagaaaagaattttttaaaaaattaaactaaagatgttttaagctaaagcctgaatttgggatggaagcaggacagacaccgtggacagcgctgtatttacagacacacccagtgcgtgaagaccaacaaagtcacagtcgtatctctagaaagctctaaagaccatgttggaaagagtctccagttactgaacagatgaaaaggagcctgtgagagggctgttaacattagcaaatattttttccttgttttttctttgttaaaaccaaactggttcacctgaatcatgaattgagaagaaataattttcatttctaaattaagtcccttttagtttgatcagacagcttgaatcagcatctcttcttccctgtcagcctgactcttcccttcccctctctcattccccatactccctattttcattccttttttaaaaaataatataagctacagaaaccaggtaagccctttatttccttaaatgttttgccagccacttaccaattgctaagtattgaatttcagaaaaaaaaaatgcatttactggcaaggagaagagcaaagttaaggcttgataccaatcgagctaaggatacctgctttggaagcatgtttattctgttccccagcaactctggcctccaaaatgggagaaaacgccagtgtgtttaaattgatagcagatatcacgacagatttaacctctgccatgtgttttttattttgttttttagcagtgctgactaagccgaagttttgtaaggtacataaaatccaatttatatgtaaacaagcaataatttaagttgagaacttatgtgttttaattgtataatttttgtgaggtatacatattgtggaattgactcaaaaatgaggtacttcagtattaaattagatatcttcatagcaatgtctcctaaaggtgttttgtaaaggatatcaatgccttgattagacctaatttgtagacttaagactttttattttctaaaccttgtgattctgcttataagtcatttatctaatctatatgatatgcagccgctgtaggaaccaattcttgatttttatatgtttatattctttcttaatgaaccttagaaagactacatgttactaagcaggccacttatggttgtttttcttgcccactctggtaggggaaaaatcttttattaataggtgtcagtttcagacaactccaataccaagaaactgatgaccttttttgagctatttctccttaacccctaatacctttcttacctaaatttcagaatgatatctttttgatgtctaaaaagcaaagcattttataatatctcattagccaggctttttaggaacagagaagtttttccttgaaatttgattgtttgtttatttgtggcagggtgaaaaatgtacaaactacccctatttatacttatatctctctctatatgtacgcattatggaaatataggaagagatatagcccaaagatagatggtaagtagacagtctgaaaatgttgctccatactaaagaacctttctggaaatttgcatttcgctacttttttccacttgagaggggtctcaatacagggaggtggccaaggaacaacacttctcagtggccaccagttcatatatcccctcaaaaggctctacttttctccaccaaaccattgggttgcccaactgtgatggaaaaaacaagcagatgttggcccagaactccaggacctccccgtgggctgaggctcatgtggcatacaattcagtgtgaccagttttaatgttcagaaatatgtgaattagaatgacttttaacttcacacagcacaaaagagaaatggagtttaaactggatttgttttgttttgagtttcaagtcccttttcactacaacaccgtccaaaactatctacctatctcttcttttttatccatctgcccgctgtattttaatgtcaatcctaattcagacaaatccgcaacttcatgatactggtaatttataataattcgtgatcattgctgttttgaaggaaaagagatgataaattctcttacggtttcaatcaggtaatggattttgttttacatctagttaggagaagaaaagtaagtgaaggaatcctctgatcatattgatcactatagaagcaaaagccaaatcagttcccttcattatcagtatttctcatgctgtacacaataaatttgttagactgagtacttggtttttgtttaatagaacaaataatcagtgtttcacttatattactaaatgtgaaaaacataatgtgaaaagtatacatacattaacttggttgtaaaactcattttaagtgttcatgtaatgtggtaagtttaaaaagtgaagtgagctgttttactacaatgaattcgtttgactcaaagattaaaatgcccctccccctatgtgtatctcttatggcctgtaataattgaaagcaatgtttttgcagtttatataatgcaatttttaatctgtgttcaaaaatggagttcatatgggcttaacacatgaaatgggtggcacagatccacttgcagaacccaaagatacacaatcagttttgaaatgcaacttaagccattaattgttggtgtgaatttaaaattttctagtgtttgtatggtggtatgctgcctaagagcaaagcatcctctgcacaaaagaaaattactgtagtggcttcgattttaattagaattttctccctggtgtttctttatagactaaagcaaaatcttttaagtttcttactacaggtaaaagctatgtgcaagaacctcaaaatgctaaaatctagcataatgccttagatctgtttttaagtcttgtatattcctacatagctgtccgatgtattatatttgtatagtgaattgtgtacaatttttgaataagtgcatcatcacttaacctttatgttgtttgaatagtgatgatgatacatttcttcagacatttaactgtcatttttttcctttgtcatttgtgagttttatttgtacagttcctcatgaagttgcatctgagatgtgtgtatatgaaaagattatacaagggtaaaattaagcaatatattaactatggttcttcaggagaaagcttacagtgtttcaggttgtgatttattttcaaaatggagttgactctgaacatcactttgttcacctgcattgatgtttgtatttctagtgtgagcagtttatgcaaaggtagatatattcagagaaattttaaatacatttatgcaagttaatattgctttgctgatgctatttgcttatttgatgttaaataatgctattgtaaataaagaattctgttgttattgcatcatttaataaattttaatgccttcgggttttacatggctttagagattttaatgtgtttatattgtatcttctttcataattgcatttaaaaagaccttgtaatttaataatttattatatttatatggtagttgacactgttgacagcaccttaacatttaattcttccaataacccattttataaatttttacatttgaaataaaggattatctaataacttaa

SEQ ID NO: 21514 - DNA, 3847 bp, Homo sapiens
ggcggccgcagcctcggctacagcttcggcggcgaaggtcagcgccgacggcagccggcacctgacggcgtgaccgacccgagccgatttctcttggatttggctacacacttatagatcttctgcactgtttacaggcacagttgctgatatgtgttcaagatgagtgggatgggagaaaatacctctgacccctccagggcagagacaagaaagcgcaaggaatgtcctgaccaacttggacccagccccaaaaggaacactgaaaaacgtaatcgtgaacaggaaaataaatatatagaagaacttgcagagttgatttttgcaaattttaatgatatagacaactttaacttcaaacctgacaaatgtgcaatcttaaaagaaactgtgaagcaaattcgtcagatcaaagaacaagagaaagcagcagctgccaacatagatgaagtgcagaagtcagatgtatcctctacagggcagggtgtcatcgacaaggatgcgctggggcctatgatgcttgaggcccttgatgggttcttctttgtagtgaacctggaaggcaacgttgtgtttgtgtcagagaatgtgacacagtatctaaggtataaccaagaagagctgatgaacaaaagtgtatatagcatcttgcatgttggggaccacacggaatttgtcaaaaacctgctgccaaagtctatagtaaatgggggatcttggtctggcgaacctccgaggcggaacagccataccttcaattgtcggatgctggtaaaacctttacctgattcagaagaggagggtcatgataaccaggaagctcatcagaaatatgaaactatgcagtgcttcgctgtctctcaaccaaagtccatcaaagaagaaggagaagatttgcagtcctgcttgatttgcgtggcaagaagagttcccatgaaggaaagaccagttcttccctcatcagaaagttttactactcgccaggatctccaaggcaagatcacgtctctggataccagcaccatgagagcagccatgaaaccaggctgggaggacctggtaagaaggtgtattcagaagttccatgcgcagcatgaaggagaatctgtgtcctatgctaagaggcatcatcatgaagtactgagacaaggattggcattcagtcaaatctatcgtttttccttgtctgatggcactcttgttgctgcacaaacgaagagcaaactcatccgttctcagactactaatgaacctcaacttgtaatatctttacatatgcttcacagagagcagaatgtgtgtgtgatgaatccggatctgactggacaaacgatggggaagccactgaatccaattagctctaacagccctgcccatcaggccctgtgcagtgggaacccaggtcaggacatgaccctcagtagcaatataaattttcccataaatggcccaaaggaacaaatgggcatgcccatgggcaggtttggtggttctgggggaatgaaccatgtgtcaggcatgcaagcaaccactcctcagggtagtaactatgcactcaaaatgaacagcccctcacaaagcagccctggcatgaatccaggacagcccacctccatgctttcaccaaggcatcgcatgagccctggagtggctggcagccctcgaatcccacccagtcagttttcccctgcaggaagcttgcattcccctgtgggagtttgcagcagcacaggaaatagccatagttataccaacagctccctcaatgcacttcaggccctcagcgaggggcacggggtctcattagggtcatcgttggcttcaccagacctaaaaatgggcaatttgcaaaactccccagttaatatgaatcctcccccactcagcaagatgggaagcttggactcaaaagactgttttggactatatggggagccctctgaaggtacaactggacaagcagagagcagctgccatcctggagagcaaaaggaaacaaatgaccccaacctgcccccggccgtgagcagtgagagagctgacgggcagagcagactgcatgacagcaaagggcagaccaaactcctgcagctgctgaccaccaaatctgatcagatggagccctcgcccttagccagctctttgtcggatacaaacaaagactccacaggtagcttgcctggttctgggtctacacatggaacctcgctcaaggagaagcataaaattttgcacagactcttgcaggacagcagttcccctgtggacttggccaagttaacagcagaagccacaggcaaagacctgagccaggagtccagcagcacagctcctggatcagaagtgactattaaacaagagccggtgagccccaagaagaaagagaatgcactacttcgctatttgctagataaagatgatactaaagatattggtttaccagaaataacccccaaacttgagagactggacagtaagacagatcctgccagtaacacaaaattaatagcaatgaaaactgagaaggaggagatgagctttgagcctggtgaccagcctggcagtgagctggacaacttggaggagattttggatgatttgcagaatagtcaattaccacagcttttcccagacacgaggccaggcgcccctgctggatcagttgacaagcaagccatcatcaatgacctcatgcaactcacagctgaaaacagccctgtcacacctgttggagcccagaaaacagcactgcgaatttcacagagcagaatgattggtaacagtgcttctcggcctactatgccatctggagaatgggcaccgcagagttcggctgtgagagtcacctgtgctgctaccaccagtgccatgaaccggccagtccaaggaggtatgattcggaacccagcagccagcatccccatgaggcccagcagccagcctggccaaagacagacgcttcagtctcaggtcatgaatatagggccatctgaattagagatgaacatggggggacctcagtatagccaacaacaagctcctccaaatcagactgccccatggcctgaaagcatcctgcctatagaccaggcgtcttttgccagccaaaacaggcagccatttggcagttctccagatgacttgctatgtccacatcctgcagctgagtctccgagtgatgagggagctctcctggaccagctgtatctggccttgcggaattttgatggcctggaggagattgatagagccttaggaatacccgaactggtcagccaggtatgcgcggaagggcagcaggtgggggccaagcgctctcatgggcgcagaggtgtccattttctgtttacaggtactccacggtctgctttttagaatatattgttgttgttttttttacctcaaaacaggctggccctgtttcttcctcccctttccttgtaaccctcacataaacttttgcctgagaatggagagcactgaaaatgagcattgcatacagttcaagttagcagaaagacacaaactcaagtccatttcacctggtgtccgcccttgctgatagggaaggacacacaagatacagagaaaccacaaacagcacattgctgccttgtgacctagaacgcttccccctggaagttggtgtgagtgtagtcgtgaccccagtattcatttcacacctgtgggctggtgataggaagctgtttgtgctaaaagaatactttccacataagttagcagaagtcattttacaggtagctgcaactctttcatcatttttacctttaaaaatggcgggttaaacctttcacttatggtttagcccaggagttcaaggatgtag

SEQ ID NO: 21515 - DNA, 293 bp, Homo sapiens
atattcccaagttgtaaaaatggtaaagatttttcctcctctagattatgaaagtatttagacaagtataaaagtagtacataaagatgaaataatcatatttttcctacatcattttaataattcagaggcaatgaatctgatgtttgtttctttgtaaaactggattacttttgccttgctcagtaaatgggggatcttggtctggcgaacctccgaggcggaacagccataccttcaattgtcggatgctggtaaaacctttacctgattcagaagaggagggtcatgat

SEQ ID NO: 21516 - DNA, 313 bp, Homo sapiens
tacccacctaccactttcatgaagagaataaaaccagtaggaagctcaggtacatagtgtttcatcactgtctcccttactgcttttttaatgacaggctgtgctgtcataaatacacttgggtttgtttgaatcactagaaaagcccaatatgataaatgtaaacatgtgtggtttaagatttgcagtcctgcttgatttgcgtggcaagaagagttcccatgaaggaaagaccagttcttccctcatcagaaagttttactactcgccaggatctccaaggtaaatttcctctccaaagaagaccaaagga

SEQ ID NO: 21517 - DNA, 8579 bp, Homo sapiens
ggcggccgcagcctcggctacagcttcggcggcgaaggtcagcgccgacggcagccggcacctgacggcgtgaccgacccgagccgatttctcttggatttggctacacacttatagatcttctgcactgtttacaggcacagttgctgatatgtgttcaagatgagtgggatgggagaaaatacctctgacccctccagggcagagacaagaaagcgcaaggaatgtcctgaccaacttggacccagccccaaaaggaacactgaaaaacgtaatcgtgaacaggaaaataaatatatagaagaacttgcagagttgatttttgcaaattttaatgatatagacaactttaacttcaaacctgacaaatgtgcaatcttaaaagaaactgtgaagcaaattcgtcagatcaaagaacaagagaaagcagcagctgccaacatagatgaagtgcagaagtcagatgtatcctctacagggcagggtgtcatcgacaaggatgcgctggggcctatgatgcttgaggcccttgatgggttcttctttgtagtgaacctggaaggcaacgttgtgtttgtgtcagagaatgtgacacagtatctaaggtataaccaagaagagctgatgaacaaaagtgtatatagcatcttgcatgttggggaccacacggaatttgtcaaaaacctgctgccaaagtctatagtaaatgggggatcttggtctggcgaacctccgaggcggaacagccataccttcaattgtcggatgctggtaaaacctttacctgattcagaagaggagggtcatgataaccaggaagctcatcagaaatatgaaactatgcagtgcttcgctgtctctcaaccaaagtccatcaaagaagaaggagaagatttgcagtcctgcttgatttgcgtggcaagaagagttcccatgaaggaaagaccagttcttccctcatcagaaagttttactactcgccaggatctccaaggcaagatcacgtctctggataccagcaccatgagagcagccatgaaaccaggctgggaggacctggtaagaaggtgtattcagaagttccatgcgcagcatgaaggagaatctgtgtcctatgctaagaggcatcatcatgaagtactgagacaaggattggcattcagtcaaatctatcgtttttccttgtctgatggcactcttgttgctgcacaaacgaagagcaaactcatccgttctcagactactaatgaacctcaacttgtaatatctttacatatgcttcacagagagcagaatgtgtgtgtgatgaatccggatctgactggacaaacgatggggaagccactgaatccaattagctctaacagccctgcccatcaggccctgtgcagtgggaacccaggtcaggacatgaccctcagtagcaatataaattttcccataaatggcccaaaggaacaaatgggcatgcccatgggcaggtttggtggttctgggggaatgaaccatgtgtcaggcatgcaagcaaccactcctcagggtagtaactatgcactcaaaatgaacagcccctcacaaagcagccctggcatgaatccaggacagcccacctccatgctttcaccaaggcatcgcatgagccctggagtggctggcagccctcgaatcccacccagtcagttttcccctgcaggaagcttgcattcccctgtgggagtttgcagcagcacaggaaatagccatagttataccaacagctccctcaatgcacttcaggccctcagcgaggggcacggggtctcattagggtcatcgttggcttcaccagacctaaaaatgggcaatttgcaaaactccccagttaatatgaatcctcccccactcagcaagatgggaagcttggactcaaaagactgttttggactatatggggagccctctgaaggtacaactggacaagcagagagcagctgccatcctggagagcaaaaggaaacaaatgaccccaacctgcccccggccgtgagcagtgagagagctgacgggcagagcagactgcatgacagcaaagggcagaccaaactcctgcagctgctgaccaccaaatctgatcagatggagccctcgcccttagccagctctttgtcggatacaaacaaagactccacaggtagcttgcctggttctgggtctacacatggaacctcgctcaaggagaagcataaaattttgcacagactcttgcaggacagcagttcccctgtggacttggccaagttaacagcagaagccacaggcaaagacctgagccaggagtccagcagcacagctcctggatcagaagtgactattaaacaagagccggtgagccccaagaagaaagagaatgcactacttcgctatttgctagataaagatgatactaaagatattggtttaccagaaataacccccaaacttgagagactggacagtaagacagatcctgccagtaacacaaaattaatagcaatgaaaactgagaaggaggagatgagctttgagcctggtgaccagcctggcagtgagctggacaacttggaggagattttggatgatttgcagaatagtcaattaccacagcttttcccagacacgaggccaggcgcccctgctggatcagttgacaagcaagccatcatcaatgacctcatgcaactcacagctgaaaacagccctgtcacacctgttggagcccagaaaacagcactgcgaatttcacagagcacttttaataacccacgaccagggcaactgggcaggttattgccaaaccagaatttaccacttgacatcacattgcaaagcccaactggtgctggacctttcccaccaatcagaaacagtagtccctactcagtgatacctcagccaggaatgatgggtaatcaagggatgataggaaaccaaggaaatttagggaacagtagcacaggaatgattggtaacagtgcttctcggcctactatgccatctggagaatgggcaccgcagagttcggctgtgagagtcacctgtgctgctaccaccagtgccatgaaccggccagtccaaggaggtatgattcggaacccagcagccagcatccccatgaggcccagcagccagcctggccaaagacagacgcttcagtctcaggtcatgaatatagggccatctgaattagagatgaacatggggggacctcagtatagccaacaacaagctcctccaaatcagactgccccatggcctgaaagcatcctgcctatagaccaggcgtcttttgccagccaaaacaggcagccatttggcagttctccagatgacttgctatgtccacatcctgcagctgagtctccgagtgatgagggagctctcctggaccagctgtatctggccttgcggaattttgatggcctggaggagattgatagagccttaggaatacccgaactggtcagccagagccaagcagtagatccagaacagttctcaagtcaggattccaacatcatgctggagcagaaggcgcccgttttcccacagcagtatgcatctcaggcacaaatggcccagggtagctattctcccatgcaagatccaaactttcacaccatgggacagcggcctagttatgccacactccgtatgcagcccagaccgggcctcaggcccacgggcctagtgcagaaccagccaaatcaactaagacttcaacttcagcatcgcctccaagcacagcagaatcgccagccacttatgaatcaaatcagcaatgtttccaatgtgaacttgactctgaggcctggagtaccaacacaggcacctattaatgcacagatgctggcccagagacagagggaaatcctgaaccagcatcttcgacagagacaaatgcatcagcaacagcaagttcagcaacgaactttgatgatgagaggacaagggttgaatatgacaccaagcatggtggctcctagtggtatgccagcaactatgagcaaccctcggattccccaggcaaatgcacagcagtttccatttcctccaaactacggaataagtcagcaacctgatccaggctttactggggctacgactccccagagcccacttatgtcaccccgaatggcacatacacagagtcccatgatgcaacagtctcaggccaacccagcctatcaggccccctccgacataaatggatgggcgcaggggaacatgggcggaaacagcatgttttcccagcagtccccaccacactttgggcagcaagcaaacaccagcatgtacagtaacaacatgaacatcaatgtgtccatggcgaccaacacaggtggcatgagcagcatgaaccagatgacaggacagatcagcatgacctcagtgacctccgtgcctacgtcagggctgtcctccatgggtcccgagcaggttaatgatcctgctctgaggggaggcaacctgttcccaaaccagctgcctggaatggatatgattaagcaggagggagacacaacacggaaatattgctgacactgctgaagccagttgcttcttcagctgaccgggctcacttgctcaaaacacttccagtctggagagctgtgtctatttgtttcaacccaactgacctgccagccggttctgctagagcagacaggcctggccctggttcccagggtggcgtccactcggctgtggcaggaggagctgcctcttctcttgacagtctgaagctcgcatccagacagtcgctcagtctgttcactgcattcaccttagtgcaacttagatctctcctgcaaaagtaaatgttgacaggcaaatttcatacccatgtcagattgaatgtatttaaatgtatgtatttaaggagaaccatgctcttgttctgttcctgttcggttccagacactggtttcttgctttgttttccctggctaacagtctagtgcaaaagattaagattttatctgggggaaagaaaagaattttttaaaaaattaaactaaagatgttttaagctaaagcctgaatttgggatggaagcaggacagacaccgtggacagcgctgtatttacagacacacccagtgcgtgaagaccaacaaagtcacagtcgtatctctagaaagctctaaagaccatgttggaaagagtctccagttactgaacagatgaaaaggagcctgtgagagggctgttaacattagcaaatattttttccttgttttttctttgttaaaaccaaactggttcacctgaatcatgaattgagaagaaataattttcatttctaaattaagtcccttttagtttgatcagacagcttgaatcagcatctcttcttccctgtcagcctgactcttcccttcccctctctcattccccatactccctattttcattccttttttaaaaaataatataagctacagaaaccaggtaagccctttatttccttaaatgttttgccagccacttaccaattgctaagtattgaatttcagaaaaaaaaaatgcatttactggcaaggagaagagcaaagttaaggcttgataccaatcgagctaaggatacctgctttggaagcatgtttattctgttccccagcaactctggcctccaaaatgggagaaaacgccagtgtgtttaaattgatagcagatatcacgacagatttaacctctgccatgtgttttttattttgttttttagcagtgctgactaagccgaagttttgtaaggtacataaaatccaatttatatgtaaacaagcaataatttaagttgagaacttatgtgttttaattgtataatttttgtgaggtatacatattgtggaattgactcaaaaatgaggtacttcagtattaaattagatatcttcatagcaatgtctcctaaaggtgttttgtaaaggatatcaatgccttgattagacctaatttgtagacttaagactttttattttctaaaccttgtgattctgcttataagtcatttatctaatctatatgatatgcagccgctgtaggaaccaattcttgatttttatatgtttatattctttcttaatgaaccttagaaagactacatgttactaagcaggccacttatggttgtttttcttgcccactctggtaggggaaaaatcttttattaataggtgtcagtttcagacaactccaataccaagaaactgatgaccttttttgagctatttctccttaacccctaatacctttcttacctaaatttcagaatgatatctttttgatgtctaaaaagcaaagcattttataatatctcattagccaggctttttaggaacagagaagtttttccttgaaatttgattgtttgtttatttgtggcagggtgaaaaatgtacaaactacccctatttatacttatatctctctctatatgtacgcattatggaaatataggaagagatatagcccaaagatagatggtaagtagacagtctgaaaatgttgctccatactaaagaacctttctggaaatttgcatttcgctacttttttccacttgagaggggtctcaatacagggaggtggccaaggaacaacacttctcagtggccaccagttcatatatcccctcaaaaggctctacttttctccaccaaaccattgggttgcccaactgtgatggaaaaaacaagcagatgttggcccagaactccaggacctccccgtgggctgaggctcatgtggcatacaattcagtgtgaccagttttaatgttcagaaatatgtgaattagaatgacttttaacttcacacagcacaaaagagaaatggagtttaaactggatttgttttgttttgagtttcaagtcccttttcactacaacaccgtccaaaactatctacctatctcttcttttttatccatctgcccgctgtattttaatgtcaatcctaattcagacaaatccgcaacttcatgatactggtaatttataataattcgtgatcattgctgttttgaaggaaaagagatgataaattctcttacggtttcaatcaggtaatggattttgttttacatctagttaggagaagaaaagtaagtgaaggaatcctctgatcatattgatcactatagaagcaaaagccaaatcagttcccttcattatcagtatttctcatgctgtacacaataaatttgttagactgagtacttggtttttgtttaatagaacaaataatcagtgtttcacttatattactaaatgtgaaaaacataatgtgaaaagtatacatacattaacttggttgtaaaactcattttaagtgttcatgtaatgtggtaagtttaaaaagtgaagtgagctgttttactacaatgaattcgtttgactcaaagattaaaatgcccctccccctatgtgtatctcttatggcctgtaataattgaaagcaatgtttttgcagtttatataatgcaatttttaatctgtgttcaaaaatggagttcatatgggcttaacacatgaaatgggtggcacagatccacttgcagaacccaaagatacacaatcagttttgaaatgcaacttaagccattaattgttggtgtgaatttaaaattttctagtgtttgtatggtggtatgctgcctaagagcaaagcatcctctgcacaaaagaaaattactgtagtggcttcgattttaattagaattttctccctggtgtttctttatagactaaagcaaaatcttttaagtttcttactacaggtaaaagctatgtgcaagaacctcaaaatgctaaaatctagcataatgccttagatctgtttttaagtcttgtatattcctacatagctgtccgatgtattatatttgtatagtgaattgtgtacaatttttgaataagtgcatcatcacttaacctttatgttgtttgaatagtgatgatgatacatttcttcagacatttaactgtcatttttttcctttgtcatttgtgagttttatttgtacagttcctcatgaagttgcatctgagatgtgtgtatatgaaaagattatacaagggtaaaattaagcaatatattaactatggttcttcaggagaaagcttacagtgtttcaggttgtgatttattttcaaaatggagttgactctgaacatcactttgttcacctgcattgatgtttgtatttctagtgtgagcagtttatgcaaaggtagatatattcagagaaattttaaatacatttatgcaagttaatattgctttgctgatgctatttgcttatttgatgttaaataatgctattgtaaataaagaattctgttgttattgcatcatttaataaattttaatgccttcgggaaaaaaacaaacaccacaaaaaaaaaaaaatttttgggccgcttgggcccaggaaaaaggttttttaaccctcttgttgtgggcgcggggccccatttgggttagtgggaccttgggcaatagcggtcccaagggaaatccggcccaggacaggggttgggttttctccccatttaaag

SEQ ID NO: 21518 - DNA, 8185 bp, Homo sapiens
  misc_feature (8151)..(8151): n is a, c, g, or t
ggcggccgcagcctcggctacagcttcggcggcgaaggtcagcgccgacggcagccggcacctgacggcgtgaccgacccgagccgatttctcttggatttggctacacacttatagatcttctgcactgtttacaggcacagttgctgatatgtgttcaagatgagtgggatgggagaaaatacctctgacccctccagggcagagacaagaaagcgcaaggaatgtcctgaccaacttggacccagccccaaaaggaacactgaaaaacgtaatcgtgaacaggaaaataaatatatagaagaacttgcagagttgatttttgcaaattttaatgatatagacaactttaacttcaaacctgacaaatgtgcaatcttaaaagaaactgtgaagcaaattcgtcagatcaaagaacaagagaaagcagcagctgccaacatagatgaagtgcagaagtcagatgtatcctctacagggcagggtgtcatcgacaaggatgcgctggggcctatgatgcttgaggcccttgatgggttcttctttgtagtgaacctggaaggcaacgttgtgtttgtgtcagagaatgtgacacagtatctaaggtataaccaagaagagctgatgaacaaaagtgtatatagcatcttgcatgttggggaccacacggaatttgtcaaaaacctgctgccaaagtctatagtaaatgggggatcttggtctggcgaacctccgaggcggaacagccataccttcaattgtcggatgctggtaaaacctttacctgattcagaagaggagggtcatgataaccaggaagctcatcagaaatatgaaactatgcagtgcttcgctgtctctcaaccaaagtccatcaaagaagaaggagaagatttgcagtcctgcttgatttgcgtggcaagaagagttcccatgaaggaaagaccagttcttccctcatcagaaagttttactactcgccaggatctccaaggcaagatcacgtctctggataccagcaccatgagagcagccatgaaaccaggctgggaggacctggtaagaaggtgtattcagaagttccatgcgcagcatgaaggagaatctgtgtcctatgctaagaggcatcatcatgaagtactgagacaaggattggcattcagtcaaatctatcgtttttccttgtctgatggcactcttgttgctgcacaaacgaagagcaaactcatccgttctcagactactaatgaacctcaacttgtaatatctttacatatgcttcacagagagcagaatgtgtgtgtgatgaatccggatctgactggacaaacgatggggaagccactgaatccaattagctctaacagccctgcccatcaggccctgtgcagtgggaacccaggtcaggacatgaccctcagtagcaatataaattttcccataaatggcccaaaggaacaaatgggcatgcccatgggcaggtttggtggttctgggggaatgaaccatgtgtcaggcatgcaagcaaccactcctcagggtagtaactatgcactcaaaatgaacagcccctcacaaagcagccctggcatgaatccaggacagcccacctccatgctttcaccaaggcatcgcatgagccctggagtggctggcagccctcgaatcccacccagtcagttttcccctgcaggaagcttgcattcccctgtgggagtttgcagcagcacaggaaatagccatagttataccaacagctccctcaatgcacttcaggccctcagcgaggggcacggggtctcattagggtcatcgttggcttcaccagacctaaaaatgggcaatttgcaaaactccccagttaatatgaatcctcccccactcagcaagatgggaagcttggactcaaaagactgttttggactatatggggagccctctgaaggtacaactggacaagcagagagcagctgccatcctggagagcaaaaggaaacaaatgaccccaacctgcccccggccgtgagcagtgagagagctgacgggcagagcagactgcatgacagcaaagggcagaccaaactcctgcagctgctgaccaccaaatctgatcagatggagccctcgcccttagccagctctttgtcggatacaaacaaagactccacaggtagcttgcctggttctgggtctacacatggaacctcgctcaaggagaagcataaaattttgcacagactcttgcaggacagcagttcccctgtggacttggccaagttaacagcagaagccacaggcaaagacctgagccaggagtccagcagcacagctcctggatcagaagtgactattaaacaagagccggtgagccccaagaagaaagagaatgcactacttcgctatttgctagataaagatgatactaaagatattggtttaccagaaataacccccaaacttgagagactggacagtaagacagatcctgccagtaacacaaaattaatagcaatgaaaactgagaaggaggagatgagctttgagcctggtgaccagcctggcagtgagctggacaacttggaggagattttggatgatttgcagaatagtcaattaccacagcttttcccagacacgaggccaggcgcccctgctggatcagttgacaagcaagccatcatcaatgacctcatgcaactcacagctgaaaacagccctgtcacacctgttggagcccagaaaacagcactgcgaatttcacagagcacttttaataacccacgaccagggcaactgggcaggttattgccaaaccagaatttaccacttgacatcacattgcaaagcccaactggtgctggacctttcccaccaatcagaaacagtagtccctactcagtgatacctcagccaggaatgatgggtaatcaagggatgataggaaaccaaggaaatttagggaacagtagcacaggaatgattggtaacagtgcttctcggcctactatgccatctggagaatgggcaccgcagagttcggctgtgagagtcacctgtgctgctaccaccagtgccatgaaccggccagtccaaggaggtatgattcggaacccagcagccagcatccccatgaggcccagcagccagcctggccaaagacagacgcttcagtctcaggtcatgaatatagggccatctgaattagagatgaacatggggggacctcagtatagccaacaacaagctcctccaaatcagactgccccatggcctgaaagcatcctgcctatagaccaggcgtcttttgccagccaaaacaggcagccatttggcagttctccagatgacttgctatgtccacatcctgcagctgagtctccgagtgatgagggagctctcctggaccagctgtatctggccttgcggaattttgatggcctggaggagattgatagagccttaggaatacccgaactggtcagccagagccaagcagtagatccagaacagttctcaagtcaggattccaacatcatgctggagcagaaggcgcccgttttcccacagcagtatgcatctcaggcacaaatggcccagggtagctattctcccatgcaagatccaaactttcacaccatgggacagcggcctagttatgccacactccgtatgcagcccagaccgggcctcaggcccacgggcctagtgcagaaccagccaaatcaactaagacttcaacttcagcatcgcctccaagcacagcagaatcgccagccacttatgaatcaaatcagcaatgtttccaatgtgaacttgactctgaggcctggagtaccaacacaggcacctattaatgcacagatgctggcccagagacagagggaaatcctgaaccagcatcttcgacagagacaaatgcatcagcaacagcaagttcagcaacgaactttgatgatgagaggacaagggttgaatatgacaccaagcatggtggctcctagtggtatgccagcaactatgagcaaccctcggattccccaggcaaatgcacagcagtttccatttcctccaaactacggaataagtcagcaacctgatccaggctttactggggctacgactccccagagcccacttatgtcaccccgaatggcacatacacagagtcccatgatgcaacagtctcaggccaacccagcctatcaggccccctccgacataaatggatgggcgcaggggaacatgggcggaaacagcatgttttcccagcagtccccaccacactttgggcagcaagcaaacaccagcatgtacagtaacaacatgaacatcaatgtgtccatggcgaccaacacaggtggcatgagcagcatgaaccagatgacaggacagatcagcatgacctcagtgacctccgtgcctacgtcagggctgtcctccatgggtcccgagcaggttaatgatcctgctctgaggggaggcaacctgttcccaaaccagctgcctggaatggatatgattaagcaggagggagacacaacacggaaatattgctgacactgctgaagccagttgcttcttcagctgaccgggctcacttgctcaaaacacttccagtctggagagctgtgtctatttgtttcaacccaactgacctgccagccggttctgctagagcagacaggcctggccctggttcccagggtggcgtccactcggctgtggcaggaggagctgcctcttctcttgacagtctgaagctcgcatccagacagtcgctcagtctgttcactgcattcaccttagtgcaacttagatctctcctgcaaaagtaaatgttgacaggcaaatttcatacccatgtcagattgaatgtatttaaatgtatgtatttaaggagaaccatgctcttgttctgttcctgttcggttccagacactggtttcttgctttgttttccctggctaacagtctagtgcaaaagattaagattttatctgggggaaagaaaagaattttttaaaaaattaaactaaagatgttttaagctaaagcctgaatttgggatggaagcaggacagacaccgtggacagcgctgtatttacagacacacccagtgcgtgaagaccaacaaagtcacagtcgtatctctagaaagctctaaagaccatgttggaaagagtctccagttactgaacagatgaaaaggagcctgtgagagggctgttaacattagcaaatattttttccttgttttttctttgttaaaaccaaactggttcacctgaatcatgaattgagaagaaataattttcatttctaaattaagtcccttttagtttgatcagacagcttgaatcagcatctcttcttccctgtcagcctgactcttcccttcccctctctcattccccatactccctattttcattccttttttaaaaaataatataagctacagaaaccaggtaagccctttatttccttaaatgttttgccagccacttaccaattgctaagtattgaatttcagaaaaaaaaaatgcatttactggcaaggagaagagcaaagttaaggcttgataccaatcgagctaaggatacctgctttggaagcatgtttattctgttccccagcaactctggcctccaaaatgggagaaaacgccagtgtgtttaaattgatagcagatatcacgacagatttaacctctgccatgtgttttttattttgttttttagcagtgctgactaagccgaagttttgtaaggtacataaaatccaatttatatgtaaacaagcaataatttaagttgagaacttatgtgttttaattgtataatttttgtgaggtatacatattgtggaattgactcaaaaatgaggtacttcagtattaaattagatatcttcatagcaatgtctcctaaaggtgttttgtaaaggatatcaatgccttgattagacctaatttgtagacttaagactttttattttctaaaccttgtgattctgcttataagtcatttatctaatctatatgatatgcagccgctgtaggaaccaattcttgatttttatatgtttatattctttcttaatgaaccttagaaagactacatgttactaagcaggccacttatggttgtttttcttgcccactctggtaggggaaaaatcttttattaataggtgtcagtttcagacaactccaataccaagaaactgatgaccttttttgagctatttctccttaacccctaatacctttcttacctaaatttcagaatgatatctttttgatgtctaaaaagcaaagcattttataatatctcattagccaggctttttaggaacagagaagtttttccttgaaatttgattgtttgtttatttgtggcagggtgaaaaatgtacaaactacccctatttatacttatatctctctctatatgtacgcattatggaaatataggaagagatatagcccaaagatagatggtaagtagacagtctgaaaatgttgctccatactaaagaacctttctggaaatttgcatttcgctacttttttccacttgagaggggtctcaatacagggaggtggccaaggaacaacacttctcagtggccaccagttcatatatcccctcaaaaggctctacttttctccaccaaaccattgggttgcccaactgtgatggaaaaaacaagcagatgttggcccagaactccaggacctccccgtgggctgaggctcatgtggcatacaattcagtgtgaccagttttaatgttcagaaatatgtgaattagaatgacttttaacttcacacagcacaaaagagaaatggagtttaaactggatttgttttgttttgagtttcaagtcccttttcactacaacaccgtccaaaactatctacctatctcttcttttttatccatctgcccgctgtattttaatgtcaatcctaattcagacaaatccgcaacttcatgatactggtaatttataataattcgtgatcattgctgttttgaaggaaaagagatgataaattctcttacggtttcaatcaggtaatggattttgttttacatctagttaggagaagaaaagtaagtgaaggaatcctctgatcatattgatcactatagaagcaaaagccaaatcagttcccttcattatcagtatttctcatgctgtacacaataaatttgttagactgagtacttggtttttgtttaatagaacaaataatcagtgtttcacttatattactaaatgtgaaaaacataatgtgaaaagtatacatacattaacttggttgtaaaactcattttaagtgttcatgtaatgtggtaagtttaaaaagtgaagtgagctgttttactacaatgaattcgtttgactcaaagattaaaatgcccctccccctatgtgtatctcttatggcctgtaataattgaaagcaatgtttttgcagtttatataatgcaatttttaatctgtgttcaaaaatggagttcatatgggcttaacacatgaaatgggtggcacagatccacttgcagaacccaaagatacacaatcagttttgaaatgcaacttaagccattaattgttggtgtgaatttaaaattttctagtgtttgtatggtggtatgctgcctaagagcaaagcatcctctgcacaaaagaaaattactgtagtggcttcgattttaattagaattttctccctggtgtttctttatagactaaagcaaaatcttttaagtttcttactacaggtaaaagctatgtgcaagaacctcaaaatgctaaaatctagcataatgccttagatctgtttttaagtcttgtatattcctacatagctgtccgatgtattatatttgtatagtgaattgtgtacaatttttgaataagtgcatcatcacttaacctttatgttgtttgaatagtgatgatgatacatttcttcagacatttaactgtcatttttttcctttgtcatttgtgagttttatttgtacagttcctcatgaagttgcatctgagatgtgtgtatatgaaaagattatacaagggtaaaattaagcaatatattaactatggttcttcaggagaaagcttagctacngccaatttaaataagggtcctctagagtcaccct

SEQ ID NO: 21519 - DNA, 8392 bp, Homo sapiens
ggcggccgcagcctcggctacagcttcggcggcgaaggtcagcgccgacggcagccggcacctgacggcgtgaccgacccgagccgatttctcttggatttggctacacacttatagatcttctgcactgtttacaggcacagttgctgatatgtgttcaagatgagtgggatgggagaaaatacctctgacccctccagggcagagacaagaaagcgcaaggaatgtcctgaccaacttggacccagccccaaaaggaacactgaaaaacgtaatcgtgaacaggaaaataaatatatagaagaacttgcagagttgatttttgcaaattttaatgatatagacaactttaacttcaaacctgacaaatgtgcaatcttaaaagaaactgtgaagcaaattcgtcagatcaaagaacaagagaaagcagcagctgccaacatagatgaagtgcagaagtcagatgtatcctctacagggcagggtgtcatcgacaaggatgcgctggggcctatgatgcttgaggcccttgatgggttcttctttgtagtgaacctggaaggcaacgttgtgtttgtgtcagagaatgtgacacagtatctaaggtataaccaagaagagctgatgaacaaaagtgtatatagcatcttgcatgttggggaccacacggaatttgtcaaaaacctgctgccaaagtctatagtaaatgggggatcttggtctggcgaacctccgaggcggaacagccataccttcaattgtcggatgctggtaaaacctttacctgattcagaagaggagggtcatgataaccaggaagctcatcagaaatatgaaactatgcagtgcttcgctgtctctcaaccaaagtccatcaaagaagaaggagaagatttgcagtcctgcttgatttgcgtggcaagaagagttcccatgaaggaaagaccagttcttccctcatcagaaagttttactactcgccaggatctccaaggcaagatcacgtctctggataccagcaccatgagagcagccatgaaaccaggctgggaggacctggtaagaaggtgtattcagaagttccatgcgcagcatgaaggagaatctgtgtcctatgctaagaggcatcatcatgaagtactgagacaaggattggcattcagtcaaatctatcgtttttccttgtctgatggcactcttgttgctgcacaaacgaagagcaaactcatccgttctcagactactaatgaacctcaacttgtaatatctttacatatgcttcacagagagcagaatgtgtgtgtgatgaatccggatctgactggacaaacgatggggaagccactgaatccaattagctctaacagccctgcccatcaggccctgtgcagtgggaacccaggtcaggacatgaccctcagtagcaatataaattttcccataaatggcccaaaggaacaaatgggcatgcccatgggcaggtttggtggttctgggggaatgaaccatgtgtcaggcatgcaagcaaccactcctcagggtagtaactatgcactcaaaatgaacagcccctcacaaagcagccctggcatgaatccaggacagcccacctccatgctttcaccaaggcatcgcatgagccctggagtggctggcagccctcgaatcccacccagtcagttttcccctgcaggaagcttgcattcccctgtgggagtttgcagcagcacaggaaatagccatagttataccaacagctccctcaatgcacttcaggccctcagcgaggggcacggggtctcattagggtcatcgttggcttcaccagacctaaaaatgggcaatttgcaaaactccccagttaatatgaatcctcccccactcagcaagatgggaagcttggactcaaaagactgttttggactatatggggagccctctgaaggtacaactggacaagcagagagcagctgccatcctggagagcaaaaggaaacaaatgaccccaacctgcccccggccgtgagcagtgagagagctgacgggcagagcagactgcatgacagcaaagggcagaccaaactcctgcagctgctgaccaccaaatctgatcagatggagccctcgcccttagccagctctttgtcggatacaaacaaagactccacaggtagcttgcctggttctgggtctacacatggaacctcgctcaaggagaagcataaaattttgcacagactcttgcaggacagcagttcccctgtggacttggccaagttaacagcagaagccacaggcaaagacctgagccaggagtccagcagcacagctcctggatcagaagtgactattaaacaagagccggtgagccccaagaagaaagagaatgcactacttcgctatttgctagataaagatgatactaaagatattggtttaccagaaataacccccaaacttgagagactggacagtaagacagatcctgccagtaacacaaaattaatagcaatgaaaactgagaaggaggagatgagctttgagcctggtgaccagcctggcagtgagctggacaacttggaggagattttggatgatttgcagaatagtcaattaccacagcttttcccagacacgaggccaggcgcccctgctggatcagttgacaagcaagccatcatcaatgacctcatgcaactcacagctgaaaacagccctgtcacacctgttggagcccagaaaacagcactgcgaatttcacagagcagaatgattggtaacagtgcttctcggcctactatgccatctggagaatgggcaccgcagagttcggctgtgagagtcacctgtgctgctaccaccagtgccatgaaccggccagtccaaggaggtatgattcggaacccagcagccagcatccccatgaggcccagcagccagcctggccaaagacagacgcttcagtctcaggtcatgaatatagggccatctgaattagagatgaacatggggggacctcagtatagccaacaacaagctcctccaaatcagactgccccatggcctgaaagcatcctgcctatagaccaggcgtcttttgccagccaaaacaggcagccatttggcagttctccagatgacttgctatgtccacatcctgcagctgagtctccgagtgatgagggagctctcctggaccagctgtatctggccttgcggaattttgatggcctggaggagattgatagagccttaggaatacccgaactggtcagccagagccaagcagtagatccagaacagttctcaagtcaggattccaacatcatgctggagcagaaggcgcccgttttcccacagcagtatgcatctcaggcacaaatggcccagggtagctattctcccatgcaagatccaaactttcacaccatgggacagcggcctagttatgccacactccgtatgcagcccagaccgggcctcaggcccacgggcctagtgcagaaccagccaaatcaactaagacttcaacttcagcatcgcctccaagcacagcagaatcgccagccacttatgaatcaaatcagcaatgtttccaatgtgaacttgactctgaggcctggagtaccaacacaggcacctattaatgcacagatgctggcccagagacagagggaaatcctgaaccagcatcttcgacagagacaaatgcatcagcaacagcaagttcagcaacgaactttgatgatgagaggacaagggttgaatatgacaccaagcatggtggctcctagtggtatgccagcaactatgagcaaccctcggattccccaggcaaatgcacagcagtttccatttcctccaaactacggaataagtcagcaacctgatccaggctttactggggctacgactccccagagcccacttatgtcaccccgaatggcacatacacagagtcccatgatgcaacagtctcaggccaacccagcctatcaggccccctccgacataaatggatgggcgcaggggaacatgggcggaaacagcatgttttcccagcagtccccaccacactttgggcagcaagcaaacaccagcatgtacagtaacaacatgaacatcaatgtgtccatggcgaccaacacaggtggcatgagcagcatgaaccagatgacaggacagatcagcatgacctcagtgacctccgtgcctacgtcagggctgtcctccatgggtcccgagcaggttaatgatcctgctctgaggggaggcaacctgttcccaaaccagctgcctggaatggatatgattaagcaggagggagacacaacacggaaatattgctgacactgctgaagccagttgcttcttcagctgaccgggctcacttgctcaaaacacttccagtctggagagctgtgtctatttgtttcaacccaactgacctgccagccggttctgctagagcagacaggcctggccctggttcccagggtggcgtccactcggctgtggcaggaggagctgcctcttctcttgacagtctgaagctcgcatccagacagtcgctcagtctgttcactgcattcaccttagtgcaacttagatctctcctgcaaaagtaaatgttgacaggcaaatttcatacccatgtcagattgaatgtatttaaatgtatgtatttaaggagaaccatgctcttgttctgttcctgttcggttccagacactggtttcttgctttgttttccctggctaacagtctagtgcaaaagattaagattttatctgggggaaagaaaagaattttttaaaaaattaaactaaagatgttttaagctaaagcctgaatttgggatggaagcaggacagacaccgtggacagcgctgtatttacagacacacccagtgcgtgaagaccaacaaagtcacagtcgtatctctagaaagctctaaagaccatgttggaaagagtctccagttactgaacagatgaaaaggagcctgtgagagggctgttaacattagcaaatattttttccttgttttttctttgttaaaaccaaactggttcacctgaatcatgaattgagaagaaataattttcatttctaaattaagtcccttttagtttgatcagacagcttgaatcagcatctcttcttccctgtcagcctgactcttcccttcccctctctcattccccatactccctattttcattccttttttaaaaaataatataagctacagaaaccaggtaagccctttatttccttaaatgttttgccagccacttaccaattgctaagtattgaatttcagaaaaaaaaaatgcatttactggcaaggagaagagcaaagttaaggcttgataccaatcgagctaaggatacctgctttggaagcatgtttattctgttccccagcaactctggcctccaaaatgggagaaaacgccagtgtgtttaaattgatagcagatatcacgacagatttaacctctgccatgtgttttttattttgttttttagcagtgctgactaagccgaagttttgtaaggtacataaaatccaatttatatgtaaacaagcaataatttaagttgagaacttatgtgttttaattgtataatttttgtgaggtatacatattgtggaattgactcaaaaatgaggtacttcagtattaaattagatatcttcatagcaatgtctcctaaaggtgttttgtaaaggatatcaatgccttgattagacctaatttgtagacttaagactttttattttctaaaccttgtgattctgcttataagtcatttatctaatctatatgatatgcagccgctgtaggaaccaattcttgatttttatatgtttatattctttcttaatgaaccttagaaagactacatgttactaagcaggccacttatggttgtttttcttgcccactctggtaggggaaaaatcttttattaataggtgtcagtttcagacaactccaataccaagaaactgatgaccttttttgagctatttctccttaacccctaatacctttcttacctaaatttcagaatgatatctttttgatgtctaaaaagcaaagcattttataatatctcattagccaggctttttaggaacagagaagtttttccttgaaatttgattgtttgtttatttgtggcagggtgaaaaatgtacaaactacccctatttatacttatatctctctctatatgtacgcattatggaaatataggaagagatatagcccaaagatagatggtaagtagacagtctgaaaatgttgctccatactaaagaacctttctggaaatttgcatttcgctacttttttccacttgagaggggtctcaatacagggaggtggccaaggaacaacacttctcagtggccaccagttcatatatcccctcaaaaggctctacttttctccaccaaaccattgggttgcccaactgtgatggaaaaaacaagcagatgttggcccagaactccaggacctccccgtgggctgaggctcatgtggcatacaattcagtgtgaccagttttaatgttcagaaatatgtgaattagaatgacttttaacttcacacagcacaaaagagaaatggagtttaaactggatttgttttgttttgagtttcaagtcccttttcactacaacaccgtccaaaactatctacctatctcttcttttttatccatctgcccgctgtattttaatgtcaatcctaattcagacaaatccgcaacttcatgatactggtaatttataataattcgtgatcattgctgttttgaaggaaaagagatgataaattctcttacggtttcaatcaggtaatggattttgttttacatctagttaggagaagaaaagtaagtgaaggaatcctctgatcatattgatcactatagaagcaaaagccaaatcagttcccttcattatcagtatttctcatgctgtacacaataaatttgttagactgagtacttggtttttgtttaatagaacaaataatcagtgtttcacttatattactaaatgtgaaaaacataatgtgaaaagtatacatacattaacttggttgtaaaactcattttaagtgttcatgtaatgtggtaagtttaaaaagtgaagtgagctgttttactacaatgaattcgtttgactcaaagattaaaatgcccctccccctatgtgtatctcttatggcctgtaataattgaaagcaatgtttttgcagtttatataatgcaatttttaatctgtgttcaaaaatggagttcatatgggcttaacacatgaaatgggtggcacagatccacttgcagaacccaaagatacacaatcagttttgaaatgcaacttaagccattaattgttggtgtgaatttaaaattttctagtgtttgtatggtggtatgctgcctaagagcaaagcatcctctgcacaaaagaaaattactgtagtggcttcgattttaattagaattttctccctggtgtttctttatagactaaagcaaaatcttttaagtttcttactacaggtaaaagctatgtgcaagaacctcaaaatgctaaaatctagcataatgccttagatctgtttttaagtcttgtatattcctacatagctgtccgatgtattatatttgtatagtgaattgtgtacaatttttgaataagtgcatcatcacttaacctttatgttgtttgaatagtgatgatgatacatttcttcagacatttaactgtcatttttttcctttgtcatttgtgagttttatttgtacagttcctcatgaagttgcatctgagatgtgtgtatatgaaaagattatacaagggtaaaattaagcaatatattaactatggttcttcaggagaaagcttacagtgtttcaggttgtgatttattttcaaaatggagttgactctgaacatcactttgttcacctgcattgatgtttgtatttctagtgtgagcagtttatgcaaaggtagatatattcagagaaattttaaatacatttatgcaagttaatattgctttgctgatgctatttgcttatttgatgttaaataatgctattgtaaataaagaattctgttgttattgcatcatttaataaattttaatgccttcgggttttacatggctttagagattttaatgtgtttatattgtatcttctttcataattgcatttaaaaagaccttgtaatttaataatttattatatttatatggtagttgacactgttgacagcaccttaacatttaattcttccaataacccattttataaatttttacatttgaaataaaggattatctaataacttaa

SEQ ID NO: 21520 - DNA, 3552 bp, Homo sapiens
ggcggccgcagcctcggctacagcttcggcggcgaaggtcagcgccgacggcagccggcacctgacggcgtgaccgacccgagccgatttctcttggatttggctacacacttatagatcttctgcactgtttacaggcacagttgctgatatgtgttcaagatgagtgggatgggagaaaatacctctgacccctccagggcagagacaagaaagcgcaaggaatgtcctgaccaacttggacccagccccaaaaggaacactgaaaaacgtaatcgtgaacaggaaaataaatatatagaagaacttgcagagttgatttttgcaaattttaatgatatagacaactttaacttcaaacctgacaaatgtgcaatcttaaaagaaactgtgaagcaaattcgtcagatcaaagaacaagagaaagcagcagctgccaacatagatgaagtgcagaagtcagatgtatcctctacagggcagggtgtcatcgacaaggatgcgctggggcctatgatgcttgaggcccttgatgggttcttctttgtagtgaacctggaaggcaacgttgtgtttgtgtcagagaatgtgacacagtatctaaggtataaccaagaagagctgatgaacaaaagtgtatatagcatcttgcatgttggggaccacacggaatttgtcaaaaacctgctgccaaagtctatagtaaatgggggatcttggtctggcgaacctccgaggcggaacagccataccttcaattgtcggatgctggtaaaacctttacctgattcagaagaggagggtcatgataaccaggaagctcatcagaaatatgaaactatgcagtgcttcgctgtctctcaaccaaagtccatcaaagaagaaggagaagatttgcagtcctgcttgatttgcgtggcaagaagagttcccatgaaggaaagaccagttcttccctcatcagaaagttttactactcgccaggatctccaaggcaagatcacgtctctggataccagcaccatgagagcagccatgaaaccaggctgggaggacctggtaagaaggtgtattcagaagttccatgcgcagcatgaaggagaatctgtgtcctatgctaagaggcatcatcatgaagtactgagacaaggattggcattcagtcaaatctatcgtttttccttgtctgatggcactcttgttgctgcacaaacgaagagcaaactcatccgttctcagactactaatgaacctcaacttgtaatatctttacatatgcttcacagagagcagaatgtgtgtgtgatgaatccggatctgactggacaaacgatggggaagccactgaatccaattagctctaacagccctgcccatcaggccctgtgcagtgggaacccaggtcaggacatgaccctcagtagcaatataaattttcccataaatggcccaaaggaacaaatgggcatgcccatgggcaggtttggtggttctgggggaatgaaccatgtgtcaggcatgcaagcaaccactcctcagggtagtaactatgcactcaaaatgaacagcccctcacaaagcagccctggcatgaatccaggacagcccacctccatgctttcaccaaggcatcgcatgagccctggagtggctggcagccctcgaatcccacccagtcagttttcccctgcaggaagcttgcattcccctgtgggagtttgcagcagcacaggaaatagccatagttataccaacagctccctcaatgcacttcaggccctcagcgaggggcacggggtctcattagggtcatcgttggcttcaccagacctaaaaatgggcaatttgcaaaactccccagttaatatgaatcctcccccactcagcaagatgggaagcttggactcaaaagactgttttggactatatggggagccctctgaaggtacaactggacaagcagagagcagctgccatcctggagagcaaaaggaaacaaatgaccccaacctgcccccggccgtgagcagtgagagagctgacgggcagagcagactgcatgacagcaaagggcagaccaaactcctgcagctgctgaccaccaaatctgatcagatggagccctcgcccttagccagctctttgtcggatacaaacaaagactccacaggtagcttgcctggttctgggtctacacatggaacctcgctcaaggagaagcataaaattttgcacagactcttgcaggacagcagttcccctgtggacttggccaagttaacagcagaagccacaggcaaagacctgagccaggagtccagcagcacagctcctggatcagaagtgactattaaacaagagccggtgagccccaagaagaaagagaatgcactacttcgctatttgctagataaagatgatactaaagatattggtttaccagaaataacccccaaacttgagagactggacagtaagacagatcctgccagtaacacaaaattaatagcaatgaaaactgagaaggaggagatgagctttgagcctggtgaccagcctggcagtgagctggacaacttggaggagattttggatgatttgcagaatagtcaattaccacagcttttcccagacacgaggccaggcgcccctgctggatcagttgacaagcaagccatcatcaatgacctcatgcaactcacagctgaaaacagccctgtcacacctgttggagcccagaaaacagcactgcgaatttcacagagcacttttaataacccacgaccagggcaactgggcaggttattgccaaaccagaatttaccacttgacatcacattgcaaagcccaactggtgctggacctttcccaccaatcagaaacagtagtccctactcagtgatacctcagccaggaatgatgggtaatcaagggatgataggaaaccaaggaaatttagggaacagtagcacaggaatgattggtaacagtgcttctcggcctactatgccatctggagaatgggcaccgcagagttcggctgtgagagtcacctgtgctgctaccaccagtgccatgaaccggccagtccaaggaggtatgattcggaacccagcagccagcatccccatgaggcccagcagccagcctggccaaagacagacgcttcagtctcaggtcatgaatatagggccatctgaattagagatgaacatggggggacctcagtatagccaacaacaagctcctccaaatcagactgccccatggcctgaaagcatcctgcctatagaccaggcgtcttttgccagccaaaacaggtgagtcctgagcacctagggtagccagttattttatacctgtccagaaattaatcttttcctttggagtagtcggtgcctgaccagttttcatttattggtactatattatctactgtgcagtgcatgaagaggaggggtgaatccagaaatcagtatgacctaggacatacctttaaaggagttacaaattaaatggaaaataacatatgtatgctgataactgtaatat

SEQ ID NO: 21521 - DNA, 128 bp, Homo sapiens
taaattcataaataaaaactaactactgagtattccgcttatttagaccactgcttctcaaattatctttcatgaaggactagtttatttattttcctaaatttcccatctgttacacatgaaactgg

SEQ ID NO: 21522 - DNA, 616 bp, Homo sapiens
atacaaaaacctataaaatatatttttatctcaacttttttcaagcgtgattataaaatgcaggatttatggactttcttaattatgactttacattttaaaagacaaaataaaattctgctgcagacatgagtgtggagaaatgccattgaaaacaggctgtctttttcaccctgttccatctcagcttctggcatggccggcagatgcccccgaggctgtcactgtggtcactattgccccagatttccacggagtccaccatggacacataacgaacctgaagaagtttaccgcctacttcacttccgttctgtgcttcaccacccctggggacgggcctcccagcacacctcagctggtctggactcaggaagacaaaccaggagctgtgggacatctgagtttcacagagatcttggacacatctctcaaggtcagctggcaggagcccctggagaaaaatggcatcattactggctatcagatctcttgggaagtgtacggcaggaacgactctcgtctcacgcacaccctgaacagcacgacgcacgagtacaagatccaaggcctctcatctctcaccacctacaccatcgacgtggccgctgtgact

SEQ ID NO: 21523 - DNA, 432 bp, Homo sapiens
atacaaaaacctataaaatatatttttatctcaacttttttcaagcgtgattataaaatgcaggatttatggactttcttaattatgactttacattttaaaagacaaaataaaattctgctgcagacatgagtgtggagaaatgccattgaaaacaggctgtctttttcaccctgttccatctcagcttctggcatggccggcagatgcccccgaggctgtcactgtggtcactattgccccagatttccacggagtccaccatggacacataacgaacctgaagaagtttaccgcctacttcacttccgttctgtgcttcaccacccctggggacgggcctcccagcacacctcagctggtctggactcaggaagacagtgagtattcctttctgcgtgtctcttaagtcacttgtcaaagaggtgtata

SEQ ID NO: 21524 - DNA, 326 bp, Homo sapiens
tctttctctcttccagatggagctgagcctgacactctaaccggttctctgggtgtactgcaaaggtctaataaaaggcacctttgcccggttgcttcaattctaggaagctgttcaatgtttgactatatttctccatactcatttgaaaacagttcatcaggttagttcagttgaattattgctccttgggagttttccaaaccctggatttccttcggagagagctagattctattccattcttggaattcagctccttgcccttctctgtgaccccggatcgcgaatgcagtaaaaataaaaatatcctgctgcctcctgca

SEQ ID NO: 21525 - DNA, 362 bp, Homo sapiens
tgtagagccagggtctccctatgttgcccaggctgatcttgaactcctggcttcaagaaatcctcccaccttggcctcccaaatgagattacaggctctgggagccaccacacccagatcattataaaaatttaaaattgttatttttgtaaatggttttcaaaatttgcattcctatgatgactatcaagtttatatacttttcaattaagtttcatttcctcatacaaatatttattgagaagctactatgtgtcaaactctgtactgggtgtaccatggagatggactaatcttatgcagtctgtctctctcctccaggaacttctagttaggtacacagggaaagacaaaataagttc

SEQ ID NO: 21526 - DNA, 504 bp, Homo sapiens
agacaaaagaagcaaataacatataaagaagctccgtatgtctggcagcacatttctcagtggaaccctcacatgccatgagggagggggatgacatatccagagtgctaaaggcaaaaaaaagcttccaacttagaatattatatccagcaacatcattcttcaaacataaaaaagaaataaaaactttcccaggcaaacaaaagctaaaaaatgtcaccaacaccagaactataaagggaattcttcaatttaaaagaaaaggattctcaagcaacaagaaatcatctgaaggtataaaagtcactggtaaaacattattcacaacagccaagacatggaaacaacctgaatgtccatcaacagatcggataaagaaaatgtgggtcaggcacggctgcttatgcctgtaatcgcatcattttgggaggttgagacggacgtaccacttgagaccagaagttcaagatccatctgggaaacatactgagacctcgtctttgc

SEQ ID NO: 21527 - DNA, 1482 bp, Homo sapiens
cttaaagggctgagggcacggaagaggcatggcagggcatggcatgctggaccaaagtgttgctaatggtgggttgcaacctattcgtgtgtcaggtgttaggttagtgcgtcgcagccaatagtaaaataacccaactaggttaaaaaaaaatagagtgtaagggcattgtttgttattaaatttttattttatattttttgagacagagtctcactctgtcacccaagccgggaggtggagtgagccaagatctaaccactgcactgcagcctgggcaacagagcaagactctgtctcaaaaaaaaaaaaagattaaaaataataattaggagggagaataaacgacatcttggttttttaaaagtcctttttatgccattaaagtgtggcttgtggtttattattacatttgtatgcaaccttggtactgacatttttatcaaaagatattggagagatttcaggaatgaggagttacattccctttatatcttgttgccagaaattactcttaagcaaaataaattctgcctgaaataaaaagaaaatgagaacacagcatatgcgtgtttttggctctgtgatctatgcaaatagttatgtattaactcattaattaaaatgggcttattctacacacacatttctaccattggatttttcttcttaaaaaataagcagagcagagtggggaggcggcaagaggacctgtggcaggccctcttcggccatctctctggcctggtttccctcggcgtgccactgtgtgctcagtccagcaccatggggaagcgggacaatcgggtggcctatatgcacccaatagcaatggcgagatcaaggggtccaatccagtcttcagggccaacaatacaggattatctgaattgaccaaggcctacctgggaagaagtaaaagagcaactagaaaagaaaaagaaaggttccaaggctttggctgaatttgaagaaaaaatgaatgagaactggaagaaagaactggaaaaacacagggagaaattgttaactgcaagtgagagctcatccaaaaaaaagacagagaaagaaaaaagaaaagaagaaatctgataggtattcatcttcttcatcaagctctgattcttccagcaattcttctgattctgaagatgaggataagaaacaaggaaaatgaagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtaagaatcagagtatattgaggaggtgcgagcaaaaaagaagaaaagcagtgaagaacgagaaaaagcaacagaaaaaacaaaaaagaataagaagcataagaaacacagtaa

SEQ ID NO: 21528 - DNA, 367 bp, Homo sapiens
gttctttatggaatttgacaagctagtgaagacacttctcaaaaataataataggactggggactttccctgtcagatatcagaccttattataaagctacagaaatcatgtggtactgttacagagacagacaaactgaccagtggaataagttagtaagtcaagaaagaaatctctttgtatctggaactttaatatgtgacctaagatggcatgacagatgcatgagaaaaataaaaagttttaaatacatcaaacttatggagaaaattagatccctatttcatatcctgacataaatatcagtatcagggcctggcacagtggctcacgccagtaatcgcagcactttgggaggccggagtg

SEQ ID NO: 21529 - DNA, 174 bp, Homo sapiens
tagctgtaagttgataattgttgagactaactggtattactcattattattctgtctgatttcatatctgattaaaattttccacaacagtataaaaacatataaagcccaatgccccccaaaacaagaaaaaacaaatacccacttgaatttaggaacagtctttttaaagtt

SEQ ID NO: 21530 - DNA, 699 bp, Homo sapiens
gacgggagtgctcaagcagggtacgggggaccagaccctcacacccatctggaggagcaaaagggctgtgtgcttttcagtaggaaactaacaggagttggtcacaaatgaaaggctaagcccagattttcaaatgatagaaaacagctgcaatcttaaaagcatgctctataaaacgtaaccaccagtatctgccagtcctttatcccaaacctctgccatgagcagaggtggaaaaaccttgacccaaaatcctggccctgaggcagaggcagaaagaaggcagttgtctgcggaactcttcaccccagtctcttgtccaaagacagcaaagccctcactcttaaaggaaagagggagtttgaaaaacagtccaagtaaaatctagatgttcagccaaagaatgggagttccaatttcaggagacctcacacaaaacaccacatgagacctctgaagatggagagtgtcacactggttcccagcgccactctcagaaaaaccaggtgattgaggggagacattctgaatcctgctgtcttacatcacgtatgtcagcctaaaaggaagaagctgaggcaaaattaatataagtagagagttgatttgggccaagcctgaggattgcagcccaggtgtatggattcaggttgctctgagtatacaccccattagcagaagttggaagtagatttttaa

SEQ ID NO: 21531 - DNA, 200 bp, Homo sapiens
aagcgcacaacagcgatttcacactgcctctttagactcctgatccgcgggaaaattccacttgtccgtgttttctccaagctctccgtaggtgcaagtcacctgttgcattaaataaaagcgaaagatgtgtcaactttcaaagattggctaaaaaaagaaaaagaagaaggaaagaacacattaagccagcaacagtg

SEQ ID NO: 21532 - DNA, 475 bp, Homo sapiens
  misc_feature (402)..(402): n is a, c, g, or t
  misc_feature (437)..(437): n is a, c, g, or t
  misc_feature (452)..(452): n is a, c, g, or t
  misc_feature (472)..(472): n is a, c, g, or t
aatttttaatggagatgcattcaaattcgttgctaaaatgggcctgacacctcttgaccttggctaaacagagattctggatggagcaaagcactgtgacgtcatgtggactttgaaggttaagaaactacggatcatcaggacatatttgctcttccatctcacagagaaaatggggatatacctcctcattccaggaaactttcttcctatatttctaatatatccaggataaaattcaatatatatagtcagtagcttcaaagttaagcataatttgtttactagaattcttaaggcagatgttggatcattaactcattctcttaggaaataactttgggtgcttataagtagggcatcacataatctggatacactggatattatatatataatccnggatatattaaatgtttttccataatttattaccntatattttccaggtnttaattggtgggaaaaaccnttt

SEQ ID NO: 21533 - DNA, 1515 bp, Homo sapiens
agatagaatcgagtcggtaccggcactctagtccaatgaaatgcggggtgaaatgaaatgaaatgaagaaataaatgaaatattgaaatgaataataaaattctgggtgcggtgatgcactccagcttgggtgatagagtgagactccatgttggtcaggctgatctcgaactcccgacctcaggttgcagtgagcagagatcgcgccactgaattccagcctgggcgatagagcgagtctgtctcagaatgaaatgacgtgacatgacatgacatgatgaaatgaataatgaaatgccgggtgtggtggcacactccagcctgggcaatagagcaagtctctgtctcgaaatgaaatggaatgaaatgaagagaataaatgaaataaatgaaatgaaataataaaatgaataatgaattgccaggtgaaatgaaatgaaatgatgaaatgaataatgaaatgccgggtgcagtggtgcactccaacctgggcaatagagcaggtctccgtctcgaaatgaaatgagatgacatgagatgaaatgggatgaaatgaaataatgaacaatgaaatgccgggtgaaatgaaatgaaatgaagaaataaatgaaatattgaaatgaataataaaattctgggtgcggtgatgcactccagcttgggtgatagagtgagactccgtcttgaaatgaaatgatgaaataatgaaacaaaattaaatatgaaatgaaatacgaaatactgggtgcggtggctcacgcctgtaatcctagcactttgggaggctgaggagggtggatcacctgaggtcaggagttcaagaccagcctggccaacatgatgaaaccccatctctactaaaatacaaaaactagccgggcatgatagcgggtgcctgtaatcccagctacttgggaggctgagagaggagaatcgcttgaacccaggaggcagaggttgcagtgagcagggatcgcgccactgcactccagcctgggtgttagaacaagcctctggctcgaaatgacatgacatgacatgatgaaatgaaataatgaaatgaataatgaaatgcgtgtggtgcactccagcctgggcaatgcagcaagtctctgtcatgaaatggattgaaattgaatgggaatgggaatatgggaatggaataaatgaaatgaagaaatatgaaatgccaggtgtggtggcgcactccagcctgggtgatagagcgagtctccatcttgaagtgaaatgaaatgaaatgaaatgaagaaatgaaataaatgaatactgaaatgaaataataaaatgaaatgccaggtgtggtggcacactccagcctgggcaatagagcgcgtctccgtcttgaaatgaaatgaaataaatgaaatgagaaatgatgagatgaaatatgaaatgaataatgaaatgcgtgtggtgcactccagcctgggcaatgcagcaagtttctgtcattaaatggatttaaatttaatggggattgggatattgggatgg

SEQ ID NO: 21534 - DNA, 1476 bp, Homo sapiens
taggttcacgccattctcctgtctcagcctccccagcagctgggaccacaggcacccaccaccatgcccggctaattttgtgtatttttagtagagacggggtttctccatgttggtcaggctgatctcgaactcccgacctcaggttgcagtgagcagagatcgcgccactgaattccagcctgggcgatagagcgagtctgtctcagaatgaaatgacgtgacatgacatgacatgatgaaatgaataatgaaatgccgggtgtggtggcacactccagcctgggcaatagagcaagtctctgtctcgaaatgaaatggaatgaaatgaagagaataaatgaaataaatgaaatgaaataataaaatgaataatgaattgccaggtgaaatgaaatgaaatgatgaaatgaataatgaaatgccgggtgcagtggtgcactccaacctgggcaatagagcaggtctccgtctcgaaatgaaatgagatgacatgagatgaaatgggatgaaatgaaataatgaacaatgaaatgccgggtgaaatgaaatgaaatgaagaaataaatgaaatattgaaatgaataataaaattctgggtgcggtgatgcactccagcttgggtgatagagtgagactccgtcttgaaatgaaatgatgaaataatgaaacaaaattaaatatgaaatgaaatacgaaatactgggtgcggtggctcacgcctgtaatcctagcactttgggaggctgaggagggtggatcacctgaggtcaggagttcaagaccagcctggccaacatgatgaaaccccatctctactaaaatacaaaaactagccgggcatgatagcgggtgcctgtaatcccagctacttgggaggctgagagaggagaatcgcttgaacccaggaggcagaggttgcagtgagcagggatcgcgccactgcactccagcctgggtgttagaacaagcctctggctcgaaatgacatgacatgacatgatgaaatgaaataatgaaatgaataatgaaatgcgtgtggtgcactccagcctgggcaatgcagcaagtctctgtcatgaaatggattgaaattgaatgggaatgggaatatgggaatggaataaatgaaatgaagaaatatgaaatgccaggtgtggtggcgcactccagcctgggtgatagagcgagtctccatcttgaagtgaaatgaaatgaaatgaaatgaagaaatgaaataaatgaatactgaaatgaaataataaaatgaaatgccaggtgtggtggcacactccagcctgggcaatagagcgcgtctccgtcttgaaatgaaatgaaataaatgaaatgagaaatgatgagatgaaatatgaaatgaataatgaaatgcgtgtggtgcactccagcctgggcaatgcagcaagtttctgtcattaaatggatttaaatttaatggggattgggatattgggatgg

SEQ ID NO: 21535 - DNA, 568 bp, Homo sapiens
agatagaatcgagtcggtaccggcactctagtccaatgaaatgcggggtgaaatgaaatgaaatgaagaaataaatgaaatattgaaatgaataataaaattctgggtgcggtgatgcactccagcttgggtgatagagtgagactccatgttggtcaggctgatctcgaactcccgacctcaggttgcagtgagcagagatcgcgccactgaattccagcctgggcgatagagcgagtctgtctcagaatgaaatgacgtgacatgacatgacatgatgaaatgaataatgaaatgccgggtgtggtggcacactccagcctgggcaatagagcaagtctctgtctcgaaatgaaatggaatgaaatgaagagaataaatgaaataaatgaaatgaaataataaaatgaataatgaattgccaggtgaaatgaaatgaaatgatgaaatgaataatgaaatgccgggtgaaatgaaatgaaatgaaaaaatgaaataaatgaaatgatgaaatgaaataatgaaatgaataatgaaatgccaggtgcagtggcacactccagcctgg

SEQ ID NO: 21536 - DNA, 553 bp, Homo sapiens
gaatatgggaatggaataaatgaaatgaagaaatatgaaatgccaggtgtggtggcgcactccagcctgggtgatagagcgagtctccatcttgaagtgaaatgaaatgaaatgaaatgaagaaatgaaataaatgaatactgaaatgaaataataaaatgaaatgccaggtgtggtggcacactccagcctgggcaatagagcgcgtctccgtcttgaaatgaaatgaaataaatgaaatgagaaatgatgagatgaaatatgaaatgctgggtgaaatgaataatgaaatgccaggtgtggtggcgcagtccagcctgggtgatagagcgagtctctgtcttgaaatgaaatgaaatgatcaaatgaaatgatgaaatgaaataatgaaatgaataatgaaattctgggtgcagtggcgcactccagcctgggcaatagagggagtctccgtctcgaaatgaaatgaaatgaaatgatgaaatgaaataatgaaatgaataatgaaatgccgggtgaaatgaaatgaaatgaaaaaatgaaataaatgaaa

SEQ ID NO: 21537 - DNA, 821 bp, Homo sapiens
  misc_feature (746)..(746): n is a, c, g, or t
cgtgggtgggaattgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttggtccacatccgggaggtaaggggggccccnccttttaaatcccggtataaagcatatagtcgcggcaatataccttagaaaaccttcaaagtatacaaccattgg

SEQ ID NO: 21538 - DNA, 797 bp, Homo sapiens
  misc_feature (780)..(780): n is a, c, g, or t
cgtgggtgggaattgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttggggggaatttttttggtgggagactggggtttatatttggggggtgggggtggccccccgtttnttttagaccgcaggggg

SEQ ID NO: 21539 - DNA, 804 bp, Homo sapiens
cgtgggtgggaattgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagaagaaaaagctgccaaaggcaggggcctttttgggggacaccttttttcaccaaggccctttttttttttaaaaaaaaaccccccccccttttttttttttgggggggggcgacccccccttttttgggggggggaggggaagaagagggagagacaaccacacataatttttttatttacacagagcgaggacggggggggggcagagcccccattatcattaatcaaaaaacaagctgtcttttttatataagcgacaataaactagtacaccccccacaaaaaaaagaaaaacacaacacgtccctccccctttattttttttaaacaacaaacggttttttttttacccccccaaaaaaaaaaaggt

SEQ ID NO: 21540 - DNA, 1310 bp, Homo sapiens
cgtgggtgggaattgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccccgtagatgtatcaaaatactaccaactgtaaattgagatttaattcccaaatgtattctacttgttctaaaacaatctgtccacaaatataaaactataagtaataaattgttattttcggcaaacacactccggggaggtccgtcttacat

SEQ ID NO: 21541 - DNA, 1312 bp, Homo sapiens
cgtgggtgggaattgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggttttctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccccgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaatgttatataataaaa

SEQ ID NO: 21542 - DNA, 1396 bp, Homo sapiens
cgtgggtgggaattgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttttcagcaacttaactcctttggagggacaacggcttctcgacacgaggaacctcatatccctacagtcggtggagacctggacgtctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccccgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaatgttatataataaaa

SEQ ID NO: 21543 - DNA, 1384 bp, Homo sapiens
  misc_feature (300)..(301): n is a, c, g, or t
atcattcgttcggagcgcggaggccaggtacgctatggtgaaccagtggtgcactatgcggtgtcgctagtgagagtcgctggtcattgtacttaggtgtctatggatttactctagcctacagtaaacttagatgcctcgtgtggagaactcgactcgctgtcgtgacagcaacattctcacgcatgagatgttcgttgagagtcgcttacctggtatctattgatccacggagtccaaacggactgacgtcgtgcgtactatcgagacaatgtactgctcctcgcaactgaaactagnncgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccccgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaatgttatataataaaa

SEQ ID NO: 21544 - DNA, 1207 bp, Homo sapiens
cgtgggtgggaattgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattgggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccccgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaatgttatataataaaa

SEQ ID NO: 21545 - DNA, 1352 bp, Homo sapiens
cgtgggtgggaattgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccccgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaatgttatataataaaa

SEQ ID NO: 21546 - DNA, 1834 bp, Homo sapiens
  misc_feature (1456)..(1456): n is a, c, g, or t
  misc_feature (1465)..(1465): n is a, c, g, or t
cgtgggtgggaattgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccccgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaatgttatataataaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaancgaaaaaanaaaagcggggggggggcgaataaagcacacgcgcggggacgcgacaaagacaccgcacgcagaaaatgatagaggaggcgcagcccagagaggaacagaaaataaagcgcaggagccggacggaataaaaacaaaggcggcagcgggaaaaaaagaaacacgaggggaggaggacaatggagaaaaaacaacaacaaacacagatggggagggagaagagaagaagggaggaacaacaccgcaacaggagaagagtaaaacaccagcacagaagacataaaacaaaaggggaggaggaggagcgacaaacaagcaaacatcggcgccgaaacgaaaaaaggaacagaagaaggatgagacaaatataac

SEQ ID NO: 21547 - DNA, 1405 bp, Homo sapiens
cgtgggtgggaattgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccccgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaatgttatataataaaagtgtcttctatgcttttatatattacaacacacaaaccacacaccaaaaacac

SEQ ID NO: 21548 - DNA, 1308 bp, Homo sapiens
cgtgggtgggaattgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatgctcatattataaatttctaaatcctaggaagaaacgcttggagtgcttctgaatatacagaagttccatttaagggcaagtttccccgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaatgttatataataaaa

SEQ ID NO: 21549 - DNA, 1380 bp, Homo sapiens
ttctaggagcatgcgcttgagccctgcagccagaagatgaagtgactctggacgagtatgcatgtgcccgctatggagatcctgtatgatgactagtgctggggttctcgaacatctagatgattcgccacgcgggtcataccgaatgcagtcacttgaccttacagtgcaccacaatgctagtccctagaaagtgatgttaggggtgtctacacaatacgagcatgtttcaacgcgagctcgcaatttctggattacagacgctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccccgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaatgttatataataaaa

SEQ ID NO: 21550 - DNA, 1482 bp, Homo sapiens
cgtgggtgggaattgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggctggagtgcaatggtgcgatcttggctcggcacgatctcggctcagcacgatctcggcttactgcaacctccgcctttcgggttcaagcgattctcctgcctcagcctcccaagtagctggcattacaggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataaggaagaaataacagataagtccattggtggacagccttcttctcttaatcacaagattattttcagaatttaatctttgaggaaaaggtttgagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccccgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaatgttatataataaaa

SEQ ID NO: 21551 - DNA, 1261 bp, Homo sapiens
cgtgggtgggaattgtcgcctaagtggttccgggttggtggatgaccttgagccctcaggaacgagatggcggttctctggaggctgagtgccgtttgcggtgccctaggaggccgagctctgttgcttcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagctgccaaggcagggcttttggcactttcagctttaacctttgctgggctttgctatttcaactatcacgatgtgggcatctgcaaagctgttgccatgctgtggaagctctgacctttttgacttcatactttgaagaattgatgtatgcctctttgcctctgctttgtcatgccattaagctcacaataagagaggaattatatctaagttgtgagactgagttctatattctggtgagttaatggggttgcctcccagcttcttataagactcacagtataactaaacatgatatatcagcttttgcctttcaatttatcaatctcttaaagagaatccaactttattacgattagtatatgatcaaacttccatatttgccttgggaataatggacaaagggaaatactcttaattcatgaataaaaactttgcagaaaattagacagtgtttaattttcgaaaacttccctctctagacagtagataccacctactgatggttacatatactagggaaattttaaaattaggaaatgctgatagctcatattataaatttctaaatcctaggaagaaacgcttggagtgcttctgaatatacagaagttccatttaagggcaagtttccccgtagatgtatcaaaatactaccaactgtaaattgagatttaattcccaaatgtattctacttgttctaaaacaatctgtccacaaatataaaactataagtaataaattgttattttcgcacaatgggaatctctaatgtgaaaatgtattctatgaaaataatttttttaaataaaatgttatataataaaa

SEQ ID NO: 21552 - DNA, 3122 bp, Homo sapiens
agacactgaatcatcatttgtagtttggggggctttacatgcctgcagtggtgaaaactgaaattttgtcccacttaagggagtttcttcttccctttattaattgcaaaataaatatatgtcacttcagagggcagcagctggactacctatgtttgtggcgctacaccaacctgaacttcgcttcctgagacctaagattcagccccgtgctcagcagacatcagggatcaccgactctgtgccaggagctgttcttgatgctgggaacgcaggggtggacaaaacagagaaagccctgccctcagaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccgcccctctgaagaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctatttggtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggttttttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 21553 - DNA, 3040 bp, Homo sapiens
agcctgcgactgcactcccggggacaccctctcccggacccactcggggaggcggcggcgaaggcccggggagacccgcgaggggcaagcccggattcctgccggccgcctttctgcgcgcgccggagagagagacgcggtggggacagggatgcgcatttcacttccccgagctccggagagggatggcggggtgtcggcgagttcactgctggacacagttactaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccgcccctctgaagaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctatttggtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggttttttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 21554 - DNA, 2962 bp, Homo sapiens
cgcaccccgcgcagcggctgagccgggagccagcgcagcctcggccccgcagctcaagcctcgtccccgccgccgccgccgccgccgccgccgccgcccccggggcatggcctgtctgatggccgctttctcggtcggcaccgccatgaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccgcccctctgaagaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctatttggtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggttttttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 21555 - DNA, 2926 bp, Homo sapiens
gctttataaaggggagtttccctgcacaagctctctctcttgtctgccgccatgtgagacatgcctttcaccttccgccatgatcatgaggcttccccagccacatggaactaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccgcccctctgaagaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctatttggtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggttttttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 21556 - DNA, 640 bp, Homo sapiens
ggggtgtccttcctggagcccgggctgacccccgtctgtgtctcctgcagtcatggaggttgcatccggcgagtacggtgatcagaacagtcggctggtgagagcggttcgggagggcatgtgtgactcagaccacaagagagacctcgggggtgatgccgaggtgaacccttttctttggcaccgcccctctgaagaggtaaagcagacaaaacgattaaaggggttgagaaaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 21557 - DNA, 747 bp, Homo sapiens
cggcattgtggctagctgcactgtgggtagctgcaccgtggctagtggcactgtggctagctgcatcttggctagctgcaccgtggcctgcagtgcgggcatgaggctcacactgccagtggccgtctgttctgcttccacactgttgtccttgtcccctgcaggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttggtaagcggagtcctgagcagctcgggggacagaaaggggattttcctcctctgtgggtctcacttttagctgacgcccccaactcagaaaccacttgactaccacaaatagctcaagtgtcatccagttataaaacgtttaaagaac

SEQ ID NO: 21558 - DNA, 457 bp, Homo sapiens
agagccatggcaggaccaagtgttctggacgttgccgagagctgccttcggtggaagcgcttccatcttttaggaacgttcttcctccccgaagtgccgagtgctcctaacaagtgctgattgtaaaacctttataagaaatctggtgggagtcaggcgtggtggctcatgtctgtaatcccagcactttgggaggctgaggcaggcagatcacttgaggtcaggagtttgagaccagcctggccaacatggcgaaaccccgtctccactaaaaacacaaaacaattaggtgggcttggtggcgcgcgactgtaattctagctactccggaggctgaggcgggagggcgggaagatcccttgaacctgggaggcagaggttgcagtgagctgagatcgcgccactgcactccagcctaggtgacagagtgagactccgtctcaataaaaaaaaaaaa

SEQ ID NO: 21559 - DNA, 247 bp, Homo sapiens
gtgagccgatgaaccagccagtgaatgagtgtgcctggtgaggccgtgcctgccttgcatgagcacctgggaggctctcagcctgctcagcagagagaattctccctggtggagaagggccatccactcggctgagctggtccgggccccaggcccctctctgctccttcccaggcctgaagtctgcagaggtccggcctttgggcagttgggtgtagcctgagctacacacagaattgttcagaag

SEQ ID NO: 21560 - DNA, 3539 bp, Homo sapiens
gaattccgggatgtggaacggtcgcaggaggctgctacaagccccatgagcaaggctgttcccactgacagagctttcccaggatgacagagagtgcgctctgcctctctggggtgtgctagcctacgaggggcaatcgtaaggcgaatgtcactgaaagaacacaagtgtccttaaacatggactatctgggctttctagtgctgaaattcttcccactcccactgcccacttcccattatataaaaaacacagttgtttcatgtttttgtttctttactgtttttctttgtttttgttaagaatgcattcatttattcaaaattgtttattgtagaataatcaggcattgcgtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccgcccctctgaagaggtaaagcagacaaaacgattaaaggggttgagaaaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctatttggtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggttttttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaaaaaaaaaaacaaatacaaaaaaaataaaagaaacaacaaaaaactaaaaaaaaaaaggggagggcgccatggtaagaatatactcccggcaggaggcccacaaaaatatttcctctgatcccgcccgtttctttgtagtgaacaacggggcgcccccccataagaggacggctgactatgaatacacacagagacggcaccgggcgcgcgcttaaaaccaaacggctggcgtctggagaaaccatagtccacctcacgacaactccttagtgggaagaagcgcccaactctttgcggggccgcagacaattgagcgagacaacactccaaaggttataaacgcccagcagtaatcaaacgtataagggggttatgaggtgcaagcaactg

SEQ ID NO: 21561 - DNA, 3245 bp, Homo sapiens
gaattccgggatgtggaacggtcgcaggaggctgctacaagccccatgagcaaggctgttcccactgacagagctttcccaggatgacagagagtgcgctctgcctctctggggtgtgctagcctacgaggggcaatcgtaaggcgaatgtcactgaaagaacacaagtgtccttaaacatggactatctgggctttctagtgctgaaattcttcccactcccactgcccacttcccattatataaaaaacacagttgtttcatgtttttgtttctttactgtttttctttgtttttgttaagaatgcattcatttattcaaaattgtttattgtagaataatcaggcattgcgtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccgcccctctgaagaggtaaagcagacaaaacgattaaaggggttgagaaaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctatttggtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggttttttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcatttaaaattaaccttgttggaaaagaggggggggtgaacaaccccccctttttttttggggggtctctttccgggaaaaaaaagggaaaaaaaatttttggtaaaattttttcccccaaagggggggggtttaaaaaatattcccaaaccaaatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 21562 - DNA, 1421 bp, Homo sapiens
acgattccctccaaccgttagaaagcatgtaacctcggaagtgaacacaagacttctcagtgcatttcaccagtgaatatgtaccgctcattcaacttgtttttttgctgggggccctggaggaaacaaaattggaagaaaaacatagtggagctgttgcacgtgtttgtcttaagaaggtggtgggcggtgaggaagtattctggggaaggcggccctttgggaagggaggatagccaagctgggaatcgcagggagggtgaacgacattgaccttcagccaacggcgtggctggctgggagaacgtcctccctcatgcctggcctttcctcctaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctatttggtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggttttttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 21563 - DNA, 828 bp, Homo sapiens
  misc_feature (757)..(757): n is a, c, g, or t
  misc_feature (770)..(770): n is a, c, g, or t
  misc_feature (802)..(803): n is a, c, g, or t
gaattccgggatgtggaacggtcgcaggaggctgctacaagccccatgagcaaggctgttcccactgacagagctttcccaggatgacagagagtgcgctctgcctctctggggtgtgctagcctacgaggggcaatcgtaaggcgaatgtcactgaaagaacacaagtgtccttaaacatggactatctgggctttctagtgctgaaattcttcccactcccactgcccacttcccattatataaaaaacacagttgtttcatgtttttgtttctttactgtttttctttgtttttgttaagaatgcattcatttattcaaaattgtttattgtagaataatcaggcattgcgtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacaggtgagcagccctgcccagggcgcaaagttctctcccgggtgtcaggccagcagtgggaacagtggagctccttccatcagccccatcacctggagnaggctgtggtctncagcagtagtccaggggagagagtgacattgnnaggctgcacttgccaagggccatat

SEQ ID NO: 21564 - DNA, 870 bp, Homo sapiens
cccgggggaagctggcgtgggcgagcctcctctgcaggaggccaggctgcaggttctgctacatctgtcctgtgtgcccccaactccaggtggccactttcgtgggcccagtgacagccatcccggtgctcctgttctcggggttcttcgtcagcttcgacaccatccccacgtacctacagtggatgtcctacatctcctatgtcaggtagcgggcgtggggcacgcatggcgtggggaccgagggtgacgggggaagaaccgtctccaacagcgtgaggggctcacaaaagccactctgggctgctggccaagagcagattacacatctgaggatccaggccttccatcttcctgctagttccacctcctcctaccctcaccaacacacacacactaaacaaggaggccacacaaaccagcgcttcacacccggagagccatggcaggaccaagtgttctggacgttgccgagagctgccttcggtggaagcgcttccatcttttaggaacgttcttcctccccgaagtgccgagtgctcctaacaagtgctgattgtaaaacctttataagaaatctggtgggagtcaggcgtggtggctcatgtctgtaatcccagcactttgggaggctgaggcaggcagatcacttgaggtcaggagtttgagaccagcctggccaacatggcgaaaccccgtctccactaaaaacacaaaacaattaggtgggcttggtggcgcgcgactgtaattctagctactccggaggctgaggcgggagggcgggaagatcccttgaacctgggaggcagaggttgcagtgagctgagatcgcgccactgcactccagcctaggtgacagagtgagac

SEQ ID NO: 21565 - DNA, 2910 bp, Homo sapiens
gaattccggtttcttcctaaaaaatgtctgatggccgctttctcggtcggcaccgccatgaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccgcccctctgaagaggtaaagcagacaaaacgattaaaggggttgagaaaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctatttggtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggttttttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 21566 - DNA, 3163 bp, Homo sapiens
agacactgaatcatcatttgtagtttggggggctttacatgcctgcagtggtgaaaactgaaattttgtcccacttaagggagtttcttcttccctttattaattgcaaaataaatatatgtcacttcagagggcagcagctggactacctatgtttgtggcgctacaccaacctgaacttcgcttcctgagacctaagattcagccccgtgctcagcagacatcagggatcaccgactctgtgccaggagctgttcttgatgctgggaacgcaggggtggacaaaacagagaaagccctgccctcagtgagaaatatgctgtcatgtaaattgctttttcccctatagaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccgcccctctgaagaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctatttggtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggttttttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 21567 - DNA, 2874 bp, Homo sapiens
gaattccggtttcttcctaaaaaatgtctgatggccgctttctcggtcggcaccgccatgaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccgcccctctgaagaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctatttggtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggttttttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 21568 - DNA, 600 bp, Homo sapiens
agcctgcgactgcactcccggggacaccctctcccggacccactcggggaggcggcggcgaaggcccggggagacccgcgaggggcaagcccggattcctgccggccgcctttctgcgcgcgccggagagagagacgcggtggggacagggatgcgcatttcacttccccgagctccggagagggatggcggggtgtcggcgagttcactgctggacacagttactgtaagtgctgtttccaggggtggtcaggaatctccctttctggttttctggcattaggaacaaacaacaaaccaatcatcaggcccccagccacccacctcaccttatcctagcgcccttcatgtctacgcccagcacaccaacatcgtagaggtagctaaagtacaaatggaaagtcttccgtattccacgccgtgtatctgtgtagttactaccctgatattacttccccgaggctgtaagcccacagtgcatggcacgctccggggctcaccccgcccctcccctgtatttcatttttagcatcctgtatttgaagtcagcagggctcagcaggatttgaccgacagttacctcttgccttgagctcaaga

SEQ ID NO: 21569 - DNA, 3149 bp, Homo sapiens
gaattccgggatgtggaacggtcgcaggaggctgctacaagccccatgagcaaggctgttcccactgacagagctttcccaggatgacagagagtgcgctctgcctctctggggtgtgctagcctacgaggggcaatcgtaaggcgaatgtcactgaaagaacacaagtgtccttaaacatggactatctgggctttctagtgctgaaattcttcccactcccactgcccacttcccattatataaaaaacacagttgtttcatgtttttgtttctttactgtttttctttgtttttgttaagaatgcattcatttattcaaaattgtttattgtagaataatcaggcattgcgtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccgcccctctgaagaggtaaagcagacaaaacgattaaaggggttgagaaaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctatttggtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggttttttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 21570 - DNA, 3596 bp, Homo sapiens
gaattccgggatgtggaacggtcgcaggaggctgctacaagccccatgagcaaggctgttcccactgacagagctttcccaggatgacagagagtgcgctctgcctctctggggtgtgctagcctacgaggggcaatcgtaaggcgaatgtcactgaaagaacacaagtgtccttaaacatggactatctgggctttctagtgctgaaattcttcccactcccactgcccacttcccattatataaaaaacacagttgtttcatgtttttgtttctttactgtttttctttgtttttgttaagaatgcattcatttattcaaaattgtttattgtagaataatcaggcattgcgtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccgcccctctgaagaggtaaagcagacaaaacgattaaaggggttgagaaaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctatttggtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggttttttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaactttctgactacctttaattttgcctaggttgatttaaacaaacaaacaaacagcttccctttcctcctgtatcacctcagctgcctccactgaacctggaagaatggggcttagggaaattcaggcacgacctttgagggttggctcagcaggagtggccagcagtgaaagatgggctaactgtgcaagaggggaggaggccaacgagatggcatcagaatccaagggcttaggacgaagtcagtagacttcagcatgtggaggcatttgaaacttgatcaaacaacgcacttcgagtggtgggagatttcatctctgggttttgcgacctcacagctgcatcaccgcctcagtgttaggcctgtgtaaactttgcacgttggaaaccgcttctttcctatgactgaatcacataagtcacccgctagggcagaacagggcctatc

SEQ ID NO: 21571 - DNA, 1969 bp, Homo sapiens
ggggtgtccttcctggagcccgggctgacccccgtctgtgtctcctgcagtcatggaggttgcatccggcgagtacggtgatcagaacagtcggctggtgagagcggttcgggagggcatgtgtgactcagaccacaagagagacctcgggggtgatgccgaggtgaacccttttctttggcaccgcccctctgaagaggtaaagcagacaaaacgattaaaggggttgagaaaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctatttggtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggttttttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 21572 - DNA, 495 bp, Homo sapiens
gaattccggtttcttcctaaaaaatgtctgatggccgctttctcggtcggcaccgccatgaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggtagggagggcggctgctttgtgtatcaagctgggaggagcctctgaaggaggcaacaggttgtttgggcaaaatcggggtctggaggttgagaggctgagcttctcttcccaacgccgtcactgctgtggtcaatttattctattgctttctgcctgaattttcctctcctataaaatgaacaggttgga

SEQ ID NO: 21573 - DNA, 282 bp, Homo sapiens
gacaatggagatgagccttggtggcttctcaggacctgcgtggaactcacccatggttgtgaacaaagatgaacaagtcaatcttcaacgaaggccaagtcaaggcactgacttcagaaaatgcatatcaacagaaaatacacatacatttccaccagaatgaagccctccaaatgttcagatgaggctatgtcaggaacacaacctgccctcatagaacctcaggcatattgggatagagtcaacatcactgtttcccacagttgtgtctttatacctgca

SEQ ID NO: 21574 - DNA, 186 bp, Homo sapiens
attgttggcgtatttctggtattaccgtatttgatctctgcaactatatagaaaatttgggagcctcatgcctataatccagccctttggaaggctgaggtgggaggatcccttgagctcaggagttcaagatcagcctgggcaacctagggagactccgtctctacaaattaaaaaaataaaaat

SEQ ID NO: 21575 - DNA, 467 bp, Homo sapiens
gcgttctgagggcagcttttaggatggtgtgtccatagtgttactttcataagatagttgaaaaatctgaatataatgaagttgggcctttgtgtatgtaaaatctgcccatctcttctctttcagatgattctatccacaagctagagctagtgccagagtacaggaaagcagttccttaacgttgctgcgttactgaggtttttagtttcatgtattttttcacaatggaataaagcattgtaaactgtaaattgcatctgtacaaagagagcccagggtgcctgggaactccgtaaggaggttggcttcccagctgtcacttgactcagttatgggctgtcagaaggcatgaagagaggggggccctctgtgccagtggaatttggaaactgaattgtaacaaagtgtcagtataaggcaattgaaatcgagaatgggacttgacctaggaggagaggttttca

SEQ ID NO: 21576 - DNA, 338 bp, Homo sapiens
attcgactctacataaaaattctctaaagtacttattttccctgttatgctagaacataaccagaattgttctccttttcaaattgaatactgaaaagaaatgtaaacatgaaataacttgcccaaggtcacatacctacttaatggtgaagcccaaatttgaattaaagtctgtaatcccaaagaccaagctattttacattatttcatgttggcaaataagtatgtgttaataattccttttatttctgtatttaaattttataatagcctatttcattaatagctaggtaaatcacttaagaatttatctgctacatgctgaggttttttggtag

SEQ ID NO: 21577 - DNA, 288 bp, Homo sapiens
ttttatcttaggctgggttacccaagggcagaccctgaaacagcagaagctgacaagggagtgagggaattgggactggaaaggggaagaaaccaagcaaaggtgcaatttcatgcaaaggcccttggagggtagcttcagcctgagcctacagggaactccagagttgtcttggcctgaggcaaggtcattggctaaggtctactgactacctggtagtggtagtaaagggacacagcataggaggtctaaggtttgggctgttggaattacactgatgttcagagg

SEQ ID NO: 21578 - DNA, 357 bp, Homo sapiens
gcccagttctgtataacattgtgcatttttcttcctttttgtatttagcgaatacaaataagaaaaacagaagaggctagatgtagtgactcacactttgggagaccgaggtggtaatatcacttaagccaagaaatttgagaccagcctgtgcaacatagctagaccccatccctacaaaaaaattaaaaattaaaaattagctgggcatggcagcacatacctgtggtccaagctactcaggaggctgaggcaggaggatctcttgaggctgggaggttgaggctgcatgcattgtgccataattgcagcactgctgtatggcctgggtgacagagggagaccctgtctcaaaaa

SEQ ID NO: 21579 - DNA, 498 bp, Homo sapiens
actgcccggctgacagtattgcatggggcttggctcttaggcatggctcagcatggctcttgtactggtgcccagagaaacagagagagaaccagagctgtctttcttgtggatggacagaggggagccaggtcatggcttggcttgtctctcgtgcccagggaaacagagaaagagttaagctgctgaccctgaaagcaggggagaaccggctgtgcagctgtgtgtgtgggagcagttcagagcaagcagccgagacagggaggacagtgcgagagagacagtgtaagtaagctgctgatgagaaagctgttgatgagagctgctgctgaataaaatcatctttcacctgcctaaggctccctgagtgttctttctcttcatccatctactctctttggacctcaacatgacaattggcatagtcatgaacctgacactatatattggttgttatgtcccaaatcatctttgaaatgaattaaagtgtgaatagat

SEQ ID NO: 21580 - DNA, 121 bp, Homo sapiens
aacctgtcattgtcacatttctctttcattagtgcttagtgagaatcatttgctctctacatgctcattacgtggacaacttgcaagttaagaatagtttttacatttttaaagggtcctt

SEQ ID NO: 21581 - DNA, 1118 bp, Homo sapiens
  misc_feature (24)..(24): n is a, c, g, or t
  misc_feature (27)..(27): n is a, c, g, or t
ctatactactaaattcgcggccgngtngacagcaaagttacagtaaaatgaagtattctcttatttagtttttgcatgtggaagtttctactattacccacaggaaagaaaccccctaagacttcacagtatatctgaattactgatagtctttattcagaggctgctgtcaaagaacttgtctgtgggcctgattttcctgataggaattatgtttctgatagcaaggctatcaaaatttaccaattatttatcaaggtagctactagttaccagttatcaaatatttaccagttatttcatccatctgctgcaatgtgctccaaaaccacttaagcttttgaggagcatgataaaattaaagacaatatgtaaaagccattgaccagttaaaagagaatgataaaatgtgaaaccaagtccagctctgttaaaatgttggctttaatggaaaaagttaatgaaatgaaaagagcttgttttattcatttgtcctcactgcatttatctacagtaatctcatcatttcccttggggagctctgcacagaagctaccagtaaagacatgcaccttcagttttcctaactttgcatgaccaaactaattttgtttttcttcagtgtggtatttatttacagaaactttcccatttactgaaaacattaaagactttgactcaaacttggaaaactagtaaacatcatttagcagcaatgaacctgtcaacacatggaaataaggtttacagtcatgcaaatgtccatttaactttgtttgagccaaacaaatataacagtaaactaattagactggcttacatccccgtagacagtgaaaccaattatttcttaaagaagggtttgcttgtttttactctagggcaaaggtgcataacttcttgtaatactcctgaatagttcttcaaatcaggacagataaagttggcaactgatggaatagctaccttgatgtgcaaatggttgggtctttaattaggttcatttatataattgagaaagaagccagggaatgcatttgtgcaaggatgattttaaaagaagagggatggtctgccttttaattctgtatgggaggaaaattcataaaaaaaaaaaa

SEQ ID NO: 21582 - DNA, 423 bp, Homo sapiens
caaaagccaaaataaatgaaaacctaaacgcccatttacaaatgaatggaattttgtatgtatatatacaatggaatattattcagccttaaaaaagaaattctaccatatgtgacaatatgaatgaacctggaaaacactatgctaagcaagataaaccagtcacagaagggaaaatactgcatgatttcattcacatgagatatcaaaattagtcaaactaatggaaacgaagaatagaattgtggtttccaggggctaggaagagagggaaaaagggaggtgctgatgggtataaaatttattatgcaaaatgaataagttctagagagccactgtaaaacattgtgactacagatgaccatactgtattatatagtttaaaatctgataaaagggtaaatctcatgctaggtcttctta

SEQ ID NO: 21583 - DNA, 318 bp, Homo sapiens
tgaaagtggtctgaagaagtcacaaataggagtttataaagttctagaagtatcaagtttctagattcttttcagtttttgctctgtttaaacattcacaccaactgaggtctgggggtgaaaggggaagttaatttatcccctaaataatatttattttgtatacaaaagaatggttaaatgtattcagtagtctaacctgctcttcttggctattcattcctgaatgacaggaattccgtttgtaccaccctcatcaccaccattaatttcatgatggactagctacttcacagccctcatgtccccaccactcca

SEQ ID NO: 21584 - DNA, 1929 bp, Homo sapiens
actgctacaaaggatatactcataggccctactggttatcctagagtcgacaggcagtatagcttaacagaaagagtgttggtgttgtgtagaactggattcaaattcagattctgccacactaacttttccccacctataaaatgagggctactacatacatctcaaagattaagtgaggtaatatgagaaaagtgtcaggcacagtgcctggaacatagtacatatttaacaaatgcttacaaatattagcaagtgtaaaaatatagtgatgatcctaatgatgatggaaaagacataggtgggtcagtgaccaccaagtaaaagataactgagacaattaagttatttttgatgtgattgctctgtaaatgtggctagttaaggctaacaactgattgtttcccagtatcagatgatctaggccaaatatctagcagtcagtgtgtggctagatacatttctgcacataaaggctcatagaaatagattcagaaaaagcaaaatagataaaataaggcttacccaggtagaagagtaattgagctatttgttgatatgctttagtgggggcttggcaaaagtgggtaaagaggtaagctggaggataggtcatatgcaatctatgcctctaacccggaaactgttcctaggaatttgttctaaggaaatattacagatacgcgctaaagtgtaactacaaggatatttgtcactatagtatttaaaagagaaaatatataaatgatcaaaatattgaatagtaagggattgtgatacatatatatgtaatatatatatatatatatatatatatataaaatgggatactaatgcaagcattcagtgaaaaaagtagattaccaaactatacgatcctcatttattttaaaaagtgatatcacccagaaaaaaataagaaagataaaagatgttggtaaaataactaaagaataaaaatataggggaaaaggtagccaagggatagatattgatattcattttctttttacaactttattaagttgtaatttgtgtgcaacagattgcatatatttgaagtatataacttgactaattttgacaaatatatacacccatgaaactaccagttataattttaaacattttcatgaccctccaaagtttccttgtgtccttttgcaatacacgcaaacacacacaccccacacacagtatgtaggcaaccattgatctgccttctgttacaataggttagtttgcatcttttagaactgtacataactgaaatcacatagtatatactcctttgcatctggcttctttgactcagcataatgatttgagattcatccatatgctgttacatgtactagtaacgcatttttattactgagtagtatacaattgcatggctgtatcacatttttgtacctattcacctgttagtggacatttgggttgtttcccaaattacaacccacatttggctattacaaagaaagctgccattaacttttgtgtacaagtctttgtatggacatgtattatctcttgggtgaatatatccagggatgaaacgactatgttgaataatagatatattttaactttttaagaagctatcaaactgttttccaaggtggttgtaccattttatgttcccagcagcagtaactggtgagaatatggctcattttcaaaagatgatctgaagtttcaaaagtaaataagttattgaaacatgtaatttgatagtggtaattagccaacatgataatacgttactcatagggtttgttgtgaggattacatgcactaatgcataaaatgcatttaagcgcagaggaagtactcagtattcattagcagttttattgttattctgttaatttaacttctttggttgttaacagtagtacatttgtgactaatttcgatagacta

SEQ ID NO: 21585 - DNA, 448 bp, Homo sapiens
cactggctatcatagtggatagcagcatattagatatttccttcacatcactgtagaagttctattagacagcactggactagagagtaaaagagatttaagaggcttaaccaaatgcaatgtgtgaaattgtttcaattttgattcttttttggattaatgggaaaatttaaatatacctgagaatgagaagattaaagaattattgttaaatatgtaatgatggtattaggttatatataaaaatgtctatttttagagacacatctggaagtacatgagaataaaatgttatattagttggaatttactttaaaatacttcaggctgggcagggtggctcctgcctgtaatcccagcactttgggaggtcaaggcagaaggattgcttgagcccaggagtttgaggccaggctgggcaacacagggagaccccatctctaaaaaa

SEQ ID NO: 21586 - DNA, 1399 bp, Homo sapiens
tgccagggcatggctcaggtggcacagggacatctgatgaaccctgcccgaggttctcggtgcctcccgtgcatgagtggctcactgaaggcaggtgtggaagccaaatgcctgcaagccgtgtgtcaggccacagcagtgcagtcatgcatcacgcactcaggtttgtaacagcaacaccagggccctgtctagattcaccctgtgggtgagcccgttctccagatgggcgtataaaggggctttctcctctacaccgttcctgtcaatgttccgtacaggcccacattcccaccactaagccaatggagtcaaccagatttctgccatggatatacgtggtcacggggccacatttctgcagctggctcagtggcaggcttgggccgtctctcagtaccatctaagacttctgtctaggttcctgtttttttagactcctgaactgccattctgattagacacaattttaatggaatttttggatttaatgatagttgataatcaccttatgtatttgcacaatctctttataattaaaaactcgctaagcttcacttgctactatctactatatagaattagagacattccattggattctaagcatcagacactcctggatctcaaaatgaccttttctaaataagcacaagatttatttttgtcctagcactgttgataacactctgaaatatgttattgaactggaattgtttctttatgcttgcattccaaaaccaactgaaacagattgtagtttcactttaaattctaggcctgttctatattatgtgaaggaattctctgtaacgctgatactatgttgctaatttgtgtacttacaggcactttagaaaatgtttagactgcaacatgcactataacattgaactcagtcacatgaagtggttaacacttgcacactgactgacagatatgaaagctgtatactttggacccagtaatatgctcattggagcaagggttgggctgtgtggatggataaactgctttcttgggtttacatggaaacctggtaccactcctacttttggaaagttggtataaaagctattaggtagaagcttaattccactaaatgtagaatttagttttcttctctaaccaagattttagaagtttcaagtttcaaatatgcttataacttttccaagaaatgatgattacagtgcttttgtggttacaactgtttggtatattaaaaaataagggtttactatcacatctaggtcttttttactatgtcatttttaagatatgaaataagaatctgaggacagccctgaagaacagtcctttcctgggaggggaagacttgtaattcaaggtcatacaatacaaaataaaacaaaaacaaaagcaccaagagcagaac

SEQ ID NO: 21587 - DNA, 658 bp, Homo sapiens
  misc_feature (68)..(68): n is a, c, g, or t
  misc_feature (95)..(95): n is a, c, g, or t
attgtagtccccctttaaaatcccaggccctggccccaaattatggtgaggggaatccccctgtaccncctggaacccatggtgcccaaatttgnggtccttacgggcccctttagaaaatgtttagactgcaacatgcactataacattgaactcagtcacatgaagtggttaacacttgcacactgactgacagatatgaaagctgtatactttggacccagtaatatgctcattggagcaagggttgggctgtgtggatggataaactgctttcttgggtttacatggaaacctggtaccactcctacttttggaaagttggtataaaagctattaggtagaagcttaattccactaaatgtagaatttagttttcttctctaaccaagattttagaagtttcaagtttcaaatatgcttataacttttccaagaaatgatgattacagtgcttttgtggttacaactgtttggtatattaaaaaataagggtttactatcacatctaggtcttttttactatgtcatttttaagatatgaaataagaatctgaggacagccctgaagaacagtcctttcctgggaggggaagacttgtaattcaaggtcatacaatacaaaataaaacaaaaacaaaagcaccaagagcagaac

SEQ ID NO: 21588 - DNA, 3005 bp, Homo sapiens
acgcttcctttgccctgctttccatcccctctccctccaactcccctgccagagttccaaggctgtggaccccagagaaggtggcaggtggcccccctaggagagctctgggcacattcgaatcttcccaaactccaataataaaaattcgaagactttggcagagagtgtgtgtgtgtgtgtatggttgttgggcgtaggacaggtttcggggatgcgcggtacgcggtaccacccctcggaggcccccacccccagacgcccaggccgcctccccactccccctcaagcagccccagccggggactttccgtcgcggggaaggggcggggaccctgagcgaaaggtgcggaggcggcctgccggggtggttcggcttcccgttgccgcctcgggcgctgtacccagagctcgaagaggagcagcgcggccgcgcggacccggcaaggctgggccggactcggggctcccgagggacgccatgcggggaggcaggggcgcccctttctggctgtggccgctgcccaagctggcgctgctgcctctgttgtgggtgcttttccagcggacgcgtccccagggcagcgccgggccactgcagtgctacggagttggacccttgggcgacttgaactgctcgtgggagcctcttggggacctgggagccccctccgagttacacctccagagccaaaagtaccgttccaacaaaacccagactgtggcagtggcagccggacggagctgggtggccattcctcgggaacagctcaccatgtctgacaaactccttgtctggggcactaaggcaggccagcctctctggccccccgtcttcgtgaacctagaaacccaaatgaagccaaacgccccccggctgggccctgacgtggacttttccgaggatgaccccctggaggccactgtccattgggccccacctacatggccatctcataaagttctgatctgccagttccactaccgaagatgtcaggaggcggcctggaccctgctggaaccggagctgaagaccatacccctgacccctgttgagatccaagatttggagctagccactggctacaaagtgtatggccgctgccggatggagaaagaagaggatttgtggggcgagtggagccccattttgtccttccagacaccgccttctgctccaaaagatgtgtgggtatcagggaacctctgtgggacgcctggaggagaggaacctttgcttctatggaaggccccagggccctgtgtgcaggtgagctacaaagtctggttctgggttggaggtcgtgagctgagtccagaaggaattacctgctgctgctccctaattcccagtggggcggagtgggccagggtgtccgctgtcaacgccacaagctgggagcctctcaccaacctctctttggtctgcttggattcagcctctgccccccgtagcgtggcagtcagcagcatcgctgggagcacggagctactggtgacctggcaaccggggcctggggaaccactggagcatgtagtggactgggctcgagatggggaccccctggagaaactcaactgggtccggcttccccctgggaacctcagtgctctgttaccagggaatttcactgtcggggtcccctatcgaatcactgtgaccgcagtctctgcttcaggcttggcctctgcatcctccgtctgggggttcagggaggaattagcacccctagtggggccaacgctttggcgactccaagatgcccctccagggacccccgccatagcgtggggagaggtcccaaggcaccagcttcgaggccacctcacccactacaccttgtgtgcacagagtggaaccagcccctccgtctgcatgaatgtgagtggcaacacacagagtgtcaccctgcctgaccttccttggggtccctgtgagctgtgggtgacagcatctaccatcgctggacagggccctcctggtcccatcctccggcttcatctaccagataacaccctgaggtggaaagttctgccgggcatcctattcttgtggggcttgttcctgttggggtgtggcctgagcctggccacctctggaaggtgctaccacctaaggcacaaagtgctgccccgctgggtctgggagaaagttcctgatcctgccaacagcagttcaggccagccccacatggagcaagtacctgaggcccagccccttggggacttgcccatcctggaagtggaggagatggagcccccgccggttatggagtcctcccagcccgcccaggccaccgccccgcttgactctgggtatgagaagcacttcctgcccacacctgaggagctgggccttctggggccccccaggccacaggttctggcctgaaccacacgtctggctgggggctgccagccaggctagagggatgctcatgcaggttgcaccccagtcctggattagccctcttgatggatgaagacactgaggactcagagaggctgagtcacttacctgaggacacccagccaggcagagctgggattgaaggacccctatagagaagggcttggcccccatggggaagacacggatggaaggtggagcaaaggaaaatacatgaaattgagagtggcagctgcctgccaaaatctgttccgctgtaacagaactgaatttggaccccagcacagtggctcacgcctgtaatcccagcactttggcaggccaaggtggaaggatcacttagagctaggagtttgagaccagcctgggcaatatagcaagacccctcactacaaaaataaaacatcaaaaacaaaaacaattagctgggcatgatggcacacacctgtagtccgagccacttgggaggctgaggtgggaggatcggttgagcccaggagttcgaagctgcagggacctctgattgcaccactgcactccaggctgggtaacagaatgagaccttatctcaaaaataaacaaactaataaaaagc

SEQ ID NO: 21589 - DNA, 3327 bp, Homo sapiens
acgcttcctttgccctgctttccatcccctctccctccaactcccctgccagagttccaaggctgtggaccccagagaaggtggcaggtggcccccctaggagagctctgggcacattcgaatcttcccaaactccaataataaaaattcgaagactttggcagagagtgtgtgtgtgtgtgtatggttgttgggcgtaggacaggtttcggggatgcgcggtacgcggtaccacccctcggaggcccccacccccagacgcccaggccgcctccccactccccctcaagcagccccagccggggactttccgtcgcggggaaggggcggggaccctgagcgaaaggtgcggaggcggcctgccggggtggttcggcttcccgttgccgcctcgggcgctgtacccagagctcgaagaggagcagcgcggccgcgcggacccggcaaggctgggccggactcggggctcccgagggacgccatgcggggaggcaggggcgcccctttctggctgtggccgctgcccaagctggcgctgctgcctctgttgtgggtgcttttccagcggacgcgtccccagggcagcgccgggccactgcagtgctacggagttggacccttgggcgacttgaactgctcgtgggagcctcttggggacctgggagccccctccgagttacacctccagagccaaaagtaccgttccaacaaaacccagactgtggcagtggcagccggacggagctgggtggccattcctcgggaacagctcaccatgtctgacaaactccttgtctggggcactaaggcaggccagcctctctggccccccgtcttcgtgaacctagaaacccaaatgaagccaaacgccccccggctgggccctgacgtggacttttccgaggatgaccccctggaggccactgtccattgggccccacctacatggccatctcataaagttctgatctgccagttccactaccgaagatgtcaggaggcggcctggaccctgctggaaccggagctgaagaccatacccctgacccctgttgagatccaagatttggagctagccactggctacaaagtgtatggccgctgccggatggagaaagaagaggatttgtggggcgagtggagccccattttgtccttccagacaccgccttctgctccaaaagatgtgtgggtatcagggaacctctgtgggacgcctggaggagaggaacctttgcttctatggaaggccccagggccctgtgtgcaggtgagctacaaagtctggttctgggttggaggtcgtgagctgagtccagaaggaattacctgctgctgctccctaattcccagtggggcggagtgggccagggtgtccgctgtcaacgccacaagctgggagcctctcaccaacctctctttggtctgcttggattcagcctctgccccccgtagcgtggcagtcagcagcatcgctgggagcacggagctactggtgacctggcaaccggggcctggggaaccactggagcatgtagtggactgggctcgagatggggaccccctggagaaactcaactgggtccggcttccccctgggaacctcagtgctctgttaccagggaatttcactgtcggggtcccctatcgaatcactgtgaccgcagtctctgcttcaggcttggcctctgcatcctccgtctgggggttcagggaggaattagcacccctagtggggccaacgctttggcgactccaagatgcccctccagggacccccgccatagcgtggggagaggtcccaaggcaccagcttcgaggccacctcacccactacaccttgtgtgcacagagtggaaccagcccctccgtctgcatgaatgtgagtggcaacacacagagtgtcaccctgcctgaccttccttggggtccctgtgagctgtgggtgacagcatctaccatcgctggacagggccctcctggtcccatcctccggcttcatctaccagataacaccctgaggtggaaagttctgccgggcatcctattcttgtggggcttgttcctgttggggtgtggcctgagcctggccacctctggaaggtgctaccacctaaggcacaaagtgctgccccgctgggtctgggagaaagttcctgatcctgccaacagcagttcaggccagccccacatggagcaagtacctgaggcccagccccttggggacttgcccatcctggaagtggaggagatggagcccccgccggttatggagtcctcccagcccgcccaggccaccgccccgcttgactctgggtatgagaagcacttcctgcccacacctgaggagctgggccttctggggccccccaggccacaggttctggcctgaaccacacgtctggctgggggctgccagccaggctagagggatgctcatgcaggttgcaccccagtcctggattagccctcttgatggatgaagacactgaggactcagagaggctgagtcacttacctgaggacacccagccaggcagagctgggattgaaggacccctatagagaagggcttggcccccatggggaagacacggatggaaggtggagcaaaggaaaatacatgaaattgagagtggcagctgcctgccaaaatctgttccgctgtaacagaactgaatttggaccccagcacagtggctcacgcctgtaatcccagcactttggcaggccaaggtggaaggatcacttagagctaggagtttgagaccagcctgggcaatatagcaagacccctcactacaaaaataaaacatcaaaaacaaaaacaattagctgggcatgatggcacacacctgtagtccgagccacttgggaggctgaggtgggaggatcggttgagcccaggagttcgaagctgcagggacctctgattgcaccactgcactccaggctgggtaacagaatgagaccttatctcaaaaataaacaaactaataaaaagcaaaaaaaaaaaaaaaagaaaagaaaaaacactgcatttgggcaccatctcagctcccttgcatccaggtgcagcatggactgagttcttgacaacagaatgtggtcagaagtgacatatgccaacacggggtctgggtgggggctcccccacatcctttccttgcctatgagctggaacataacacatgcctatgatccagctttggtcatacccaaggggaaggtggagcaagaaatgaaaaggaacctgaatccctgaatgactgcatggatagaaccactaagaaaaataaacttttatatttttataaaaaaaaaagc

SEQ ID NO: 21590 - DNA, 2982 bp, Homo sapiens
acgcttcctttgccctgctttccatcccctctccctccaactcccctgccagagttccaaggctgtggaccccagagaaggtggcaggtggcccccctaggagagctctgggcacattcgaatcttcccaaactccaataataaaaattcgaagactttggcagagagtgtgtgtgtgtgtgtatggttgttgggcgtaggacaggtttcggggatgcgcggtacgcggtaccacccctcggaggcccccacccccagacgcccaggccgcctccccactccccctcaagcagccccagccggggactttccgtcgcggggaaggggcggggaccctgagcgaaaggtgcggaggcggcctgccggggtggttcggcttcccgttgccgcctcgggcgctgtacccagagctcgaagaggagcagcgcggccgcgcggacccggcaaggctgggccggactcggggctcccgagggacgccatgcggggaggcaggggcgcccctttctggctgtggccgctgcccaagctggcgctgctgcctctgttgtgggtgcttttccagcggacgcgtccccagggcagcgccgggccactgcagtgctacggagttggacccttgggcgacttgaactgctcgtgggagcctcttggggacctgggagccccctccgagttacacctccagagccaaaagtaccgttccaacaaaacccagactgtggcagtggcagccggacggagctgggtggccattcctcgggaacagctcaccatgtctgacaaactccttgtctggggcactaaggcaggccagcctctctggccccccgtcttcgtgaacctagaaacccaaatgaagccaaacgccccccggctgggccctgacgtggacttttccgaggatgaccccctggaggccactgtccattgggccccacctacatggccatctcataaagttctgatctgccagttccactaccgaagatgtcaggaggcggcctggaccctgctggaaccggagctgaagaccatacccctgacccctgttgagatccaagatttggagctagccactggctacaaagtgtatggccgctgccggatggagaaagaagaggatttgtggggcgagtggagccccattttgtccttccagacaccgccttctgctccaaaagatgtgtgggtatcagggaacctctgtgggacgcctggaggagaggaacctttgcttctatggaaggccccagggccctgtgtgcaggtgagctacaaagtctggttctgggttggaggtcgtgagctgagtccagaaggaattacctgctgctgctccctaattcccagtggggcggagtgggccagggtgtccgctgtcaacgccacaagctgggagcctctcaccaacctctctttggtctgcttggattcagcctctgccccccgtagcgtggcagtcagcagcatcgctgggagcacggagctactggtgacctggcaaccggggcctggggaaccactggagcatgtagtggactgggctcgagatggggaccccctggagaaactcaactgggtccggcttccccctgggaacctcagtgctctgttaccagggaatttcactgtcggggtcccctatcgaatcactgtgaccgcagtctctgcttcaggcttggcctctgcatcctccgtctgggggttcagggaggaattagcacccctagtggggccaacgctttggcgactccaagatgcccctccagggacccccgccatagcgtggggagaggtcccaaggcaccagcttcgaggccacctcacccactacaccttgtgtgcacagagtggaaccagcccctccgtctgcatgaatgtgagtggcaacacacagagtgtcaccctgcctgaccttccttggggtccctgtgagctgtgggtgacagcatctaccatcgctggacagggccctcctggtcccatcctccggcttcatctaccagataacaccctgaggtggaaagttctgccgggcatcctattcttgtggggcttgttcctgttggggtgtggcctgagcctggccacctctggaaggtgctaccacctaaggcacaaagtgctgccccgctgggtctgggagaaagttcctgatcctgccaacagcagttcaggccagccccacatggagcaagtacctgaggcccagccccttggggacttgcccatcctggaagtggaggagatggagcccccgccggttatggagtcctcccagcccgcccaggccaccgccccgcttgactctgggtatgagaagcacttcctgcccacacctgaggagctgggccttctggggccccccaggccacaggttctggcctgaaccacacgtctggctgggggctgccagccaggctagagggatgctcatgcaggttgcaccccagtcctggattagccctcttgatggatgaagacactgaggactcagagaggctgagtcacttacctgaggacacccagccaggcagagctgggattgaaggacccctatagagaagggcttggcccccatggggaagacacggatggaaggtggagcaaaggaaaatacatgaaattgagagtggcagctgcctgccaaaatctgttccgctgtaacagaactgaatttggaccccagcacagtggctcacgcctgtaatcccttgcatccaggtgcagcatggactgagttcttgacaacagaatgtggtcagaagtgacatatgccaacacggggtctgggtgggggctcccccacatcctttccttgcctatgagctggaacataacacatgcctatgatccagctttggtcatacccaaggggaaggtggagcaagaaatgaaaaggaacctgaatccctgaatgactgcatggatagaaccactaagaaaaataaacttttatatttttataaaaaaaaaagc

SEQ ID NO: 21591 - DNA, 1484 bp, Homo sapiens
acgcttcctttgccctgctttccatcccctctccctccaactcccctgccagagttccaaggctgtggaccccagagaaggtggcaggtggcccccctaggagagctctgggcacattcgaatcttcccaaactccaataataaaaattcgaagactttggcagagagtgtgtgtgtgtgtgtatggttgttgggcgtaggacaggtttcggggatgcgcggtacgcggtaccacccctcggaggcccccacccccagacgcccaggccgcctccccactccccctcaagcagccccagccggggactttccgtcgcggggaaggggcggggaccctgagcgaaaggtgcggaggcggcctgccggggtggttcggcttcccgttgccgcctcgggcgctgtacccagagctcgaagaggagcagcgcggccgcgcggacccggcaaggctgggccggactcggggctcccgagggacgccatgcggggaggcaggggcgcccctttctggctgtggccgctgcccaagctggcgctgctgcctctgttgtgggtgcttttccagcggacgcgtccccagggcagcgccgggccactgcagtgctacggagttggacccttgggcgacttgaactgctcgtgggagcctcttggggacctgggagccccctccgagttacacctccagagccaaaagtaccgttccaacaaaacccagactgtggcagtggcagccggacggagctgggtggccattcctcgggaacagctcaccatgtctgacaaactccttgtctggggcactaaggcaggccagcctctctggccccccgtcttcgtgaacctagaaacccaaatgaagccaaacgccccccggctgggccctgacgtggacttttccgaggatgaccccctggaggccactgtccattgggccccacctacatggccatctcataaagttctgatctgccagttccactaccgaagatgtcaggaggcggcctggaccctgctggaaccggagctgaagaccatacccctgacccctgttgagatccaagatttggagctagccactggctacaaagtgtatggccgctgccggatggagaaagaagaggatttgtggggcgagtggagccccattttgtccttccagacaccgccttctgctccaaaagatgtgtgggtatcagggaacctctgtgggacgcctggaggagaggaacctttgcttctatggaaggccccagggccctgtgtgcaggtgagctacaaagtctggttctgggttggaggtcgtgagctgagtccagaaggaattacctgctgctgctccctaattcccagtggggcggagtgggccagggtgtccgctgtcaacgccacaagctgggagcctctcaccaacctctctttggtctgcttggattcagcctctgccccccgtagtagtaggcgcagcggggacctctagagcg

SEQ ID NO: 21592 - DNA, 2830 bp, Homo sapiens
acgcttcctttgccctgctttccatcccctctccctccaactcccctgccagagttccaaggctgtggaccccagagaaggtggcaggtggcccccctaggagagctctgggcacattcgaatcttcccaaactccaataataaaaattcgaagactttggcagagagtgtgtgtgtgtgtgtatggttgttgggcgtaggacaggtttcggggatgcgcggtacgcggtaccacccctcggaggcccccacccccagacgcccaggccgcctccccactccccctcaagcagccccagccggggactttccgtcgcggggaaggggcggggaccctgagcgaaaggtgcggaggcggcctgccggggtggttcggcttcccgttgccgcctcgggcgctgtacccagagctcgaagaggagcagcgcggccgcgcggacccggcaaggctgggccggactcggggctcccgagggacgccatgcggggaggcaggggcgcccctttctggctgtggccgctgcccaagctggcgctgctgcctctgttgtgggtgcttttccagcggacgcgtccccagggcagcgccgggccactgcagtgctacggagttggacccttgggcgacttgaactgctcgtgggagcctcttggggacctgggagccccctccgagttacacctccagagccaaaagtaccgttccaacaaaacccagactgtggcagtggcagccggacggagctgggtggccattcctcgggaacagctcaccatgtctgacaaactccttgtctggggcactaaggcaggccagcctctctggccccccgtcttcgtgaacctagaaacccaaatgaagccaaacgccccccggctgggccctgacgtggacttttccgaggatgaccccctggaggccactgtccattgggccccacctacatggccatctcataaagttctgatctgccagttccactaccgaagatgtcaggaggcggcctggaccctgctggaaccggagctgaagaccatacccctgacccctgttgagatccaagatttggagctagccactggctacaaagtgtatggccgctgccggatggagaaagaagaggatttgtggggcgagtggagccccattttgtccttccagacaccgccttctgctccaaaagatgtgtgggtatcagggaacctctgtgggacgcctggaggagaggaacctttgcttctatggaaggccccagggccctgtgtgcaggtgagctacaaagtctggttctgggttggaggtcgtgagctgagtccagaaggaattacctgctgctgctccctaattcccagtggggcggagtgggccagggtgtccgctgtcaacgccacaagctgggagcctctcaccaacctctctttggtctgcttggattcagcctctgccccccgtagcgtggcagtcagcagcatcgctgggagcacggagctactggtgacctggcaaccggggcctggggaaccactggagcatgtagtggactgggctcgagatggggaccccctggagaaactcaactgggtccggcttccccctgggaacctcagtgctctgttaccagggaatttcactgtcggggtcccctatcgaatcactgtgaccgcagtctctgcttcaggcttggcctctgcatcctccgtctgggggttcagggaggaattagcacccctagtggggccaacgctttggcgactccaagatgcccctccagggacccccgccatagcgtggggagaggtcccaaggcaccagcttcgaggccacctcacccactacaccttgtgtgcacagagtggaaccagcccctccgtctgcatgaatgtgagtggcaacacacagagtgtcaccctgcctgaccttccttggggtccctgtgagctgtgggtgacagcatctaccatcgctggacagggccctcctggtcccatcctccggcttcatctaccagataacaccctgaggtggaaagttctgccgggcatcctattcttgtggggcttgttcctgttggggtgtggcctgagcctggccacctctggaaggtgctaccacctaaggcacaaagtgctgccccgctgggtctgggagaaagttcctgatcctgccaacagcagttcaggccagccccacatggagcaagtacctgaggcccagccccttggggacttgcccatcctggaagtggaggagatggagcccccgccggttatggagtcctcccagcccgcccaggccaccgccccgcttgactctgggtatgagaagcacttcctgcccacacctgaggagctgggccttctggggccccccaggccacaggttctggcctgaaccacacgtctggctgggggctgccagccaggctagagggatgctcatgcaggttgcaccccagtcctggattagccctcttgatggatgaagacactgaggactcagagaggctgagtcacttacctgaggacacccagccaggcagagctgggattgaaggacccctatagagaagggcttggcccccatggggaagacacggatggaaggtggagcaaaggaaaatacatgaaattgagagtggcagctgcctgccaaaatctgttccgctgtaacagaactgaatttggaccccagcacagtggctcacgcctgtaatcccagcactttggcaggccaaggtggaaggatcacttagagctaggagtttgagaccagcctgggcaatatagcaagacccctcaccctaaccccggaaccctcaccctaacccct

SEQ ID NO: 21593 - DNA, 1347 bp, Homo sapiens
taagaatgatctcttccctaccctaccagataacaccctgaggtggaaagttctgccgggcatcctattcttgtggggcttgttcctgttggggtgtggcctgagcctggccacctctggaaggtgctaccacctaaggcacaaagtgctgccccgctgggtctgggagaaagttcctgatcctgccaacagcagttcaggccagccccacatggagcaagtacctgaggcccagccccttggggacttgcccatcctggaagtggaggagatggagcccccgccggttatggagtcctcccagcccgcccaggccaccgccccgcttgactctgggtatgagaagcacttcctgcccacacctgaggagctgggccttctggggccccccaggccacaggttctggcctgaaccacacgtctggctgggggctgccagccaggctagagggatgctcatgcaggttgcaccccagtcctggattagccctcttgatggatgaagacactgaggactcagagaggctgagtcacttacctgaggacacccagccaggcagagctgggattgaaggacccctatagagaagggcttggcccccatggggaagacacggatggaaggtggagcaaaggaaaatacatgaaattgagagtggcagctgcctgccaaaatctgttccgctgtaacagaactgaatttggaccccagcacagtggctcacgcctgtaatcccagcactttggcaggccaaggtggaaggatcacttagagctaggagtttgagaccagcctgggcaatatagcaagacccctcactacaaaaataaaacatcaaaaacaaaaacaattagctgggcatgatggcacacacctgtagtccgagccacttgggaggctgaggtgggaggatcggttgagcccaggagttcgaagctgcagggacctctgattgcaccactgcactccaggctgggtaacagaatgagaccttatctcaaaaataaacaaactaataaaaagcaaaaaaaaaaaaaaaagaaaagaaaaaacactgcatttgggcaccatctcagctcccttgcatccaggtgcagcatggactgagttcttgacaacagaatgtggtcagaagtgacatatgccaacacggggtctgggtgggggctcccccacatcctttccttgcctatgagctggaacataacacatgcctatgatccagctttggtcatacccaaggggaaggtggagcaagaaatgaaaaggaacctgaatccctgaatgactgcatggatagaaccactaagaaaaataaacttttatatttttataaaaaaaaaagc

SEQ ID NO: 21594 - DNA, 324 bp, Homo sapiens
tactgataggctttattaaagtagttttaagtttatgggaaaattaagtaaaaagtacagagggttctcatatactatcttttctctctcatcccagccacaatttccctattattagcatcttctttggcacatttgttagaattggtggacaaatattgatatataattattaactagagactacagttcacactagggtttattctgtgttttttacagttctattggttttgacagatacatgatgccatgtacctactattacagtaccataccaaaatagttttgttattccacaaatcccctattttccatctgttc

SEQ ID NO: 21595 - DNA, 1462 bp, Homo sapiens
attataatctgcaatctttaacttatatattaaatatttgtatcatatcctgcttttgaatttttagacactgataccctcaatttatatattttttggccttaattatctaagtcttaggtttaatggcctctggtatggattcgttgataaattgcatttgggttatcattttaattttttagaataacttattagaagattaattatcactgacagaccataaccttttcctcaatcttagttaatcatataattcagttgagaatgcttttggttacatgttgaaaatgcaaattgatgttcggatattaattatgaataatcatctttggtactacacataaaggtatgaaaccatggtgtgtgtgggcatgtgtgtgtgtatgtgtgtgtgtgtgtgtgtatgtgtgagacagagagatctatagtttataatttgcatgcttttaaatttcaaatgggtatttaatactcttattttttcctgaagtgcaaattgatgttcggatattaattatgaataataatctttggtactacacataaaggtatgaaaccatgggtgtgtgtgggcttgtgtgtgtgtgtgtgtgtgtgtgtgtgtgtgtatgtatgtgtgagacagagagatctatagtttataatttgcatgcttttaaatttcaaatcggtatttaatactcttattttttcctgaagtttcagcaataggtttaacaaccttttaaatgttaattttcagttaatcaacattttagataatgacaaattaattaagtgggtttttttggtggtgggatggatggtgctttagttttacttttgaatacaatttcatttatatatgcacagaagtatacaaatcataatgtactgctcaattgattttcgtaaaagaagtgctcccaagaaatcagcaccaggtcaataaataaaacaatgacagaatctcagaaacttctttccagttcctacctcgcttaccctaatggtaatcactaacctgacttccaacaccagagattagctttgcttacttctgaacttcatataaatggactcataccaaatattctcttttgtgtctgtattctttatctcagtatttatgtttgtggaaattgatttctgttgttgtaggctcattcattttattgctatattgtagtttattgtataaataaacaatagtctcttctgctgtagatagatgtttggcttgtttccagtttctggctattacaaatactgctgctataaacattcttacccatgtcctttgtggaacatatatacactttttttgggtatttagttagggttaaaatttcttggtctgggtgcagtggctcacacttgtaatctgaacactttgggaagccaaggcaggaggattgcttgagcccaagaatttgagatcagcctgggcaacatgacaagaccccacctctaaaaaaaa

SEQ ID NO: 21596 - DNA, 1047 bp, Homo sapiens
  misc_feature (24)..(25): n is a, c, g, or t
  misc_feature (30)..(30): n is a, c, g, or t
  misc_feature (33)..(33): n is a, c, g, or t
  misc_feature (39)..(40): n is a, c, g, or t
  misc_feature (55)..(55): n is a, c, g, or t
  misc_feature (57)..(57): n is a, c, g, or t
  misc_feature (61)..(61): n is a, c, g, or t
  misc_feature (65)..(65): n is a, c, g, or t
  misc_feature (70)..(70): n is a, c, g, or t
  misc_feature (92)..(92): n is a, c, g, or t
  misc_feature (99)..(99): n is a, c, g, or t
  misc_feature (102)..(102): n is a, c, g, or t
  misc_feature (106)..(106): n is a, c, g, or t
  misc_feature (109)..(109): n is a, c, g, or t
gttcatgtatacacgcagagatcnntctcnatntttacnngcacacttcatatananggcnacantaganatgggccataataggcacacanaggctcnctntgcncanatataagtgtagaaaaattcaggtgagagagagagagagatatgtgtcttgtgttgtgtgtgtgtgtgtgtgtgtgtgtgtgtgtgtatgtatgtgtgagacagagagatctatagtttataatttgcatgcttttaaatttcaaatcggtatttaatactcttattttttcctgaagtttcagcaataggtttaacaaccttttaaatgttaattttcagttaatcaacattttagataatgacaaattaattaagtgggtttttttggtggtgggatggatggtgctttagttttacttttgaatacaatttcatttatatatgcacagaagtatacaaatcataatgtactgctcaattgattttcgtaaaagaagtgctcccaagaaatcagcaccaggtcaataaataaaacaatgacagaatctcagaaacttctttccagttcctacctcgcttaccctaatggtaatcactaacctgacttccaacaccagagattagctttgcttacttctgaacttcatataaatggactcataccaaatattctcttttgtgtctgtattctttatctcagtatttatgtttgtggaaattgatttctgttgttgtaggctcattcattttattgctatattgtagtttattgtataaataaacaatagtctcttctgctgtagatagatgtttggcttgtttccagtttctggctattacaaatactgctgctataaacattcttacccatgtcctttgtggaacatatatacactttttttgggtatttagttagggttaaaatttcttggtctgggtgcagtggctcacacttgtaatctgaacactttgggaagccaaggcaggaggattgcttgagcccaagaatttgagatcagcctgggcaacatgacaagaccccacctctaaaaaaaa

SEQ ID NO: 21597 - DNA, 267 bp, Homo sapiens
gtgatattcttcccacccagaaactcttccagtaacagcaccacgactttcctctgttagattcccttcctcactccctacagaactgtaggtggaattgactccacttcccttctgggatgtgcatgtaaccaagttttgaccaatcagagtgtggtgcaccccccatctctggttggttgacagatagtcacatgataaacagcagtgagagggaaaccttcagtttagtcaggagagactgggaaagtggccagaaatgcctca

SEQ ID NO: 21598 - DNA, 257 bp, Homo sapiens
tttttttgagtcagggtcttgctccgtcatccaagctggagtgcagtggcacgatcatggctcattgtaacttggaactcctgggctcaagcgaccctcctgcttcagcctcccaaagtgctggtattagaggtgtgagccacctcgcccagcttcttctacaactattaactgaaattcttctgtaaataattttcccttaccaactaggtctttttggtatcctaaaataaccatttgtacatgatgagtagaat

SEQ ID NO: 21599 - DNA, 372 bp, Homo sapiens
ccgcaaaactcataccctcccaaacccaccctgaatcctgcacacctcactcattttcctcacatccctgagtcttttccctccacactctcccctcctggtttcttgttctgcaatatcttctttcccatgttatacttggattttactccttcctcttgtctatgctgctcagtggccagttttccccaggggaggctggggacattctctttctacggccctgtttatctctactctgaataagtcaatatgcaaacatgtgggtgtccaactcataccccccaggagggattctctttagcctgacagcctattatacttgtggggggtggcctaacgtgtgtctggggggaggcttatgcgcattgt

SEQ ID NO: 21600 - DNA, 519 bp, Homo sapiens
tttaggcactgagataaaaggtgtcccacagtgcacctagtttaaaaaggagtaagtcatcaagcatttcatcatgtgtgactcatatatggacatggaaaaatgtaagccatttatatataaacacgatgcttattaaaggaaaggaagaaaagaatataatggaaaacctagaagaatacttgcttttctttttctaggtgcacattaattagaacaagattaaagggcatgggtcaggtgaggtggctcatacctgtaatcccagcactttgggaggctgaggcaggaggattgtttgaggccaggagttcaagtccatcttgggcaacataatgacaccccccaaattaaaaaaaaaaatagccgggcatggtggcatgcactgagtccaagctacatgggggactgaggtaggagggttgcttgggcttaggaggtagaggctgcagtgagctatgattgtcccgctgcactcaagcctgcatgacagagcaagaatttgtctcaaaaaaaaaa

SEQ ID NO: 21601 - DNA, 317 bp, Homo sapiens
tttaggcactgagataaaaggtgtcccacagtgcacctagtttaaaaaggagtaagtcatcaagcatttcatcatgtgtgactcatatatggacatggaaaaatgtaagccatttatatataaacacgatgcttattaaaggaaaggaagaaaagaatataatggaaaacacaatagaaaaagtataggttcagggccatacaaaataacccacaatggagatagcattccactgataagagaacagtattataatcggtcagaggtaggaaacaggaactctctaacatcattttgcggttttcctggcgtcgagc

SEQ ID NO: 21602 - DNA, 207 bp, Homo sapiens
ttactgttacacagatagtgaacatggtacccaattggtaatttttcaaggccttgccctagaattttttaaaacatctctagagtatttgaaattattggaaggttgagtcatcattagagctggagagaactgagaatttaaggttcagtataatggacatttaaatgggtgactgtagaattgtcttaaagagggtcacgatta

SEQ ID NO: 21603 - DNA, 229 bp, Homo sapiens
cccacccattctgtagccactgagctctctgggagcaccaagccccacagccatcaccccgggccatgggggtctctcgatggcgagggtttggggcttccgtggagatcaatacccctactcctgccgtcgctacgggcggcccagcgggctgagaccatcgcatcttgctcagccccagttcagaacacagaacttcacaccgcctgctcgggcctggagtcccccc

SEQ ID NO: 21604 - DNA, 391 bp, Homo sapiens
actgggtctggcaatattgcccaggctggttgcaaacaccaacactgcgcccagccatctgggcctgataatttaaaaggactctcattcctcagataaaagttcttttcggccaggtgaggtggcacgtgtctgtaatcccagcgctttgggaggctgagactggaggatcgcctgagcccgggagttcgaggccagcttgggcaagatgttgagacccccgtctctaccaaaaatgaacaaattaaaagagtgtggtggcgggcactcgcctgtagtcccagctactcgggatggctgaggcgggaagatcccttgagagcccaggaattcgatacttaagctatgattgcactagcctgcgtggcaaaatgagacctcttctcttaca

SEQ ID NO: 21605 - DNA, 536 bp, Homo sapiens
atgagatttggattcagccattcactattataagttattgacataagaagtgctaaaaagaatctttatcctaaggaatgaaatcaaaacttcttcaaagttacctcaaactgaattgtaaacactaaatttaacagcaagaatttcagaaaaatgattttcttgctaataattcttaagatttattagtttggctagtttttaaagcatttaactggggaaaaaactatgtgttgaataattagatttctaagtcatcctgttaaatagttagtagagctttgcctttgatggtattactttttaattcttctcatccagttacaagttgtattaatgccaaagaagtgtatttgttacagattttcataacattttattaaattgctagatatgatgataggttttggtatgtttacagaggagaaattgcatattttcactcagattcaaaagagcatgctcttttaatgctttaatggtgaatggtcatgataagaggtattataaaaataaagtactaatttgaaaattag

SEQ ID NO: 21606 - DNA, 343 bp, Homo sapiens
ttaatgatgtttgtctagtagtcacttttttcttatgagaagagaaaacctttacatgttggtgccagggatttctggttttattttgatattttcccttatgtattcctcaaacaaatacctactttacttttgttgtttgagattcctcatatgagtaattatttagatcaacctcctgtcttgattgacctaggcaagacctttggaaatgctcttcccactatttaatgcttctggtataacttaaaacttgaaggaaaatattttctgagttattggggaaagcacaattagaaacctatcggcaacagagagagactccgtctcaaaaaaaaaaaaa

SEQ ID NO: 21607 - DNA, 356 bp, Homo sapiens
gatggacagaggaaaggctgaaagctccatcacctgctacttcgccttgtcactgggggaataaggaactaacatggggtttcagaaaggaggcaggaacacccaaccattccacatgaaaggaacatttcaaatgaaaggggaaaaaaggctgtgcttttttatttcaccacaggaactcttacgcaaggcaaaattgcaaaaaagcccacatgaaaagtaggttcccttgacagtcttcaggcttcttccctggggcaaggttttagcagtgagtgcaggaaggctgtgcacaatcagaaaggggcttttgagaattgacttttccaaagtggcactggggacacccagagcaa

SEQ ID NO: 21608 - DNA, 434 bp, Homo sapiens
gatgatgacattccagctaatttttagacattgtttattttgggataattgaaaaaggcccttgataatgttcaaaattctacctctgcttgtgtattttttatttagaagaccattcatttattgaaacaaaacgataaaattcaccctttaattgtggcttcatgttttcactggcgagtattttttataaatataaaagactagaacaccaggatagaatagatattttaaagtatctatgagtttcatttacagatattgactgtgattccaatttcaaaggcaaccaaagttttgtgcttatatatggagaaacatctatccaggggaaagcactttaagctatttttgctgatatggataatatcttcaccctctattagattcaatacccctgtgactgtgacaagatctcccatgtttaaaaaaaa

SEQ ID NO: 21609 - DNA, 347 bp, Homo sapiens
acattgtatttttacacctagtttatgtgaaaaatatctgtattgtgtattatagttttgcagtcactgaaaatagtgtactgaattcagctgttttcttcaggtagctattccatgataactgagtttgtcaagcaacaattgaagatttgaatgttggactatgaaaatgaggtttcagcagtcacagtcatcacagggtgagaatagattagatagtgttgccaggttttagaagacagagtattagaacctagtatcagtaaggaggaacacaggaatatagagaagaccatttttgagttttagattttttagaatttttagacagttttgcaggtatatat

SEQ ID NO: 21610 - DNA, 317 bp, Homo sapiens
gctgagagggggcacaatagtggggcctgtggtggatatggcctctggtcttaggttgcccctgctgtttgctctgaatataggagccatgcagccaggaagatgagagaaagctcggccacaggaaaaggactggtggtaggacctgtgaggataggaaaaagaaaagcaaacacagggcagagaaggatcagactagcaagcagaggcctctactgcagactaaagagtaggctgattagaaagtgcaaagagggaggggggcttctattgtgcagctgggaaattcttcctgttgcaaaaggggctacctgggg

SEQ ID NO: 21611 - DNA, 130 bp, Homo sapiens
agaaggtttttctgtatcataaccatagcaaaaggtaagccaattaatctgtagtaaacattattttataatattgagattcagttacttgtcctgaatttttgaaattcttatgtcctttactagtgtt

SEQ ID NO: 21612 - DNA, 459 bp, Homo sapiens
atctcctgacatcgtgatccacacgcctcggattcccaaagtgctgggattacaggcgtgagccaccgcgccgggcccataattttttatgatcatttctcttgagacatttcagaaggcatcaggcagcattaacaagaaacatcagcttgttttcacaggtgcacgtttttatttgatactgcctttaaaacattcctagtgattttatgtgtgaagctttccttatctaatgcctaattgcattctatgctctttgcacagtgaattcttgattatccatggtcatggtagaaagggagagcgtggataatctaaaaatctcatttgcatcaactgcctctctcaccaaatcttttgccagagatagtaatgagtgtatcaaagctagtggaagtacaaatgagctgtgaaatggcaaaaacacgtgttgccaaatgaaaagctctgaataataca

SEQ ID NO: 21613 - DNA, 272 bp, Homo sapiens
tctttttgatgtggcagttgtcccaagtttggcccatgggaccccctttctgttggcacatgtgtcttttagacatgactccctggtctttgatttttcccttgctttctgacctgggatactccaggtacacctgtacttcacttgctgtacaaccagactcagctgtttttccaagaagccctacttcttttttcttttgtctctgcaaaggctgggcatagagcacgtacctacctagttcttatagaatgggttttttggagacatct

SEQ ID NO: 21614 - DNA, 329 bp, Homo sapiens
aaggccaggaattcccatgtgtgctcagttggcccacagcatcattgtgcctaggaaactgcttcaatttatcaagtcctctgggctgggaatctcactgaattccaaacggcggaaagaggaaactttcccaacccgatgtgggtgtgacgcgagccaggggccccagggacactgtcccagagcacaccgtccccctttaacagcaactggagcttggattcgctcttatattgtacagtcctttcgaccattgccctggagcacccgcacacgcgcacgcatctccggccgcgctcacacacactcatacacacgcacgcaaacgc

SEQ ID NO: 21615 - DNA, 212 bp, Homo sapiens
ctgttttataagaagaaattgaactgaaatgcaggttgcgtgacttaacaaaataacttagtgtctttgcccttgacatattatttgtttttttttaatgagataattcagacataaaacaactatggtcgaaccaaatgattcttgttcttttcatttattgtattgccagtaagctttcagtgttggcatattgtttaatatattctgaa

SEQ ID NO: 21616 - DNA, 371 bp, Homo sapiens
aaggtagtataagcattttattgcctgaataataaaaggtggtctagagaacagctgcttcggtagcaggtgggatgggtaatgctaggtatcactctgtgatcatgaataatgttctcctggacatcatggcatcagttaaatcaggatatttgctcagcaacaatgaattaactccctctgacgttccctatggacgaagtccttccctagcacggtagcacttggagaggtgcacaatgcacatgacattttttacttatgttcaggtggaagccagaagttgattggcattttcttaatttacagtgtctaggaaaagcatacctgggtatcagtgttttagtcacattttacactcatcgcttttg

SEQ ID NO: 21617 - DNA, 278 bp, Homo sapiens
gctagggatgagactgaaacttcacaatttaaattcctcaaatttgaaatgtgtcaaaacaatctctgatttaattaagttttatcaattaacagtacttttgttcttagaggtttatatgtaatgtcaggaaatggaaatttatttttgatcaataaattattaaagagagaatattaactaaagaatatagtcttaagtagtagactcttgttttaattaataaagctacgagttaaatagcttaggattcatttccacttattcatttccacaaa

SEQ ID NO: 21618 - DNA, 144 bp, Homo sapiens
agcgcatgcacaaaggggaaagtgctacacactttcaaacaactagatcttgtgagaactcacttactgtcatgagaacagtaaggggaagtccgccccatgattcagtaatgtcccaccaggcccctccaccgacatgtgggg

SEQ ID NO: 21619 - DNA, 403 bp, Homo sapiens
gcggccgcggccgggctggggcttcagcgggaggcagcagaggggaagtggtcagcgtggcgaatgacggaagaaactcgcattgtctactggatcaaggacagacagctcaccaaccgtgacagcaccatactggaacttcaaaaagttctgaaaacatgttgtgctcagagcatgaaaattttctgctgtctttggaactttgtctacaaacagttagaagatgcagcccaagggctcaccatgggtggcgatgttgaagaacatgaagaccttactgctgatagcaccatcttcaaatttgtggaagcttatgtgagttggataggaaaatttcctacatataatgttggctcttccatttgtttctaatttagtatttctcaattgatattttttttgt

SEQ ID NO: 21620 - DNA, 359 bp, Homo sapiens
gcggccgcggccgggctggggcttcagcgggaggcagcagaggggaagtggtcagcgtggcgaatgacggaagaaactcgcattgtctactggatcaaggacagacagctcaccaaccgtgacagcaccatactggaacttcaaaaagttctgaaaacatgttggttcgtttgttggagtatttttcaacttaaattccttttccttttttttttttttgctcactttttcctctgcagaaaaaccttaaaatgttctaccttttccttgaaacctcctcccactccttagttcacattgacttgtctttaaatgtttttgagaaaataatcagaaatgcacaattaaacctcgtgccg

SEQ ID NO: 21621 - DNA, 769 bp, Homo sapiens
gcggccgcggccgggctggggcttcagcgggaggcagcagaggggaagtggtcagcgtggcgaatgacggaagaaactcgcattgtctactggatcaaggacagacagctcaccaaccgtgacagcaccatactggaacttcaaaaagttctgaaaacatgttgtgctcagagcatgaaaattttctgctgtctttggaactttgtctacaaacagttagaagatgcagcccaagggctcaccatgggtggcgatgttgaagaacatggtgagtttgactgtggctggtggcagaggtctctgtgtgtcagcggcatctgcaaagcagcccaatcttaagtattttgttataacagcacatacagactaagacaacttccttgaccaaactttaattgggctcatctgagcattctgcttaaccagggcatgaccttggtctgccattaggcaagaatcctgctaagttattttagagagaatctccgcaccttttatatctaattacctttgatatctgatcaagtttcttattccccacccttgatgtctaagtccttggcttccctctaccaagaatcctattagacaattttagcaagaatccccctacccttgatatctccttttgttaattctctatccactgaccttttcattcttctcattggcaatacatctatagctatctttgctgaatttggagtaagtgcaatctctctcccctcttgtaatagtcttgaataaagtcttccttaccatttcaata

SEQ ID NO: 21622 - DNA, 419 bp, Homo sapiens
aaagaaagaaaaatatatagtgagcccaataaagctgtataatctaaatcaaacatgacttgcatgcctggagactttgcactagaaaaatatttctacctaaaaaatcaaattttattttctttctcacaaatattcaatctgctttcatctcagttcttcctaccttgtcaaacctctccccacatttcctattctttttctctccagcctgatatctctcattatactgcttaagagaaatgttatgttactattcttttctcccagaactgtttctctggttctttaaggtgtctgagtacacactgtgccttcttccttttagccctctcttctccttgttccctgagccttacctttatgaccttagaacttcaagttcccactacaattttaaatatagactattttgcttt

SEQ ID NO: 21623 - DNA, 539 bp, Homo sapiens
catccggctgcgggaccctctcctcaccctcacagcacatccgttctaggaaccccactccgtctccactctccggaagcctgctcgcccagacctccatgtagcggcatctaaaggctgggaccctccccagctgcaaacgctctcctcgaggattctgcagcactctcccggccctcccgctccccactatcccgtggctggtttgcaccggtcctctaccctcggaagcccttacgaccctacgactggcaggacgcgcgccgacgggctcccccgcagctgcgtccactcggttaaccccggcccccgggactgtcctcggcgtggctgactctcttcccaggcccagcacggagagcggcccgcggcaggcgagcgtaaatgtgtgctaagtgcacgagtgcgtcccgactggtagtggtgcattcttcacccgggaggagcgccattcccggcggccggaccaggaaaacgctccgcttccggcactgctggcacttggggcgggcgctgggcccgaccgcggccgcaagctt

SEQ ID NO: 21624 - DNA, 252 bp, Homo sapiens
gtgtcctaaccctgggtatcctgagcttgctccctacttggtctttgaaaagtgttctctgttaacttcaacacatatttataggaattcctactaagtccaggcctggggctgggtccccacatggatgaaaaagaccaggagcaaacaggtgcaggcttggttcagtggggtgggttctgccccttcccaggtgatttggaagcaggtggtctgggacccacactctgagaaatgctgaggcatagccat

SEQ ID NO: 21625 - DNA, 514 bp, Homo sapiens
ttttttttctcagtagaaatagggtctcactctgttggccaggctggtcttgaactcctggcctcaagcaatcctcctgccttagcctcccaaagtgctgggattacagacataatctcacgtagatttttaaagaagccatttacaaagatataaaatttgggggccgggagtggtggctcacgcctgtaatcccagcactttgggaggccaaagcgggtcaatcatctgaggtcaggacttcaagaccagcctgcccaacatggtgaaaccctgtctctaccaaaaatacaaaaaattatctgggtgtggtggcgggcacctgtaatcccagctactccggaggctgaggccaagagcaaaactctgtctcaaacaaacaggtcggatgcggtggctcaccactgtaatcccagcactttgggaggctgaggcgggtggatcgcccaaggtcaggagttggagaccaccctggccaacatggcgaaaccccgtctctactaaaaatacaaaa

SEQ ID NO: 21626 - DNA, 689 bp, Homo sapiens
agcctcagttttcccatctgtagaatgggggaatgctgattcctttgcatagtggttgtgagggttaagtaatatagtacagtcatccgtcaatatccagggaggattgattctaaacccccccaccgcccgtccctgctgtcatgtctcacccctgcaccccctcaaggggcagagctggcagtcctgtcacagactggtactgataaatggcgtctctgagatgtctgtgcaccttatctgtattgggcagaatggtcctgtcccactcctgcatatggccactgcatggctaaatggtaaggcccagagggcatgcagcttggcatcagtaggaatctagatttgcatttcagcttcatgtccttgttagctgtggggggccttcatttctcaaggtccatctctttactgtaaaataggctcaagggttgtcctggcacagcccaccatggggacggccttgagagaggcatggaaagctgtccagggaaagttggttgtgctgtgaaatcctgtgtcattgttaacagggatgaaatgaggagtcttgcactgttctctttggtatgtatcctgccctggcaggtgctcagactgtgcctgatttttttttattgtataagggaatccccttttattgtatgtggaaatcccacaaaggcgattccacatacaataaaaaaaaa

SEQ ID NO: 21627 - DNA, 473 bp, Homo sapiens
aaaagctcccaaagagctctctcgcccctttcctctacgtgaggacacaatgagaacttggccatctgcaacctggaaagggcccctcaccagaactcaaccattctggcactctgacatcagactttcagcttgcagaactatgagaaataaatgcttattggataagccacccagtctatggtaatttgttacagtatcccaaactgactcatgcacattttacgatgaggaaactgaggttcacggaaactaagtggtttatccaaaatcacacatctttcacttgtcagagctctctctcaagcccaaactttctgacttgaagtccagacctgtctctctggctgatttcagtcctgacctttctgttagctacgtgttgggggtgcacgtcatggagagcaggtgtttgctcatcctgtccactgtccttcccagtgcctagaatccagggtaagtatgcaacacat

SEQ ID NO: 21628 - DNA, 707 bp, Homo sapiens
gcaatgtttttctttctctacctggtttaggtcatttaccatgcggtcctccaggttcaacagtatggctccaaatgatgaaatttcattctgattttctggctgaagactattctgtttgtgtatgtccaccacagttactttatcccttcatctgtggatgggcagttggttggcagagaatttgaactggagatgaactttattatccaggatgctgagagtataacatgcatgacagagcttttagagcactgtgatgtaacatgtcaagcagaaatagggagcatgtttacagccattctatgaaaaagtgttcggaatgtacagactagcacagaagctggactaattgaacaagtattgctgaaaatgagtgctgtagatgacatgatagcaggtatggggttgtctgtcaggaaagtataacttaaatgtttataaagtttcacatacttctctttatattctataggtaatgtagatttgttgacactgctttgatttaaaataaatggaaatgtatagaaattttactttttatattaatggaaaacctgaaaagtgaaagaagaaaaacataattattatagtagacaaacataattactaacgttgttttctaaattttagaaaatctcagtaccacggagtgctatgaagtctatcagaaaaataaacagtatctttttatgtagtatttcatt

SEQ ID NO: 21629 - DNA, 1891 bp, Homo sapiens
atcttttcctgaccatgtaatccaaagtagaatcctactttattctttttcagtttatactgttctttttctcttcactgtaatcaccatgatttataattctacatttgtttaattgtgtcatatatatttcttttatagctcataacttctaggagaactggttagccttgggtatctgcagtgcctggcacaatgtaaattttaaatgaatgaacacaaatgaattgtatttccacaattttgaatcttggtatagtggaaagaatattactctggaggtcaaggggctgtagttcttgtcttctccatgaatattctttatgtgccacttctaccatctgtgaaatgagggatgggagggggaacttgaggaagtggtattagatgatcattaatagtcctgtcagcatattattgtagggttttatgaatattataattgcattttagaccataataaccaaacattacatattgatatatttaatttttttatttaagtggtacatgatcagcattgtccacatttacaatcgatggagaaacagtgaaattcagtgttatgttaatggacaactggtatcttatggtgatatggcttggcatgttaacacaaatgacgtaagtctttatttttctgtctgtgttttaatttgtttgagagtatgatctatcattacaaaatgaattgaataataaaatagtttggtagaaacttaaaaaaaaaaaaaaaaaaaaaaaaaaaaaaaaaaaaaaaaaaaaaaaaaaaaaaaaaaaaagagagagacagaaaaaaaaaaaaaagcacaaaaagagagaaaagagacaaaagcaagcaaccaaccaagaaaaaagaggacaaaaaaaagagaaaggagaacagacaccaagacagaaaacgcagaccaaagaagcaaacaagcgaagacagacccaacaagcgacgcaacacagaaacaaaggagaaaagagaaaaagaaaacgaacgaagccgcgaacaagaagaagagaggagaacagacaacccacacacacagaaaacaaaagacaaagacgggaagaacgagaagaaaacaaagagaaaaaaaaggagagaacagaaaaaggaagaggagagaagaaggagcagagaaacaacggcagacagagagacaggaggccgcagaacgccaccagaagacaaaaaaaaccagagacaaagaggaggcgagccaaacaacccacggcagaaaggaggcaaaagaggcgccgaaggaggagaaagagagagaaaagaaaagagcacgagagcacgaccaccgcggcgggcagcgcgcgaggcaaagcacgagagcaaaggagacgagaaagcaggcaggagggagacgaagaggagcagagaaggaaaagacgacaatgaaagaaggagaaacgagaacgaaggaaggcagagcaggaagcaaaggcgcagagaagggcgtacaggccagcgacaagaagaagaaaagagcgagacgaaagaggaaaacagcaaagaaccgggaaggaagggaggagagagggaagagaacactagggaacggcgaaggagaagaagagaggaagaaggaggaaagagagggcaaacgaggaacaaagacagagagagacgaaacgagacagaaagaagacggcaacaacgaaaacagccacgaagcgaagcagaacaagcacaggagagacgaaaggaagacagcccgggagagcacgacaaagaagaagaggactaaacgagcaggagaaaggcataacgccgacgacaaaaaaaagaatgaagaaaaaagaggaagagaaagaacagagagacgcgaagcgacagcgacacacgaacaagaaaagacacaagacaggagaaggagacaaatgagaa

SEQ ID NO: 21630 - DNA, 983 bp, Homo sapiens
atcttttcctgaccatgtaatccaaagtagaatcctactttattctttttcagtttatactgttctttttctcttcactgtaatcaccatgatttataattctacatttgtttaattgtgtcatatatatttcttttatagctcataacttctaggagaactggttagccttgggtatctgcagtgcctggcacaatgtaaattttaaatgaatgaacacaaatgaattgtatttccacaattttgaatcttggtatagtggaaagaatattactctggaggtcaaggggctgtagttcttgtcttctccatgaatattctttatgtgccacttctaccatctgtgaaatgagggatgggagggggaacttgaggaagtggtattagatgatcattaatagtcctgtcagcatattattgtagggttttatgaatattataattgcattttagaccataataaccaaacattacatattgatatatttaatttttttatttaagtggtacatgatcagcattgtccacatttacaatcgatggagaaacagtgaaattcagtgttatgttaatggacaactggtatcttatggtgatatggcttggcatgttaacacaaatgacagtaccttcaagtttaaatctgagagtgatattcatttggcagaacatcataaacaggttttgtatgatgggaaacttgcaagtagcattacctttacatatactgctaaggccactgatgctcaactctgcctggaatcatcaccaaaagagaatgcatcaatttttgtgcattcccaacatgctctaatgcttcagattcaagtgctttttccactgtttccccaattggataatcggcagctcaatgacagtcaagtggaaacaactgtctggtaagttttctttacatgtgcaattgctggtattttatacacacttagactatgcatgatgtactcagtgctgtgtaaatgtat

SEQ ID NO: 21631 - DNA, 1460 bp, Homo sapiens
gcaatgtttttctttctctacctggtttaggtcatttaccatgcggtcctccaggttcaacagtatggctccaaatgatgaaatttcattctgattttctggctgaagactattctgtttgtgtatgtccaccacagttactttatcccttcatctgtggatgggcagttggttggcagagaatttgaactggagatgaactttattatccaggatgctgagagtataacatgcatgacagagcttttagagcactgtgatgtaacatgtcaagcagaaatagggagcatgtttacagccattctatgaaaaagtgttcggaatgtacagactagcacagaagctggactaattgaacaagtattgctgaaaatgagtgctgtagatgacatgatagcagagtaccttcaagtttaaatctgagagtgatattcatttggcagaacatcataaacaggttttgtatgatgggaaacttgcaagtagcattacctttacatatactgctaaggccactgatgctcaactctgcctggaatcatcaccaaaagagaatgcatcaatttttgtgcattcccaacatgctctaatgcttcagattcaagtgctttttccactgtttccccaattggataatcggcagctcaatgacagtcaagtggaaacaactgtctgctcctgcttcaggtgcagaaatacagcgatttccagtgccagctgttgagccagtgccagcaccaggggcagattcccctccagggacagcgctggagctagaggaagctccagagccctcctgccgctgccctgggactgcccaggaccagcccagtgaggagctgcctgacttcatggcacctcctgtagagccaccggcctcagccctggagctgaaagtgtggctggagctagaggtggcagagaggggtggccagcacagctccagccagcagctcccacactgctcccagtcctgggcacagtggaagctatggaggcagagaccagggtttgcaatctgggctcctctgcctcactggagagggacttctctcattcagcagagcagcagccctgctgctgaagggcctgctgctactgctgctggggctgtttgcctgcctgcaggaggtgctggagagcaagaaaaggagcctgtgagcaggggttccagcaggtcctcctgctcccagaggcgacctcctcctccaggcatggaggtttgccctcagctgggcatctgggccatttgcccctaacgtgctgcccaggatggcctcctcttgacaggcggacagggggtgagggggccagggggcatctccaaaggaagcttttaaactcagcagctgcaccccagaatctgtatgcctgcacctgcccaaggatttattcatagcttacctaagaatttcaaatttctaccataacactgaataaagtttgactttttgaaactt

SEQ ID NO: 21632 - DNA, 1140 bp, Homo sapiens
cggccgcggaggcaacgggggcatgcgcggcgccgtgtcccgctcctggagcctggagagcctgcgctcggccaccgccgagtaccttcaagtttaaatctgagagtgatattcatttggcagaacatcataaacaggttttgtatgatgggaaacttgcaagtagcattacctttacatatactgctaaggccactgatgctcaactctgcctggaatcatcaccaaaagagaatgcatcaatttttgtgcattcccaacatgctctaatgcttcagattcaagtgctttttccactgtttccccaattggataatcggcagctcaatgacagtcaagtggaaacaactgtctgctcctgcttcaggtgcagaaatacagcgatttccagtgccagctgttgagccagtgccagcaccaggggcagattcccctccagggacagcgctggagctagaggaagctccagagccctcctgccgctgccctgggactgcccaggaccagcccagtgaggagctgcctgacttcatggcacctcctgtagagccaccggcctcagccctggagctgaaagtgtggctggagctagaggtggcagagaggggtggccagcacagctccagccagcagctcccacactgctcccagtcctgggcacagtggaagctatggaggcagagaccagggtttgcaatctgggctcctctgcctcactggagagggacttctctcattcagcagagcagcagccctgctgctgaagggcctgctgctactgctgctggggctgtttgcctgcctgcaggaggtgctggagagcaagaaaaggagcctgtgagcaggggttccagcaggtcctcctgctcccagaggcgacctcctcctccaggcatggaggtttgccctcagctgggcatctgggccatttgcccctaacgtgctgcccaggatggcctcctcttgacaggcggacagggggtgagggggccagggggcatctccaaaggaagcttttaaactcagcagctgcaccccagaatctgtatgcctgcacctgcccaaggatttattcatagcttacctaagaatttcaaatttctaccataacactgaataaagtttgactttttgaaactt

SEQ ID NO: 21633 - DNA, 1325 bp, Homo sapiens
gtcacctgggctgggagggcggcttaggggcggaagcggcggtccagggccgcctggtgcagcagcctgtctcagccgcggtccctccagtccctccctggcggctgcggagccgtccgaggacaggggccataaactctccagagcgggaagccgcacgctggtggcccggccccgcgcacagacctggcggcagctggcacctgacccgctgcatgggtctccagtgagctcgctgcccacccggctgctgcagcctcggctccctcgtacgcgctctggtggagatgactgtgtgtgcgcacacctgggggtgaagaggacgcagcctgtctacctgacccatgaaatggaggagactgtaccccagaagcagcgggttcactgctccattgattaagcaagtctgggacacacatgtagctaagctgtgacttctgtgccagcggtcccaacacccacgccttcaggaagacacatgtgtgaggggttgcatgtttgtcaggcctgagagtggagagcaggggccagagacactagctcctgcttcaggtgcagaaatacagcgatttccagtgccagctgttgagccagtgccagcaccaggggcagattcccctccagggacagcgctggagctagaggaagctccagagccctcctgccgctgccctgggactgcccaggaccagcccagtgaggagctgcctgacttcatggcacctcctgtagagccaccggcctcagccctggagctgaaagtgtggctggagctagaggtggcagagaggggtggccagcacagctccagccagcagctcccacactgctcccagtcctgggcacagtggaagctatggaggcagagaccagggtttgcaatctgggctcctctgcctcactggagagggacttctctcattcagcagagcagcagccctgctgctgaagggcctgctgctactgctgctggggctgtttgcctgcctgcaggaggtgctggagagcaagaaaaggagcctgtgagcaggggttccagcaggtcctcctgctcccagaggcgacctcctcctccaggcatggaggtttgccctcagctgggcatctgggccatttgcccctaacgtgctgcccaggatggcctcctcttgacaggcggacagggggtgagggggccagggggcatctccaaaggaagcttttaaactcagcagctgcaccccagaatctgtatgcctgcacctgcccaaggatttattcatagcttacctaagaatttcaaatttctaccataacactgaataaagtttgactttttgaaactt

SEQ ID NO: 21634 - DNA, 1195 bp, Homo sapiens
tgctttcttggatcatcagaaactgctgatgcaaatagggtattctgtggtcaacttggtgccgtgtatgtgttcagtgaagcactcaacccagcacagatatttgcaattcatcagttaggacctagatataagagtaccttcaagtttaaatctgagagtgatattcatttggcagaacatcataaacaggttttgtatgatgggaaacttgcaagtagcattacctttacatatactgctaaggccactgatgctcaactctgcctggaatcatcaccaaaagagaatgcatcaatttttgtgcattcccaacatgctctaatgcttcagattcaagtgctttttccactgtttccccaattggataatcggcagctcaatgacagtcaagtggaaacaactgtctgctcctgcttcaggtgcagaaatacagcgatttccagtgccagctgttgagccagtgccagcaccaggggcagattcccctccagggacagcgctggagctagaggaagctccagagccctcctgccgctgccctgggactgcccaggaccagcccagtgaggagctgcctgacttcatggcacctcctgtagagccaccggcctcagccctggagctgaaagtgtggctggagctagaggtggcagagaggggtggccagcacagctccagccagcagctcccacactgctcccagtcctgggcacagtggaagctatggaggcagagaccagggtttgcaatctgggctcctctgcctcactggagagggacttctctcattcagcagagcagcagccctgctgctgaagggcctgctgctactgctgctggggctgtttgcctgcctgcaggaggtgctggagagcaagaaaaggagcctgtgagcaggggttccagcaggtcctcctgctcccagaggcgacctcctcctccaggcatggaggtttgccctcagctgggcatctgggccatttgcccctaacgtgctgcccaggatggcctcctcttgacaggcggacagggggtgagggggccagggggcatctccaaaggaagcttttaaactcagcagctgcaccccagaatctgtatgcctgcacctgcccaaggatttattcatagcttacctaagaatttcaaatttctaccataacactgaataaagtttgactttttgaaactt

SEQ ID NO: 21635 - DNA, 341 bp, Homo sapiens
tttttttttagactagtcaaatgcagtactgagagtatgagtagaacaaggagttcaatctgtaactgactgtgaaaaatcccttgagataactcattaccttagacaagtctcatctattgctggtttaagaatgagtaataaatgttgtcaagtcttttttctccatttattgagatgatctcatggttttctaattcaatctttggatatggtgaattacattggatgctttttctaacactgaactgacagtatattcctgacataaactccagctagacatggggtattatccttttcataagattgattttctaatattttgttgaagatgtttg

SEQ ID NO: 21636 - DNA, 390 bp, Homo sapiens
cctgagccgctgctcccagctcaccaccttctactttggcagaaattgcatgtctacggacaccctgaaggacctgctgcgccacaccagtgggctgagcaagttaagcctggagacgtatcctgcccctgaggagagtttgaattccttggttcgtgtcgattgggagatcttcgccccactttgggctgagctgatgtgtacactgagggaagtcaggcagcccaagaggatcttcactggtcccactccctgcccttcctgtggctcatcaccgtctgaggaactggagctccatctttgctgctagggaaggcgtgcctagtggggttgataaatccaaagttctcttccaggcacttggacactaaaatctagtatgtaagtgca

SEQ ID NO: 21637 - DNA, 122 bp, Homo sapiens
gacagaatccccaagacagaagccatggtcctttataacctaatcttagaaggcatggtggctcacgcctgtaatcccagaactttgagaggctgaggtgagcacgtcacttgaggttagga

SEQ ID NO: 21638 - DNA, 560 bp, Homo sapiens
gatcctcataattgacaaattgtcaatatttatgaatacactttatatacataattcaaaagcaaagtatacaattcatctagaaatataagttctgatatatttggaaaagttgtcattttttgaggtgttttgtcagttgatctcagtatagtactgtgcttaggaatacatgttgcttgactgtggatgataacatagaacaatagttggaacgttaagttccattgaagaaaacaagatgtagtaatgatcattgtctactctaaagaatatttttgaccagatgcggtggctcacgcttgtaatcccagcactttgggaggccgaggcgggcagatcattaggtcaggagttcaagaccagtctggccaacacaatgaaaccctgtctctactaaaaatacaaaaattagctgggcttagtggcgggcacctgtaatcccagctactcaggaggctgaggcaggaaaatcgattgaacctgggaggcggaggttgcagtaaggcaagatcatgccactgcacttaagcctgggtgacagagctagattccatctc

SEQ ID NO: 21639 - DNA, 696 bp, Homo sapiens
cagtgtatgtttgtctaaagttctatcaattaataaatggatctgcagaaagccagttagtttaaggggcaagtagatggagggtgcttaaaatcacaccccctgctaaacattttgctctccttatttaaaataaaatcacagatattttctgagaaggaataacaatttgagtgaaatagcagatgagaagttgccaattttaaagtgaaagatattaaatatttctgggattcttacaggattccacttagaaaaatctagcaaacctggatttcagcatcttttgcttgactttaagagaaaaataacacgatcaaattaaaattatacagctgtcagcgttcaagtcaggcagttcacaatagacaagaaaaattgccttcctaatacatattggtataattaagccatatggaagtctctgaattctctcctccagttagaaaatggagtgttggttgccactgttctttgtcatgaagtgaactaggtagtcttttaaaaatacacttgtaaaaccaacagataggccatcccatggcatcttctgagcatgtagcttttccattccaccagaaatataatttgcctcctgaggttgctgatttttatttttcttattttcacaagaaataactatttcttgaaaaacaaagctgaatatcttaaagcaaacccttcctaaagaaaaaa

SEQ ID NO: 21640 - DNA, 642 bp, Homo sapiens
gggaagtagtacagatagtgtagagttcccacacaccctagacccagtcttctctgttattaacattaatacttgagtatggcacatttgtcacaattaaagaaccaaattattatttcatggtttatagtaaaccaaattccatattgttactcagatttccttagttcttacctaatatcctttatctgttccatgatcctgtctgggacactatttcattgtcatgtttccttaggcttctcttgactgactgtgacagtttcctaaactctccttcttattgatgatctggacagttttcaggaatattgatcaggtattttgtcaaatgaccctcagttggaacttgtgtgaagtttttcccattattagactgggtttatggactttctaggaggaagacttcagataaaatgtcattctcatcatatcaagggcacatacaagcaatatgacttaccactgatgttgatgttaaccaaccaacctacctaccttccttccttcctttttctttctttctttctttttttttttttttgacagagtcttgccgtgttgctaggcggagcttgcagtgagctgagatcacaccactgcacttcatccagcctgggcaacagagcgagactccatctc

SEQ ID NO: 21641 - DNA, 206 bp, Homo sapiens
ctccagatccaatgcaattctaataataattccaagcggcattttggtagaaatttacaagctgattctaccatttatatggtaatgtcaatgatcaagaataataaaatagcaatattataaaagaataatggcgaatgaattcactacctatttccagaattactctacagctatgaaaatcaagattatgtgttttgttgaaa

SEQ ID NO: 21642 - DNA, 581 bp, Homo sapiens
agaattatattgtccaaggaaacttaaagagacagtagttttatgaaaactaatatatgtcaaatgaaagtatgtattgtttctttattttgctttatcctttttctcctatcttatcaaatcttactaaacacttgagttaggcaacattatttcaatatagctttaatacattgaatttattttcagaacaaaggtttgctggtttgaatgttgtttttctctgtggaaatgggaaagaaatgaaatggggtcctattcccccttcctgaaaggattgccaaatccatggtagattcagggctctccctgtttccttctctctcccctccacctcacaccccaccatcttttatctctgttacttactcaggagacgtgaaagccactacataataagtgtaccattgctattcctgaaaactaaaaatacaaaaattagccaggcatggtggcatgtgcctgtaatcccagctacttcagaggctgaggcaggagaatcgcttgaacctggaaggcggaggctgcagtaagccgagattgcgccattgcattccagcctgggcgaaggagcaagactc

SEQ ID NO: 21643 - DNA, 452 bp, Homo sapiens
cccaccctaatgacctcattttaacttaccccttttataatccatctccaaacagagtcatattttgagatatcgggggttaggactttaacatatgaatttgagggagacgcaattcagcacaaagcacaaggcataaataacttgtttttgtacagattcttagctaaggaactacctttctagaaagccctgtgaaatattcaaaagtatatgaggtgacagatacatgaattagcttgatttaaccatttcacaatgtatacaggtaccagaacatgctgcacactgagaatatatttcatttgtacgtgccagttataccttagccataaattcatgtggatagataacgtttttctttaaaagcaaacttaaagaatattaatcaaagagtattcatatcaaataattactgacagtgttgttttccaacctgataattttcttga

SEQ ID NO: 21644 - DNA, 1094 bp, Homo sapiens
ggcgcacgcccctcctcgcgggcactggagaccccggggaggaaggctggggagtgttgtcgcccagctgcagggaaccgtggttgatcagagctccccgaggaggagaaagttgtggaacagggacaccagggagctgccacagccttcccggtggccccgggaggtcttcgaggccctccagggtgggcagttttgagagaatacagcccagctggggtgtgccaggcccccgaaggcccaagccagagctctgatgtgaataaatacagccaaggctggggacggaggtgaggggtgactgagaacagccctgcctcaccgcggcccctacgccctcgggttggatggaaaccagcccctccacatccccctccccaggtggctcaggagttaggaaggaggctgtctgtgggggggacccacgatgccactgtggagggaggtggctgaggcaccctgtctctgcccggcggccgcgggggaggcagccgccgcgctcaggggctccagattccagtttctggagttgaaagctactgcatctcttccgccagccccgggaggagaggcgcagacatcacctgtcagctggtgctgactccgtgggcgactgttcagggcttcctcagaaggtttaaaatggaaatggcctgagctgacagggcccgtgcctgggaggggacgctgcctagctgggccagcagtgagggggccctggtaggtgtgaggggcaggaagagctgagggctgtcacatatctggctgaagggtcggccatgggcacagggtgtgtgtgtgtgtgcgcacccagtcccatgttctttcccagacacagagactggatactcttcagtaaaaagcaccctgaccccagcatggaggctccgtagcccacacccccaaggcagctgtggcctgctggacttcacctagacctgggtctgtgcatccgcactctaccatttattggtccctccacctccctgtgcctcagtttcccttgttggtaaaatgggattgatagtgccacctcctgagcctgagccagggtgctgctttgtaagtgcatttgacgcatgttgttagtggtc

SEQ ID NO: 21645 - DNA, 476 bp, Homo sapiens
atctttttctcggtgtttctgttgtggcagtcatgaatgagactctgtcaggtctccatggcagggacctgattggcagaaggcccaggtcagtgcatttcaaattcaccacctcttgtgcacagaaagcttctttcctacaggctcccagcaagggtgtgaaagcaagcctagttctccgaggctctctttaactctaatgggtgactggttggaggattcctcatcagccttgcaaaaactcttagaactgcattggtacctaaaacttctttctctttgtttttcataggaatcagctctgcatagtggtctgtgggttctcccatactaccttcatgcctgccccacattccctcacagatgtcttccctgataaattatcttgtatgtctaatcccatcttggatgcatctcagttggtaaatactaacataccaggcttgattcttgcccttccttctttctctttctct

SEQ ID NO: 21646 - DNA, 460 bp, Homo sapiens
ccaagaatattaaattgtcagcttagcccagtctgttatgcaagctcagagtccttactggggaaaaataggaccctgagagatggaaacatctgggctgatacattcaagttttaaatcctcagattcctttgaacctctgaatctacagaagagtcccatgctttaaggaccgatgctggccaggtgtggtggctcatgcttgtaatcccagtactttgggaggctgaggcgggcagatcacttgaggtcaggagttcaagaccagcctggccaacacagtgaaaccctgtctctactaaaaatacaaaaattagctggttgtggtggcgagcacctgtaatcctactcggcaggctgaggtatgagaatcacttgaacctgggaggtggagtttgcaatgagccgagatcacgccactgcactccagcctgggtgacagagcgagactctgtctcaa

SEQ ID NO: 21647 - DNA, 414 bp, Homo sapiens
ttgtttgataggactattgcctgaatagcccaagcaaatatcttttgcttatataaagttggactgttatttttttctgaattatgtaagtacttgccccatttctattattttaccattgttagcttgctcttagaagggtgaggtatgggtttcttttagaaattctgcactattgctctactctccttctccccctctcttgatgagctttggtatcagtatattccagctgcaatgctttgtagtagaaactatatcttttaaaatatactggacatggtggctcatgtctttaatcccagtgactcaggaggctgaggcaggaggatcacttgaacctaggggtttgaggctgcagtgaactgtgattgtgccactgtactccagcctgagtgacaaagcaagaccctg

SEQ ID NO: 21648 - DNA, 387 bp, Homo sapiens
acatcgacagacagtcttcttttgacagtagaagatatttccatgccaggtaaagtgagaggcatcttaacagtgagaagagtgtccatgttccctgtggtcagtggccaccagtgttgacatttcctgtgttatgctgccaagttgatgatggcttgtaggttatgtgtatctaaaacttctgtctgattagtcttcttatccttttctgtgtatagtcatgcactgcaaaacgacattggagactgggcctggtggctcacgccggtaatcccagcgctttgggaggccgaggcgggtggatcacgacatcaggagatcgagaccatcctggctaagacggtggggccctgtctctactaaaaatgcctccccagtagccgggca

SEQ ID NO: 21649 - DNA, 537 bp, Homo sapiens
acaataaataaggtgatttcagatatttatcaatgaccagtgaatgaagtaaagcagggcaattgtataaagagtaatatgggatgcagtgtagtaacagtattatatatgagaacatgatataatgagaaggagccacctgcatgaagacttggaataagatcagccacagagaaggaaaagtaaatgaaaagcccaatgtaagcgtcaggaggggagagtagtacaagatgaggtcagaaagataggcaagggctggctgcagtggctcacacatgtaatcccagcactttgggaggccaaggtgggtggatcacttggtgtcagtagttcgagaccagcctgaccaacatggtaaaaccctgtgtctactaaaaatacaaaaattagccaggcatggtggtatgcacctgtagtcccaactactggggaggccgaggcaggagaatcgcttgaacctaggaggcggacgttgcagtgagcggataccatgctgctgcatccagcctagacgacagagcaagactccatcccaaa

SEQ ID NO: 21650 - DNA, 677 bp, Homo sapiens
catacttattacctttgtggacaagatggacatatgtagaaaggatgaaagtgaagctaaattgaatgttagtactcacccgatgataaaccagagagtgagaaatgctatgtctctgattaacatttttattaatggctcagattaatttatagatgatatgtgtctcagtccattttgtgcagctatagcagaatacctgagactgggtgatttataaagaacagagattcatttcttatatttctggaggctgggaagtccaaggttgagggatccacatctggcgagggccttcttgctgtgtcattccatgttggaaggcagaagggcaagagagcatgcatgagcaagaaagaaaggtgccaaactcatccttttattaggaactcactcaacaataactaatccacttccaggataaaggcatttaatccactcacaggagattcatctcttaaagtctccacctttcaacactgctccactggggattaagtttccaacacatgaatttttgaggagggcacattcaaactatagcagtatatttatcaaaatttcaaaagggtatcaaatatattaggcattaggattaaatatttcaacagattggaacagtggacttaacatgaaatttaatcaagtatctgcttttgtgaagaaaggaaaaaaat

SEQ ID NO: 21651 - DNA, 860 bp, Homo sapiens
attccacctggggcacaaagccaaaattttttttcaaaaaaaaaaaaaaaagaaatttcccgtgggcggggcacagtgactcatgcctgtagtaatcccagcacttttggaggccaaggtgggcagatcccctgagctcaggagtccaacctgggcaacatggtgaaacccctgtctctacaaaaaataaaaaaatgagtccagtgtggtggtgtgcacctgtggtcccagctactctggaggctgaggtgggaagaccacctaagccccaggaggtcgaggctgcagtgagccatgattgcaccactgcactccagcctgggcaacagagtgagatccagtctcaaaaaaaaaaaattccccctttcctcaatccccaccccacccccccaccatatgcctgtgacccactgaggcttgcatactctgcattgcaattatgtgttattcttgattaaattcatttattctggagagcctgagtttctctttaggttgacaccactcactcttgtcagtccctggagtaccccaagcatcctcacgtggttagcagggaaaccttggcatctcaaggatgcaggtgcaggagagcgagtctccaggctgtcagagctgagcatgcagaagcctgccctggagagcgccccgaggttcctgaccgcaggttgtctcaggccctcctgagaccctggtgaagagtgggatgggaccgcggggggattccttggcaccccaagtagtcttggccttcatgtgtgaactcctgtccctaagggggcccccagtgagctccagccctgggacacagctgtgaacacctgatccttgttcccaacacccgtgcactgcccaaaaac

SEQ ID NO: 21652 - DNA, 2168 bp, Homo sapiens
cggggtaacggatatcgtcgacccacggcgctcgctgggcttctctcgcctcctgtcgtctggctgcaccgactttgcccacgccctcacgggagacgcagacactagggacccggggaggcgcccgggcggggccgccatgttggcagagagtcccagcgtcccgcgcctcggttccggaacccgcggcgcggggatggagctgggctgcccttgggcgccgtcctgggctggtgcccaccctggccgcgtggtcaccggcaagaagcccagggcctcacccaggcgtgggggccgggggaaggaccggaccctcccgaagtcgcggaccaggccgggcggcacccgggctggggtggctgctaccccgagctaagctggctgcgccgcatctcacggtccccggggcccgagcgctgcgcctggaccggcgccgagcgaggcggccaatcggccggctggacccacagtccccgcgccataggcgggtcggggctttcagacccggctcccagccctcgaactcggtaaccttggaggtcagcttgagatgactgcgcttcctgcacgcgttgtcctccccagaaacgcccaaaatggcaaagcggcgtccgtggccgcccgaggccctccctgcctgggttctccccagccgaacctcacgcccggcccctccttcattctctcctggccaggctgctcctgcccttgggcgaatccgctgcgtcccacggtcctgactgtggcatttctgcgtgtctggagagctcccccggcagcgacgtcctgcttagcacgtggctcgtctaactctgttcccctggcctcctgctcttctaggggtcatctttaggtttctgctggtctctgccccctgtgacacttgctggtacccaaatgaagtcgtttatgtcacactctaacaagaggccctgaagaagccctcacaaaaacattagcaacggagcgcctgcggcaaacccttctaacctttggtctttatggtttcaaagcagtttatgggaacttctcttttttaaaagattccccttggggccaggcgcggtggcttctgtaatcccaggactttgggaggccgaggcaggtggatcacttgaggtcaggagttcaagactagcctggccaacatggtgagacacccgtctctacaaaaaacacaaaaaaattagcagggcatggttggtggcaggcacctgtagtcccagctacacgggaggcttaggcaggagaattccttgaacccaggaggtggaggttgcagtgagccgagatggcaccactgcactccagcctgggcaacagagcaagactctgtctcaaaaaaaaaaaaaaaaaaaagaaatttcccgtgggcggggcacagtgactcatgcctgtagtaatcccagcacttttggaggccaaggtgggcagatcccctgagctcaggagtccaacctgggcaacatggtgaaacccctgtctctacaaaaaataaaaaaatgagtccagtgtggtggtgtgcacctgtggtcccagctactctggaggctgaggtgggaagaccacctaagccccaggaggtcgaggctgcagtgagccatgattgcaccactgcactccagcctgggcaacagagtgagatccagtctcaaaaaaaaaaaattccccctttcctcaatccccaccccacccccccaccatatgcctgtgacccactgaggcttgcatactctgcattgcaattatgtgttattcttgattaaattcatttattctggagagcctgagtttctctttaggttgacaccactcactcttgtcagtccctggagtaccccaagcatcctcacgtggttagcagggaaaccttggcatctcaaggatgcaggtgcaggagagcgagtctccaggctgtcagagctgagcatgcagaagcctgccctggagagcgccccgaggttcctgaccgcaggttgtctcaggccctcctgagaccctggtgaagagtgggatgggaccgcggggggattccttggcaccccaagtagtcttggccttcatgtgtgaactcctgtccctaagggggcccccagtgagctccagccctgggacacagctgtgaacacctgatccttgttcccaacacccgtgcactgcccaaaaac

SEQ ID NO: 21653 - DNA, 2255 bp, Homo sapiens
gtccggcagcgcctgcccaggtgtgctcggagcgtagctgtagcaacggggcgggccttggttcgcctggggcgtggtcgctgtctggggctcccacgtggttcgcctcatgggcctggagctgggcttctctcgcctcctgtcgtctggctgcaccgactttgcccacgccctcacgggagacgcagacactagggacccggggaggcgcccgggcggggccgccatgttggcagagagtcccagcgtcccgcgcctcggttccggaacccgcggcgcggggatggagctgggctgcccttgggcgccgtcctgggctggtgcccaccctggccgcgtggtcaccggcaagaagcccagggcctcacccaggcgtgggggccgggggaaggaccggaccctcccgaagtcgcggaccaggccgggcggcacccgggctggggtggctgctaccccgagctaagctggctgcgccgcatctcacggtccccggggcccgagcgctgcgcctggaccggcgccgagcgaggcggccaatcggccggctggacccacagtccccgcgccataggcgggtcggggctttcagacccggctcccagccctcgaactcggtaaccttggaggtcagcttgagatgactgcgcttcctgcacgcgttgtcctccccagaaacgcccaaaatggcaaagcggcgtccgtggccgcccgaggccctccctgcctgggttctccccagccgaacctcacgcccggcccctccttcattctctcctggccaggctgctcctgcccttgggcgaatccgctgcgtcccacggtcctgactgtggcatttctgcgtgtctggagagctcccccggcagcgacgtcctgcttagcacgtggctcgtctaactctgttcccctggcctcctgctcttctaggggtcatctttaggtttctgctggtctctgccccctgtgacacttgctggtacccaaatgaagtcgtttatgtcacactctaacaagaggccctgaagaagccctcacaaaaacattagcaacggagcgcctgcggcaaacccttctaacctttggtctttatggtttcaaagcagtttatgggaacttctcttttttaaaagattccccttggggccaggcgcggtggcttctgtaatcccaggactttgggaggccgaggcaggtggatcacttgaggtcaggagttcaagactagcctggccaacatggtgagacacccgtctctacaaaaaacacaaaaaaattagcagggcatggttggtggcaggcacctgtagtcccagctacacgggaggcttaggcaggagaattccttgaacccaggaggtggaggttgcagtgagccgagatggcaccactgcactccagcctgggcaacagagcaagactctgtctcaaaaaaaaaaaaaaaaaaaagaaatttcccgtgggcggggcacagtgactcatgcctgtagtaatcccagcacttttggaggccaaggtgggcagatcccctgagctcaggagtccaacctgggcaacatggtgaaacccctgtctctacaaaaaataaaaaaatgagtccagtgtggtggtgtgcacctgtggtcccagctactctggaggctgaggtgggaagaccacctaagccccaggaggtcgaggctgcagtgagccatgattgcaccactgcactccagcctgggcaacagagtgagatccagtctcaaaaaaaaaaaattccccctttcctcaatccccaccccacccccccaccatatgcctgtgacccactgaggcttgcatactctgcattgcaattatgtgttattcttgattaaattcatttattctggagagcctgagtttctctttaggttgacaccactcactcttgtcagtccctggagtaccccaagcatcctcacgtggttagcagggaaaccttggcatctcaaggatgcaggtgcaggagagcgagtctccaggctgtcagagctgagcatgcagaagcctgccctggagagcgccccgaggttcctgaccgcaggttgtctcaggccctcctgagaccctggtgaagagtgggatgggaccgcggggggattccttggcaccccaagtagtcttggccttcatgtgtgaactcctgtccctaagggggcccccagtgagctccagccctgggacacagctgtgaacacctgatccttgttcccaacacccgtgcactgcccaaaaac

SEQ ID NO: 21654 - DNA, 505 bp, Homo sapiens
gtggtgttcggttttctgttcctgtgttagtttgctgggaatgatggtttccagcttcatccatgtccctgcaaaggacatgaacacattcttttttatggctgtgcagtattatttgtccctagctggcccctttccttggcaatttctttaacctctaatccatcccacaagcatccttcactctcagaagttgattttgactctttctggtttctcttggcctatatccagtactaagacatttaaaaaatcttcttaaatcccgtgctttccattctctctgcagttgctctacttcaggtcttcatcatttaacttggctattatatggtcttccagttgttctcctgtctctaagctccatccacaccctcaccctgccactacatacacacttgctgaaaccaacatacccatcttctaaaaactatagacttcaattaattgctcccctacttaaaaatctttagtgattcatgactcccttcaaaataaagcttag

SEQ ID NO: 21655 - DNA, 1494 bp, Homo sapiens
gcgcttctgacaagcccgaaagtcatttccaatctcaagtggactttgttccaactattgggggcgtcgctccccctcttcatggtcgcgggcaaacttcctcctcggcgcctcttctaatggagccccacctgctcgggctgctcctcggcctcctgctcggtggcaccagggtcctcgctggctacccaatttggtggtccctggccctgggccagcagtacacatctctgggctcacagcccctgctctgcggctccatcccaggcctggtccccaagcaactgcgcttctgccgcaattacatcgagatcatgcccagcgtggccgagggcgtgaagctgggcatccaggagtgccagcaccagttccggggccgccgctggaactgcaccaccatagatgacagcctggccatctttgggcccgtcctcgacaaagccacccgcgagtcggccttcgttcacgccatcgcctcggccggcgtggccttcgccgtcacccgctcctgcgccgagggcacctccaccatttgcggctgtgactcgcatcataaggggccgcctggcgaaggctggaagtggggcggctgcagcgaggacgctgacttcggcgtgttagtgtccagggagttcgcggatgcgcgcgagaacaggccggacgcgcgctcggccatgaacaagcacaacaacgaggcgggccgcacgactatcctggaccacatgcacctcaaatgcaagtgccacgggctgtcgggcagctgtgaggtgaagacctgctggtgggcgcagcctgacttccgtgccatcggtgacttcctcaaggacaagtatgacagcgcctcggagatggtagtagagaagcaccgtgagtcccgaggctgggtggagaccctccgggccaagtactcgctcttcaagccacccacggagagggacctggtctactacgagaactcccccaacttttgtgagcccaacccagagacgggttcctttggcacaagggaccggacttgcaatgtcacctcccacggcatcgatggctgcgatctgctctgctgtggccggggccacaacacgaggacggagaagcggaaggaaaaatgccactgcatcttccactggtgctgctacgtcagctgccaggagtgtattcgcatctacgacgtgcacacctgcaagtagggcaccagggcgctgggaaggggtgaagtgtgtggctgggcggattcagcgaagtctcatgggaagcaggacctagagccgggcacagccctcagcgtcagacagcaaggaactgtcaccagccgcacgcgtggtaaatgacccagacccaactcgcctgtggacggggaggctctccctctctctcatcttacatttctcaccctactctggatggtgtgtggtttttaaagaagggggctttctttttagttctctagggtctgataggaacagacctgaggcttatctttgcacatgttaaaga

SEQ ID NO: 21656 - DNA, 1704 bp, Homo sapiens
cactcccgcgagcacgtgcgcgtcctcgctgctcacatttcggcggagggcgcgctccctggaaaattccactcctgtgctagctccaccctatgcggcttttctcctacccgacgctcttcactctcagctcccttcccggcggcctttgcgggaacaagatggcagcccccatacctcaagggttctcttgtttatcgaggtttttgggctggtggtttcggcagccagttctggtgactcagtccgcagctatagttccagtaagaactaaaaaacgtttcacacctcctatttatcaacctaaatttaaaacagaaaaggagtttatgcaacatgcccggaaagcaggattggttattcctccagaaaaatcggaccgttccatacatctggcctgtacagctggtatatttgatgcctatgttcctcctgagggtgatgcacgcatatcatctctttcaaaggagggactgatagagagaactgaacgaatgaagaagactatggcatcacaagtgtcaatccggaggataaaagactatgatgccaactttaaaataaaggacttccctgaaaaagctaaggatatctttattgaagctcacctttgtctaaataactcagaccatgaccgacttcataccttggtaactgaacactgttttccagacatgacttgggacatcaaatataagaccgtccgctggagctttgtggaatctttagagccctctcatgttgttcaagttcgctgttcaagtatgatgaaccagggcaacgtgtacggccagatcaccgtacgcatgcacacccggcagactctggccatctatgaccggtttggccggttgatgtatggacaggaagatgtacccaaggatgtcctggagtatgttgtattcgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatgacttctagggtgaagcctgggtgatgaggctgctggaagctttgaagtctcccattcccctcatgctataaaaagaactacctttgttctctcccatcctgctcaggtcttttcagcagtctcatcatcagcaaccatgactgatgactgggccctagcaggtggcaggtataacatggccatggacactcttcttttttaaattttatgtctagcttctgagtctagatgaaagacagtatgtttcagagaacattggatatcagtttttcccacagcagggactgtgagagacaaccagcagcatcctctttgtaatcacagggcagggatcagagtttgaaatgaaatgttgtcagggtgttggaaaaattttggtgagttctgcacatttcccctggttcaggctgggcatggaccagccttcagatggcagaagtggaagatgagcctacttgtgagcgatgtgactttaaggaaatgaagactggggaagaataattagtgtttataagacatttaagaggccctttttcatatactgactcactgatgaatcagcatttgcattttatggaaaaatataaatccaaagaaataatttatccctt

SEQ ID NO: 21657 - DNA, 944 bp, Homo sapiens
cactcccgcgagcacgtgcgcgtcctcgctgctcacatttcggcggagggcgcgctccctggaaaattccactcctgtgctagctccaccctatgcggcttttctcctacccgacgctcttcactctcagctcccttcccggcggcctttgcgggaacaagatggcagcccccatacctcaagggttctcttgtttatcgaggtttttgggctggtggtttcggcagccagttctggtgactcagtccgcagctatagttccagtaagaactaaaaaacgtttcacatctcctatttatcaacctaaatttaaaacagaaaaggagtttatgcaacatgcccggaaagcaggattggttattcctccagaaaaatcggaccgttccatacatctggcctgtacagctggtatatttgatgcctatgttcctcctgagggtgatgcacgcatatcatctctttcaaaggagagatgatagagagaactgatagagagaactgaacgaatgaagaagactatggcatcacaagtgtcaatccggaggataaaagactatgatgccaactttaaaataaaggacttccctgaaaaagctaaggatatctttattgaagctcacctttgtctaaataagttgggcccatgagatgtgtgctctgtatattccggaggtacaatttgccagtgtttccacaatggaaccaattgttttacagtctgttccacatgatcattgtaataaggtacagtggatattattttattactgtttgaatatcactgctgggaaatagaaaggaagtctttgtatttttaaaattatagttctccccaacctggctaatacggtgaaaccccgtctctactaaaaatacaaaaattagctgggcatggtggcgggcacctgtagtcccagctattcgggaggctgaggcaggagaat

SEQ ID NO: 21658 - DNA, 1070 bp, Homo sapiens
cactcccgcgagcacgtgcgcgtcctcgctgctcacatttcggcggagggcgcgctccctggaaaattccactcctgtgctagctccaccctatgcggcttttctcctacccgacgctcttcactctcagctcccttcccggcggcctttgcgggaacaagatggcagcccccatacctcaagggttctcttgtttatcgaggtttttgggctggtggtttcggcagccagttctggtgactcagtccgcagctatagttccagtaagaactaaaaaacgtttcacatctcctatttatcaacctaaatttaaaacagaaaaggagtttatgcaacatgcccggaaagcaggattggttattcctccagaaaaatcggaccgttccatacatctggcctgtacagctggtatatttgatgcctatgttcctcctgagggtgatgcacgcatatcatctctttcaaaggagagatgatagagagaactgatagagagaactgaacgaatgaagaagactatggcatcacaagtgtcaatccggaggataaaagactatgatgccaactttaaaataaaggacttccctgaaaaagctaaggatatctttattgaagctcacctttgtctaaataagttgggcccatgagatgtgtgctctgtatattccggaggtacaatttgccagtgtttccacaatggaaccaattgttttacagtctgttccacatgatcattgtaataagggttagaataggctcagtggctcatgcctatagtcctagcactttgggacgcccaggcaggagtatcacttgagcccagaagtttgaatccagtctggacaacaagcaagaccctgtctctacaaaaaagaataaatttagccaggtgtggggaggcacatgtgtctgtagtcccaactactcaagaggctgcggtgggagggtcccttgagcccagaggtcaaggctgcagtgaaccgtgactgtgccctgcacccccacctgggcaacagagcaagaccctgtctcagaaaagaacagcaagcaaagaaacacaaaacaaaaaa

SEQ ID NO: 21659 - DNA, 839 bp, Homo sapiens
cactcccgcgagcacgtgcgcgtcctcgctgctcacatttcggcggagggcgcgctccctggaaaattccactcctgtgctagctccaccctatgcggcttttctcctacccgacgctcttcactctcagctcccttcccggcggcctttgcgggaacaagatggcagcccccatacctcaagggttctcttgtttatcgaggtttttgggctggtggtttcggcagccagttctggtgactcagtccgcagctatagttccagtaagaactaaaaaacgtttcacatctcctatttatcaacctaaatttaaaacagaaaaggagtttatgcaacatgcccggaaagcaggattggttattcctccagaaaaatcggaccgttccatacatctggcctgtacagctggtatatttgatgcctatgttcctcctgagggtgatgcacgcatatcatctctttcaaaggagagatgatagagagaactgatagagagaactgaacgaatgaagaagactatggcatcacaagtgtcattttattggctgggtgcggtggctcacgtctgtaatcccagcactttgggaggctgaggtgggcagatcacctgaggtcaggaatcgaaaaccagcctgaccaacgtggagaaacctcgtctctactaaaaatgcaaaattagccgggcgtggtggcacatgcctgtaatcccagctactcaagaggctgaggcaggagaatcgcttgaacctgggaggcggaggttgcggtgagctgagatcgtgccattgcactccagcctgggcaacaagggcgaaactctgtctcaaaaaataataata

SEQ ID NO: 21660 - DNA, 1190 bp, Homo sapiens
cactcccgcgagcacgtgcgcgtcctcgctgctcacatttcggcggagggcgcgctccctggaaaattccactcctgtgctagctccaccctatgcggcttttctcctacccgacgctcttcactctcagctcccttcccggcggcctttgcgggaacaagatggcagcccccatacctcaagggttctcttgtttatcgaggtttttgggctggtggtttcggcagccagttctggtgactcagtccgcagctatagttccagtaagaactaaaaaacgtttcacatctcctatttatcaacctaaatttaaaacagaaaaggagtttatgcaacatgcccggaaagcaggattggttattcctccagaaaaatcggaccgttccatacatctggcctgtacagctggtatatttgatgcctatgttcctcctgagggtgatgcacgcatatcatctctttcaaaggagagatgatagagagaactgatagagagaactgaacgaatgaagaagactatggcatcacaagtgtcattttattggctgggtgcggtggctcacgtctgtaatcccagcactttgggaggctgaggtgatccacccgcctcagtgagccactgtgcccggcaaaaagatcgcagatggggatataactagtatcagtacaagtgcacccgtcttaattcataaggcttcatggcatcttatatacataatacaccatgtattactcctaataccccaatcagcatacggacacatatcagaatcgtacacagggcggctcatcagtccccattccagcaagggttcttcatgagaacccattcttgtaccttatcacatatgattgtgcctgttttgagcacatcattacggggacaaccgatctcgaggactgatgtgttaaggaaagaatatggctgtgtagcgggatgccgaggaggcaagagaactaaaagtaatccataatgtggggaggaaatccgtggatgtggtattaaccattgcggtaaagggatagaggagactatagtagataacgagattagtaagtgtagagaaacaggaagaagctcataatgtgtggagaagaaatattcgcaacaaaaaagttgggtagaattgtggtgagtatgttttttattctatcatcatagatttttatgagtgaaggaatagagagag

SEQ ID NO: 21661 - DNA, 1264 bp, Homo sapiens
gtatcaacgcagagtgcccattacggccggggactgatagagagaactgaacgaatgaagaagactatggcatcacaagtgtcaatccggaggataaaagactatgatgccaactttaaaataaaggacttccctgaaaaagctaaggatatctttattgaagctcacctttgtctaaataactcagaccatgaccgacttcataccttggtaactgaacactgttttccagacatgacttgggacatcaaatataagaccgtccgctggagctttgtggaatctttagagccctctcatgttgttcaagttcgctgttcaagtatgatgaaccagggcaacgtgtacggccagatcaccgtacgcatgcacacccggcagactctggccatctatgaccggtttggccggttgatgtatggacaggaagatgtacccaaggatgtcctggagtatgttgtattcgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatgacttctagggtgaagcctgggtgatgaggctgctggaagctttgaagtctcccattcccctcatgctataaaaagaactacctttgttctctcccatcctgctcaggtcttttcagcagtctcatcatcagcaaccatgactgatgactgggccctagcaggtggcaggtataacatggccatggacactcttcttttttaaattttatgtctagcttctgagtctagatgaaagacagtatgtttcagagaacattggatatcagtttttcccacagcagggactgtgagagacaaccagcagcatcctctttgtaatcacagggcagggatcagagtttgaaatgaaatgttgtcagggtgttggaaaaattttggtgagttctgcacatttcccctggttcaggctgggcatggaccagccttcagatggcagaagtggaagatgagcctacttgtgagcgatgtgactttaaggaaatgaagactggggaagaataattagtgtttataagacatttaagaggccctttttcatatactgactcactgatgaatcagcatttgcattttatggaaaaatataaatccaaagaaataatttatccctt

SEQ ID NO: 21662 - DNA, 1554 bp, Homo sapiens
cactcccgcgagcacgtgcgcgtcctcgctgctcacatttcggcggagggcgcgctccctggaaaattccactcctgtgctagctccaccctatgcggcttttctcctacccgacgctcttcactctcagctcccttcccggcggcctttgcgggaacaagatggcagcccccatacctcaagggttctcttgtttatcgaggtttttgggctggtggtttcggcagccagttctggtgactcagtccgcagctatagttccagtaagaactaaaaaacgtttcacacctcctatttatcaacctaaatttaaaacagaaaaggagtttatgcaacatgcccggaaagcaggattggttattcctccagaaaaatcggaccgttccatacatctggcctgtacagctggtatatttgatgcctatgttcctcctgagggtgatgcacgcatatcatctctttcaaaggagggactgatagagagaactgaacgaatgaagaagactatggcatcacaagtgtcaatccggaggataaaagactatgatgccaactttaaaataaaggacttccctgaaaaagctaaggatatctttattgaagctcacctttgtctaaataactcagaccatgaccgacttcataccttggtaactgaacactgttttccaactctggccatctatgaccggtttggccggttgatgtatggacaggaagatgtacccaaggatgtcctggagtatgttgtattcgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatgacttctagggtgaagcctgggtgatgaggctgctggaagctttgaagtctcccattcccctcatgctataaaaagaactacctttgttctctcccatcctgctcaggtcttttcagcagtctcatcatcagcaaccatgactgatgactgggccctagcaggtggcaggtataacatggccatggacactcttcttttttaaattttatgtctagcttctgagtctagatgaaagacagtatgtttcagagaacattggatatcagtttttcccacagcagggactgtgagagacaaccagcagcatcctctttgtaatcacagggcagggatcagagtttgaaatgaaatgttgtcagggtgttggaaaaattttggtgagttctgcacatttcccctggttcaggctgggcatggaccagccttcagatggcagaagtggaagatgagcctacttgtgagcgatgtgactttaaggaaatgaagactggggaagaataattagtgtttataagacatttaagaggccctttttcatatactgactcactgatgaatcagcatttgcattttatggaaaaatataaatccaaagaaataatttatccctt

SEQ ID NO: 21663 - DNA, 1233 bp, Homo sapiens
gcgtattgtggatgggcgcgagggcggcttttccacccccctgccattttgcaatccggaggataaaagactatgatgccaactttaaaataaaggacttccctgaaaaagctaaggatatctttattgaagctcacctttgtctaaataactcagaccatgaccgacttcataccttggtaactgaacactgttttccagacatgacttgggacatcaaatataagaccgtccgctggagctttgtggaatctttagagccctctcatgttgttcaagttcgctgttcaagtatgatgaaccagggcaacgtgtacggccagatcaccgtacgcatgcacacccggcagactctggccatctatgaccggtttggccggttgatgtatggacaggaagatgtacccaaggatgtcctggagtatgttgtattcgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatgacttctagggtgaagcctgggtgatgaggctgctggaagctttgaagtctcccattcccctcatgctataaaaagaactacctttgttctctcccatcctgctcaggtcttttcagcagtctcatcatcagcaaccatgactgatgactgggccctagcaggtggcaggtataacatggccatggacactcttcttttttaaattttatgtctagcttctgagtctagatgaaagacagtatgtttcagagaacattggatatcagtttttcccacagcagggactgtgagagacaaccagcagcatcctctttgtaatcacagggcagggatcagagtttgaaatgaaatgttgtcagggtgttggaaaaattttggtgagttctgcacatttcccctggttcaggctgggcatggaccagccttcagatggcagaagtggaagatgagcctacttgtgagcgatgtgactttaaggaaatgaagactggggaagaataattagtgtttataagacatttaagaggccctttttcatatactgactcactgatgaatcagcatttgcattttatggaaaaatataaatccaaagaaataatttatccctt

SEQ ID NO: 21664 - DNA, 1229 bp, Homo sapiens
attaaattaaattttcgggccaccttttaaaaatttttctatctcaggaatccggaggataaaagactatgatgccaactttaaaataaaggacttccctgaaaaagctaaggatatctttattgaagctcacctttgtctaaataactcagaccatgaccgacttcataccttggtaactgaacactgttttccagacatgacttgggacatcaaatataagaccgtccgctggagctttgtggaatctttagagccctctcatgttgttcaagttcgctgttcaagtatgatgaaccagggcaacgtgtacggccagatcaccgtacgcatgcacacccggcagactctggccatctatgaccggtttggccggttgatgtatggacaggaagatgtacccaaggatgtcctggagtatgttgtattcgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatgacttctagggtgaagcctgggtgatgaggctgctggaagctttgaagtctcccattcccctcatgctataaaaagaactacctttgttctctcccatcctgctcaggtcttttcagcagtctcatcatcagcaaccatgactgatgactgggccctagcaggtggcaggtataacatggccatggacactcttcttttttaaattttatgtctagcttctgagtctagatgaaagacagtatgtttcagagaacattggatatcagtttttcccacagcagggactgtgagagacaaccagcagcatcctctttgtaatcacagggcagggatcagagtttgaaatgaaatgttgtcagggtgttggaaaaattttggtgagttctgcacatttcccctggttcaggctgggcatggaccagccttcagatggcagaagtggaagatgagcctacttgtgagcgatgtgactttaaggaaatgaagactggggaagaataattagtgtttataagacatttaagaggccctttttcatatactgactcactgatgaatcagcatttgcattttatggaaaaatataaatccaaagaaataatttatccctt

SEQ ID NO: 21665 - DNA, 1320 bp, Homo sapiens
cactcccgcgagcacgtgcgcgtcctcgctgctcacatttcggcggagggcgcgctccctggaaaattccactcctgtgctagctccaccctatgcggcttttctcctacccgacgctcttcactctcagctcccttcccggcggcctttgcgggaacaagatggcagcccccatacctcaagggttctcttgtttatcgaggtttttgggctggtggtttcggcagccagttctggtgactcagtccgcagctatagttccagtaagaactaaaaaacgtttcacacctcctatttatcaacctaaatttaaaacagaaaaggagtttatgcaacatgcccggaaagcaggattggttattcctccagaaaaatcggaccgttccatacatctggcctgtacagctggtatatttgatgcctatgttcctcctgagggtgatgcacgcatatcatctctttcaaaggagggactgatagagagaactgaacgaatgaagaagactatggcatcacaagtgtcaatccggaggataaaagactatgatgccaactttaaaataaaggacttccctgaaaaagctaaggatatctttattgaagctcacctttgtctaaataagtaagtgaactccctacctttacccattctgttctcagcagttagctattattttaggcacagttttttgtttgtttgtttttgttttgcacaaatttgttttctgccttcaggtaagagatctagagtgagagaacttcctatattggaagtaattagtgactgaagctgtctttcactcccctctctgcttctgggaatttctaccatttggtctgtctcagttccacctgcaagtgttgggaccttgtgccagaatagctgcctttttcaccccatctgatccctgaattcatcctgatcttttttgtgtgtttgtcttatgtatcttcatttccctttccttggttattttgaatatatttcttgtgaaaatttccagctctccctccacttttatttttcttattttttattttgagatggagtctcgctctgtcgcccaggctgggagtgcaatggctgcaatcttggctctctgcaacctccacgtccctggttcaagcgactcccctgcctcagcctcccaagtagctgggattacaggtgcacgccaccacatccagctaatttttttgtatttttagtagagacggggtttcatcatgttggccagactggtcctgaactcctgacctcaggcaacctgcccgcctcggcctcccaaagtgctgggattacaggcgtgagccaccatg

SEQ ID NO: 21666 - DNA, 1655 bp, Homo sapiens
cactcccgcgagcacgtgcgcgtcctcgctgctcacatttcggcggagggcgcgctccctggaaaattccactcctgtgctagctccaccctatgcggcttttctcctacccgacgctcttcactctcagctcccttcccggcggcctttgcgggaacaagatggcagcccccatacctcaagggttctcttgtttatcgaggtttttgggctggtggtttcggcagccagttctggtgactcagtccgcagctatagttccagtaagaactaaaaaacgtttcacacctcctatttatcaacctaaatttaaaacagaaaaggagtttatgcaacatgcccggaaagcaggattggttattcctccagaaaaatcggaccgttccatacatctggcctgtacagctggtatatttgatgcctatgttcctcctgagggtgatgcacgcatatcatctctttcaaaggagggactgatagagagaactgaacgaatgaagaagactatggcatcacaagtgtcaatccggaggataaaagactatgatgccaactttaaaataaaggacttccctgaaaaagctaaggatatctttattgaagctcacctttgtctaaataagacatgacttgggacatcaaatataagaccgtccgctggagctttgtggaatctttagagccctctcatgttgttcaagttcgctgttcaagtatgatgaaccagggcaacgtgtacggccagatcaccgtacgcatgcacacccggcagactctggccatctatgaccggtttggccggttgatgtatggacaggaagatgtacccaaggatgtcctggagtatgttgtattcgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatgacttctagggtgaagcctgggtgatgaggctgctggaagctttgaagtctcccattcccctcatgctataaaaagaactacctttgttctctcccatcctgctcaggtcttttcagcagtctcatcatcagcaaccatgactgatgactgggccctagcaggtggcaggtataacatggccatggacactcttcttttttaaattttatgtctagcttctgagtctagatgaaagacagtatgtttcagagaacattggatatcagtttttcccacagcagggactgtgagagacaaccagcagcatcctctttgtaatcacagggcagggatcagagtttgaaatgaaatgttgtcagggtgttggaaaaattttggtgagttctgcacatttcccctggttcaggctgggcatggaccagccttcagatggcagaagtggaagatgagcctacttgtgagcgatgtgactttaaggaaatgaagactggggaagaataattagtgtttataagacatttaagaggccctttttcatatactgactcactgatgaatcagcatttgcattttatggaaaaatataaatccaaagaaataatttatccctt

SEQ ID NO: 21667 - DNA, 1194 bp, Homo sapiens
tgcctgcccctctgaacctgatcccttaagtacggccccgccgtcgcctcatcatgccaccaaatccggaggataaaagactatgatgccaactttaaaataaaggacttccctgaaaaagctaaggatatctttattgaagctcacctttgtctaaataagacatgacttgggacatcaaatataagaccgtccgctggagctttgtggaatctttagagccctctcatgttgttcaagttcgctgttcaagtatgatgaaccagggcaacgtgtacggccagatcaccgtacgcatgcacacccggcagactctggccatctatgaccggtttggccggttgatgtatggacaggaagatgtacccaaggatgtcctggagtatgttgtattcgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatgacttctagggtgaagcctgggtgatgaggctgctggaagctttgaagtctcccattcccctcatgctataaaaagaactacctttgttctctcccatcctgctcaggtcttttcagcagtctcatcatcagcaaccatgactgatgactgggccctagcaggtggcaggtataacatggccatggacactcttcttttttaaattttatgtctagcttctgagtctagatgaaagacagtatgtttcagagaacattggatatcagtttttcccacagcagggactgtgagagacaaccagcagcatcctctttgtaatcacagggcagggatcagagtttgaaatgaaatgttgtcagggtgttggaaaaattttggtgagttctgcacatttcccctggttcaggctgggcatggaccagccttcagatggcagaagtggaagatgagcctacttgtgagcgatgtgactttaaggaaatgaagactggggaagaataattagtgtttataagacatttaagaggccctttttcatatactgactcactgatgaatcagcatttgcattttatggaaaaatataaatccaaagaaataatttatccctt

SEQ ID NO: 21668 - DNA, 1605 bp, Homo sapiens
cactcccgcgagcacgtgcgcgtcctcgctgctcacatttcggcggagggcgcgctccctggaaaattccactcctgtgctagctccaccctatgcggcttttctcctacccgacgctcttcactctcagctcccttcccggcggcctttgcgggaacaagatggcagcccccatacctcaagggttctcttgtttatcgaggtttttgggctggtggtttcggcagccagttctggtgactcagtccgcagctatagttccagtaagaactaaaaaacgtttcacacctcctatttatcaacctaaatttaaaacagaaaaggagtttatgcaacatgcccggaaagcaggattggttattcctccagaaaaatcggaccgttccatacatctggcctgtacagctggtatatttgatgcctatgttcctcctgagggtgatgcacgcatatcatctctttcaaaggagggactgatagagagaactgaacgaatgaagaagactatggcatcacaagtgtcctcagaccatgaccgacttcataccttggtaactgaacactgttttccagacatgacttgggacatcaaatataagaccgtccgctggagctttgtggaatctttagagccctctcatgttgttcaagttcgctgttcaagtatgatgaaccagggcaacgtgtacggccagatcaccgtacgcatgcacacccggcagactctggccatctatgaccggtttggccggttgatgtatggacaggaagatgtacccaaggatgtcctggagtatgttgtattcgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatgacttctagggtgaagcctgggtgatgaggctgctggaagctttgaagtctcccattcccctcatgctataaaaagaactacctttgttctctcccatcctgctcaggtcttttcagcagtctcatcatcagcaaccatgactgatgactgggccctagcaggtggcaggtataacatggccatggacactcttcttttttaaattttatgtctagcttctgagtctagatgaaagacagtatgtttcagagaacattggatatcagtttttcccacagcagggactgtgagagacaaccagcagcatcctctttgtaatcacagggcagggatcagagtttgaaatgaaatgttgtcagggtgttggaaaaattttggtgagttctgcacatttcccctggttcaggctgggcatggaccagccttcagatggcagaagtggaagatgagcctacttgtgagcgatgtgactttaaggaaatgaagactggggaagaataattagtgtttataagacatttaagaggccctttttcatatactgactcactgatgaatcagcatttgcattttatggaaaaatataaatccaaagaaataatttatccctt

SEQ ID NO: 21669 - DNA, 1313 bp, Homo sapiens
agcggatgaggtttttgggctggtggtttcggcagccagttctggtgactcagtccgcagctatagttccagtaagaactaaaaaacgtttcacacctcctatttatcaacctaaatttaaaacagaaaaggagtttatgcaacatgcccggaaagcaggattggttattcctccagaaaaatcggaccgttccatacatctggcctgtacagctggtatatttgatgcctatgttcctcctgagggtgatgcacgcatatcatctctttcaaaggagggactgatagagagaactgaacgaatgaagaagactatggcatcacaagtgtcaatccggaggataaaagactatgatgccaactttaaaataaaggacttccctgaaaaagctaaggatatctttattgaagctcacctttgtctaaataaactctggccatctatgaccggtttggccggttgatgtatggacaggaagatgtacccaaggatgtcctggagtatgttgtattcgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatgacttctagggtgaagcctgggtgatgaggctgctggaagctttgaagtctcccattcccctcatgctataaaaagaactacctttgttctctcccatcctgctcaggtcttttcagcagtctcatcatcagcaaccatgactgatgactgggccctagcaggtggcaggtataacatggccatggacactcttcttttttaaattttatgtctagcttctgagtctagatgaaagacagtatgtttcagagaacattggatatcagtttttcccacagcagggactgtgagagacaaccagcagcatcctctttgtaatcacagggcagggatcagagtttgaaatgaaatgttgtcagggtgttggaaaaattttggtgagttctgcacatttcccctggttcaggctgggcatggaccagccttcagatggcagaagtggaagatgagcctacttgtgagcgatgtgactttaaggaaatgaagactggggaagaataattagtgtttataagacatttaagaggccctttttcatatactgactcactgatgaatcagcatttgcattttatggaaaaatataaatccaaagaaataatttatccctt

SEQ ID NO: 21670 - DNA, 601 bp, Homo sapiens
agctagagcccaggaggtcaaggctgcagtgaaccgtgatcgtgccatcgcactccaggctagcgatctgcctcaaaaaataataaagaatagtattctgcccatttcagtattgagttggtgtttccccatcaccatcagtttttgaaacttgctttgatcaactcagtatccgtaggagttagcatagtcctgtactgtgggaagttctaaaggaaagcctttagtaaatgtgatgttaataaaggttgctaactgtcttctatttagagacacccataagtattaaggtcctaatgcattttttccctgtgatattgttttataattgttcctgaagcattctttggatattccctctctatagtgctttgcttagagtttgtaaaagatagtagatcttttttctaggttcctaacctttcctttaccttccagccagttctggtgactcagtccgcagctatagttccagtaagaactaaaaaacgtttcacacctcctatttatcaacctaaatttaaaacagaaaaggagtttatgcaacatgcccggaaagcaggattggttattcctccagaaaaatcggaccgttccatac

SEQ ID NO: 21671 - DNA, 444 bp, Homo sapiens
gacataggcatgggcgaaaacttcatgactaaaacaccaaaagcaatggcaacaaaagccatgatgtccacaaatgatcttaacttaggtttttagaaaatttcctcatcaccgtctagtttcctaaggatgcaatactatcttgaaagacgactattggccgggcgcggtggctcatgcctgttatcccagcactttgggaggccgaggtgggtggatcatgaggtcaggagatcgagacctacctggctaacatggtgaaaccccgtctctactaaaaatacaaaaaattagccaagcgtggtgccaggcacgtgtagtcccagatacttgggaggctgaagcaagagaatggcgtgaacccaggaggtggagcttgcagtgagcctagattgcgccactgcactccagcctgggcgacagagtgagactcagtctcaaaaa

SEQ ID NO: 21672 - DNA, 275 bp, Homo sapiens
aacattccagttagtaaagaactattgaacataggcaaggcagatacagagaaaagggaacagacacacgagacatttaaactgacccacaaacacagcactaccaatttgtgagtgcttgatgcgggccaggcaccatattatgtaatttgcatacattatttcattaatcctttcagcttcctttgaagtaggaacttacatcagatattgtctatgggtacttgagtccacacctgactttctatctgtaatcttccctgtattgcccaggt

SEQ ID NO: 21673 - DNA, 430 bp, Homo sapiens
ccaggcaggcaggagacagcatgcatgcagccagcgcttagcgatgtcccttactggtgccagggctgtcaccaggctaatgctctagggcaagattttacatctagaactaagatgaacaagacctggtgtggggtgtgtgaggccccagagcgatgcccttgacaggtcacccagcctggagctcaggagaagctatgtccagctgtcacacatgatgcttgctgcctgcagcaggggactgcaggaggggacactggctgctgagactggggcccaggcaggagctgctcagctccctcctgtttttggggaacaattccctaagcttggaagcaagagaaaaccaatctcaaaggaaaagactgacagatttcagcatgtacaaactggaaatttgccagacacgaaaagacctaatggtggttta

SEQ ID NO: 21674 - DNA, 385 bp, Homo sapiens
atatctgtgttctaactataactttttaattctaccaataagttacatgtgctttcccccacttttcttcaacctaaattatataaccagtaatgatatatcaacatgaacaagatagtgaatatttaaagcagactgacatgtttttgtgtagtcaccatgtgccataataattttgaaactgttcttctccgctatttgtactcgtttctttttatcttgccgattgactttatagttaaaatttttacctcttctttctatgtgacaatcaactgcagttagtaccctatctgtaatattacagggatttttgtccttatttatgatactataataaattataagccaacaaactgtataattctgttgtattgaatatttt

SEQ ID NO: 21675 - DNA, 121 bp, Homo sapiens
catttgttttgcttgtgaatcttttatgaaaaaaagtgtctggagattaaaggattagtgagttcttaagaagctgggcagctgctaaagcatctgaatattcttcctaaagatggttgaa

SEQ ID NO: 21676 - DNA, 362 bp, Homo sapiens
cctttgagttccaaattgtagactgaacaccttgttcaaggttgagaatcttatttcagttcttagaagagatttctaggaatgccagaaatactttactcttattctgtggttgtcaggtccattactttcagatcaagatctcatctcttggaatactgtgtaccgcagaaacagtatcgcattgctcagtctggcacactttaggtttggctctcccactccctggccccttccctgatgtgatgccctttgaatgggctcctcagaggcatgtgctttggtgccacaataaggtaaccaggactgtttattaagcttatgcattttttcaagtgcaggcagccccccactaataagtt

SEQ ID NO: 21677 - DNA, 493 bp, Homo sapiens
gcaggaaatccaggtgcaaatcccaccctataagtcttagttttcccatttgtaaagtgaagataaaaaacactttgtgcattaggttgctttggagattgaattagctaaatgcttagtataatcccaaggcatggaacatacttatgtgctcaataagtgacacatatgattcatatatatgtaacagtatctaatttaaaaacataataggccgggcgtggtggcttacgcctgtaatcccagcactttgggagaccgaggcgggtggatcacaaaatcaggagcttgagaccaacctggccaacatgatgaaaccccgtctctactaaaaatacaaaaattagctggacatggtggcgggtgcctgtaatcccagctactcgggaggctgcggcaggagaatcgcttgaacccgggaggcagaggttgcagtgagccgagattgtgccactgcactccactgtgggtgacagagtgagactccgtctca

SEQ ID NO: 21678 - DNA, 353 bp, Homo sapiens
tttatagcagcatgagaatggactaatacagttttcagcaaaggcaagaccagcctcatcagaggagtaaacaggctgcttctgtaggcatgggacattcagtagatttcgggagcacaggataccatttttatagccctactctttttcagtcgctgccctaacttccacaatcagagatcaagtaaaatcattaattctactttggtcataattcagcattctactgaatcagattctgcttctaatttttgatgtgttagacttgtggctttacgggattttttagggcaatcatggaaaatccctggttttctgaagtgctgagttaaaaatttgaaatcttgggccta

SEQ ID NO: 21679 - DNA, 691 bp, Homo sapiens
cacgcccttaaccccaacactttgggaggtgaggcgggaggatcgcttgaggccaggagtttgggaccagcctgggcaacagagagagaccccatctctacaaataaacagatagctgggtgcaatggcacatgcctatagttccagctactgagaagaccaaagtgggagtatcgcttgagcccaggagtttgaaggtgcagtgagttatgatcacaccactgcactgttgccttggcaacagagcaagaccctatctctaaaaaaacaaagacaaaacaattgtactaactgttgatgacaggtgtactttcttccagatgcctctacgcctataattacctatggctacgtgaacactcttcccctgcagtctgatcgttttttgttggttaaaagtataattgccggctgggtgcggtggctcacgcctgtaatcccagcacttcgggaggctgagacgggtggatcacctgaggtcaggagtttgagaccagcctggccaacatgatgaaaccttgtctgtactaaaaatacaaaaattagccaggtgtggtggcgcatgcctgtagtcccagctactcgggaggctgaggcaggagaattgcttgaacccgggaggcagaggttgcagtgagccaagatcacgccactgcactccagcctgggcgacagagtgagactccatctc

SEQ ID NO: 21680 - DNA, 360 bp, Homo sapiens
tcatttcccattccccccagccccatccccatcccctggcaaccactaatctattttctattatctattgatttgtctattctgtatatttcatagaagtggcattatataacatgtggcctttgtatctggcttctttgacttaatatgatgttccatccatgttgtagcatgtatgtagagacagggtctcactctgtcacccaggttggagtgcagtggtgtgatcataattcactgcagcctcaaactcccatgctcaagcggctctcttgcttcagctgccagagtagctggaattacaggtgcatgccaccatgcccagctaattttttaaatgttttgtagagttggggtctc

SEQ ID NO: 21681 - DNA, 357 bp, Homo sapiens
ttctttttttttcttttttaataaaaaaagaattgttcttttaatttctttaacgctaacaaaactccaaagaaatgaggaaagaagacatctgctgcttgagaaagacttccatttcctaagtcccagttcctttttactccgggaagatctaattttatctaggcttcccgaatgcagtcacacagtggggactgctgagattggggctctggcagggggattacaagcagagcttttgttttgatctcactgcttaggttaatgcatcatgactcctccacgggctgtttcgcgggacgctgctatcccactgtctgctagggaagaaaatgtctcgtgaaaataaatcaaatg

SEQ ID NO: 21682 - DNA, 211 bp, Homo sapiens
ggaggtgcagacacaccttctgcaaaggcttgtagttaaataaggcagcacgtggaatggacagactggagacagtccttacctcatgtggaacctaggacaggtaaggccctgtcctccaccccagagctcactttgtctgagagcagctgaccagcagtggaagacatttgctcagcgatatattagttatggctgcaaaagcccaaga

SEQ ID NO: 21683 - DNA, 2377 bp, Homo sapiens
  misc_feature (939)..(939): n is a, c, g, or t
cttttctcttgttgagtgcaaatggagaacagctgctcacgctcgtcgtctgacatcagctatttctcaggatgaccctgcgagacaggccagggtcattagacccaatttggttctcagcaaatatgtgtttattcctgcatgcgtgggccacaggctggtttcttgggtgcaatgaatagctgcaggtttattagggtgtctttttagatggatgtatgtttcccgatgtctatagaacactccggaccccggagagtgaagactctgcctgtcggacttgctttgagaagatccttctccacctccccatggcagaagttgcttcacagaggggaacagttttatggatgtggctgagaccttaaacttgaggcaacccatctgaggtggcatccagaggagactggctggcccctccttcaccttggatgtagtgctgtttctaggatctcttttcaatcagcaaaacaggggatgttccaagagggtgtggattccctgccatcccacatggtcaagtggaggggacgggaaaaagctatgaagggtttgtgaccacacagactctcctggccccctgtccttttggaaagaagacagggatgaaatataatcaagcaattaaccacccccatcatcaccaagaacaacagtatcaacaagaagaacagggacaacaaaacccacggatgaaacattcctttctcagctcagatcttatctggtgcgttctctctctgctctgtcttggtgtgtggtttagagaaacatggacaacgctgtttggaagaacaggtgagcgagggtggggaatttcagaggcctgggcccaccgcctccaccccttccccagtttaacctttgacaggatcttcacctctctctgatcagcattgcttcttgttcaaaggcctcagccacccagctgtgtccctntccccagaaagcaagggcagatggcagtgggtctgttgatgagagaactttaagggcccaatcagtccctgggcaccccctcctgggctcgttttctccaggaggctgcattctgatccataaaccttctcctcggggtttagggtcgagctgttcctgatgtttatcggagactgggatcaaagctatccaggtcataaatctctctctgtggctgttgggccccagggcagctgaagagggttgacagccctttggacctcaaaggaaaaaatgtgctctactccacccactcccagctctgccaagaagctgtcctctgagaagccatggctgggccgttccattctggggagctgctgaaaagagctgggaggccgagaagaacttgcgtgtgctgggggagaggaagcctggccttgagggaggggtgcaggtgtggctcctctgtgtgtgggggctgggggaccttgtgtgccttttccttgtggctgtgaaatgctttatgagtacttccataggaggatggacagggagtcggggagataaactcagccacaaggccccagggcctcaggaaacttgcacccaaccctctcattttacagaagaaaactgtgcctggaaggttgaagggtttgttcccagtcacacaaccagggatccttaggacagccagaccaggaaaccatttccaaactgccaagccatggcagagtatcaagacctcaggaaccatcgagacaccatggaagcattgggaaaagcctccttagcttttgaagctcctcattgttcttgagtgtgcatggagcccatgactgcggggttttgtagacacctcagggattacatgactggtacccctgacaaagtcaaggctgctggacaaaatgagtccgaggatttcaggggcagctgggcgcaggagctggtgggctgttgggagtgcccctttactgggcaggcttccttcctcctggtgatggggggttcctcagcacaaaagtgaaggggtggaggggctggaggagcaggaatctctcttgttgataggtatgaggccttgaagtccttttctttgtcccaggattcatggacgcttcggggctgatctttgagttttcaagcatggggtgcagagacgtttaggtaaactcttaccgtcctctctcttcgtcagggcttcccaggaatcaacaatgcccaagaaggaagggattgtagaaatagcttaaccctttcatttaccaacgtggaaattgaagcccagggaagggaagggaccggtcgtggaagggagagccatcagcagaaagagaccctgagatcttcgcctgggattcccaggaagtccagcccgagctgattcacagaataaatgcatgcaaaccttgctatcaataaattacacatgcacttacgtaaaacacataaa

SEQ ID NO: 21684 - DNA, 1053 bp, Homo sapiens
cttttctcttgttgagtgcaaatggagaacagctgctcacgctcgtcgtctgacatcagctatttctcaggatgaccctgcgagacaggccagggtcattagacccaatttggttctcagcaaatatgtgtttattcctgcatgcgtgggccacaggctggtttcttgggtgcaatgaatagctgcaggtttattagggtgtctttttagatggatgtatgtttcccgatgtctatagaacactccggaccccggagagtgaagactctgcctgtcggacttgctttgagaagatccttctccacctccccatggcagaagttgcttcacagaggggaacagttttatggatgtggctgagaccttaaacttgaggcaacccatctgaggtggcatccagaggagactggctggcccctccttcaccttggatgtagtgctgtttctaggatctcttttcaatcagcaaaacaggggatgttccaagagggtgtggattccctgccatcccacatggtcaagtggaggggacgggaaaaagctatgaagggtttgtgaccacacagactctcctggccccctgtccttttggaaagaagacagggatgaaatataatcaagcaattaaccacccccatcatcaccaagaacaacagtatcaacaagaagaacagggacaacaaaacccacggatgaaacattcctttctcagctcagatcttatctggtgcgttctctctctgctctgtcttggtgtgtggtttagagaaacatggacaacgctgtttggaagaacagggcttcccaggaatcaacaatgcccaagaaggaagggattgtagaaatagcttaaccctttcatttaccaacgtggaaattgaagcccagggaagggaagggaccggtcgtggaagggagagccatcagcagaaagagaccctgagatcttcgcctgggattcccaggaagtccagcccgagctgattcacagaataaatgcatgcaaaccttgctatcaataaattacacatgcacttacgtaaaacacataaa

SEQ ID NO: 21685 - DNA, 1904 bp, Homo sapiens
  misc_feature (939)..(939): n is a, c, g, or t
cttttctcttgttgagtgcaaatggagaacagctgctcacgctcgtcgtctgacatcagctatttctcaggatgaccctgcgagacaggccagggtcattagacccaatttggttctcagcaaatatgtgtttattcctgcatgcgtgggccacaggctggtttcttgggtgcaatgaatagctgcaggtttattagggtgtctttttagatggatgtatgtttcccgatgtctatagaacactccggaccccggagagtgaagactctgcctgtcggacttgctttgagaagatccttctccacctccccatggcagaagttgcttcacagaggggaacagttttatggatgtggctgagaccttaaacttgaggcaacccatctgaggtggcatccagaggagactggctggcccctccttcaccttggatgtagtgctgtttctaggatctcttttcaatcagcaaaacaggggatgttccaagagggtgtggattccctgccatcccacatggtcaagtggaggggacgggaaaaagctatgaagggtttgtgaccacacagactctcctggccccctgtccttttggaaagaagacagggatgaaatataatcaagcaattaaccacccccatcatcaccaagaacaacagtatcaacaagaagaacagggacaacaaaacccacggatgaaacattcctttctcagctcagatcttatctggtgcgttctctctctgctctgtcttggtgtgtggtttagagaaacatggacaacgctgtttggaagaacaggtgagcgagggtggggaatttcagaggcctgggcccaccgcctccaccccttccccagtttaacctttgacaggatcttcacctctctctgatcagcattgcttcttgttcaaaggcctcagccacccagctgtgtccctntccccagaaagcaagggcagatggcagtgggtctgttgatgagagaactttaagggcccaatcagtccctgggcaccccctcctgggctcgttttctccaggaggctgcattctgatccataaaccttctcctcggggtttagggtcgagctgttcctgatgtttatcggagactgggatcaaagctatccaggtcataaatctctctctgtggctgttgggccccagggcagctgaagagggttgacagccctttggacctcaaaggaaaaaatgtgctctactccacccactcccagctctgccaagaagctgtcctctgagaagccatggctgggccgttccattctggggagctgctgaaaagagctgggaggccgagaagaacttgcgtgtgctgggggagaggaagcctggccttgagggaggggtgcaggtgtggctcctctgtgtgtgggggctgggggaccttgtgtgccttttccttgtggctgtgaaatgctttatgagtacttccataggaggatggacagggagtcggggagataaactcagccacaaggccccagggcctcaggaaacttgcacccaaccctctcattttacagaagaaaactgtgcctggaaggttgaagggtttgttcccagtcacacaaccagggatccttaggacagccagaccaggaaaccatttccaaactgccaagccatggcagagtatcaagacctcaggaaccatcgagacaccatggaagcattgggaaaagcctccttagcttttgaagctcctcattgttcttgagtgtgcatggaccggtcgtggaagggagagccatcagcagaaagagaccctgagatcttcgcctgggattcccaggaagtccagcccgagctgattcacagaataaatgcatgcaaaccttgctatcaataaattacacatgcacttacgtaaaacacataaa

SEQ ID NO: 21686 - DNA, 1630 bp, Homo sapiens
  misc_feature (939)..(939): n is a, c, g, or t
cttttctcttgttgagtgcaaatggagaacagctgctcacgctcgtcgtctgacatcagctatttctcaggatgaccctgcgagacaggccagggtcattagacccaatttggttctcagcaaatatgtgtttattcctgcatgcgtgggccacaggctggtttcttgggtgcaatgaatagctgcaggtttattagggtgtctttttagatggatgtatgtttcccgatgtctatagaacactccggaccccggagagtgaagactctgcctgtcggacttgctttgagaagatccttctccacctccccatggcagaagttgcttcacagaggggaacagttttatggatgtggctgagaccttaaacttgaggcaacccatctgaggtggcatccagaggagactggctggcccctccttcaccttggatgtagtgctgtttctaggatctcttttcaatcagcaaaacaggggatgttccaagagggtgtggattccctgccatcccacatggtcaagtggaggggacgggaaaaagctatgaagggtttgtgaccacacagactctcctggccccctgtccttttggaaagaagacagggatgaaatataatcaagcaattaaccacccccatcatcaccaagaacaacagtatcaacaagaagaacagggacaacaaaacccacggatgaaacattcctttctcagctcagatcttatctggtgcgttctctctctgctctgtcttggtgtgtggtttagagaaacatggacaacgctgtttggaagaacaggtgagcgagggtggggaatttcagaggcctgggcccaccgcctccaccccttccccagtttaacctttgacaggatcttcacctctctctgatcagcattgcttcttgttcaaaggcctcagccacccagctgtgtccctntccccagaaagcaagggcagatggcagtgggtctgttgatgagagaactttaagggcccaatcagtccctgggcaccccctcctgggctcgttttctccaggaggctgcattctgatccataaaccttctcctcggggtttagggtcgagctgttcctgatgtttatcggagactgggatcaaagctatccaggtcataaatctctctctgtggctgttgggccccagggcagctgaagagggttgacagccctttggacctcaaaggaaaaaatgtgctctactccacccactcccagctctgccaagaagctgtcctctgagaagccatggctgggccgttccattctggggagctgctgaaaagagctgggaggccgagaagaacttgcgtgtgctgggggagaggaagcctggccttgagggaggggtgcagggcttcccaggaatcaacaatgcccaagaaggaagggattgtagaaatagcttaaccctttcatttaccaacgtggaaattgaagcccagggaagggaagggaccggtcgtggaagggagagccatcagcagaaagagaccctgagatcttcgcctgggattcccaggaagtccagcccgagctgattcacagaataaatgcatgcaaaccttgctatcaataaattacacatgcacttacgtaaaacacataaa

SEQ ID NO: 21687 - DNA, 673 bp, Homo sapiens
atgcgtgtgcatgtgtatgaagtgggctagggatttttaatcttagagcgaaagctataatcactgtgcctgtcataaggtgatggcatggctaggtttatagatagttgggtggttggtgtaaatgagtgaggcaggagtcgataataaatagtatggggataaggggtgtaggtgtgccttgtggtaaagaagtgggcaggcttccttcctcctggtgatggggggttcctcagcacaaaagtgaaggggtggaggggctggaggagcaggaatctctcttgttgataggtatgaggccttgaagtccttttctttgtcccaggattcatggacgcttcggggctgatctttgagttttcaagcatggggtgcagagacgtttaggtaaactcttaccgtcctctctcttcgtcagggcttcccaggaatcaacaatgcccaagaaggaagggattgtagaaatagcttaaccctttcatttaccaacgtggaaattgaagcccagggaagggaagggaccggtcgtggaagggagagccatcagcagaaagagaccctgagatcttcgcctgggattcccaggaagtccagcccgagctgattcacagaataaatgcatgcaaaccttgctatcaataaattacacatgcacttacgtaaaacacataaa

SEQ ID NO: 21688 - DNA, 724 bp, Homo sapiens
cttttctcttgttgagtgcaaatggagaacagctgctcacgctcgtcgtctgacatcagctatttctcaggatgaccctgcgagacaggccagggtcattagacccaatttggttctcagcaaatatgtgtttattcgctgcattctgatccataaaccttctcctcggggtttagggtcgagctgttcctgatgtttatcggagactgggatcaaagctatccaggtcataaatctctctctgtggctgttgggccccagggcagctgaagagggttgacagccctttggacctcaaaggaaaaaatgtgctctactccacccactcccagctctgccaagaagctgtcctctgagaagccatggctgggccgttccattctggggagctgctgaaaagagctgggaggccgagaagaacttgcgtgtgctgggggagaggaagcctggccttgagggaggggtgcagggcttcccaggaatcaacaatgcccaagaaggaagggattgtagaaatagcttaaccctttcatttaccaacgtggaaattgaagcccagggaagggaagggaccggtcgtggaagggagagccatcagcagaaagagaccctgagatcttcgcctgggattcccaggaagtccagcccgagctgattcacagaataaatgcatgcaaaccttgctatcaataaattacacatgcacttacgtaaaacacataaa

SEQ ID NO: 21689 - DNA, 353 bp, Homo sapiens
agttgcccttcccgtggtcaccacagcggcttcattgctgccagtgtgaatgttggtcctagcaagactggaaagttgagagtaattcacgtccttgtcgtgatccgaagaatgttgtccacatcaatccctaggcctttgcttcctggctggacatggtgtgtggttgggagtgtccgctaagcagcactcttttagagcagaaggcatgtgcctcaacgatttcatttccctccttgtaaactggaacagcagattgttgccaaatttagcaccttgaaatgggtaagcgttggttgtttagggtgtctcagctggaaaaaggccctccagtgtgggcggtagtgagcttt

SEQ ID NO: 21690 - DNA, 701 bp, Homo sapiens
gatcgagctcgtgtaccgggtgggagtacggaatcaacagaagcttctggtgcccaaagaatcttatgtgaaactcctgattggtccgaagggccacgtgatctcccagatagcacaggaggcaggccatgacctcatggacatcttcctctgcgatgttgacatccgcctctctgtgaagctcctcaagtgaccaccctctactgaccctcccagggcattccagctcaagctgctggcaggaactgaccagttctttccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcttctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttctca

SEQ ID NO: 21691 - DNA, 1855 bp, Homo sapiens
cctggtcggttcccgcagtgccttgcggctgtaatggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccctggaccacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggagccccgaatgcagggaagtcaacactctccaaccagctactgggccgaaaggtgttccctgtttccaggaaggtgcatactactcgctgccaagctctgggggtcatcacagagaaggagacccaggtgattctacttgacacacctggcattatcagtcctggtaaacagaagaggcatcacctggagctctctttgttggaagatccatggaagagcatggaatctgctgatcttgttgtggttcttgtggatgtctcagacaagtggacacggaaccagctcagcccccagttgctcaggtgcttgaccaagtactcccagatccctagtgtcctggtcatgaacaaggtagattgtttgaagcagaagtcagttctcctggagctcacggcagccctcactgaaggtgtggtcaatggcaaaaagctcaagatgaggcaggccttccactcacaccctggcacccattgccccagcccagcagttaaggacccaaacacacaatctgtgggaaatcctcagaggattggctggccccacttcaaggagatcttcatgttgtcagccctaagccaggaggatgtgaaaacactaaagcaataccttctgacacaggcccagccagggccctgggagtaccacagtgcagtcctcactagccagacaccagaagagatctgtgccaacattatccgagagaagctcctagaacacctgccccaggaggtgccttacaatgtacagcagaagacagcagtgtgggaggaaggaccaggtggggagctggttatccaacagaagcttctggtgcccaaagaatcttatgtgaaactcctgattggtccgaagggccacgtgatctcccagatagcacaggaggcaggccatgacctcatggacatcttcctctgcgatgttgacatccgcctctctgtgaagctcctcaagtgaccaccctctactgaccctcccagggcattccagctcaagctgctggcaggaactgaccagttctttccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcttctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttctca

SEQ ID NO: 21692 - DNA, 1872 bp, Homo sapiens
aggatccttaattttattaatcccccccccccccggcagttgcggctgtaatggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccctggaccacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggagccccgaatgcagggaagtcaacactctccaaccagctactgggccgaaaggtgttccctgtttccaggaaggtgcatactactcgctgccaagctctgggggtcatcacagagaaggagacccaggtgattctacttgacacacctggcattatcagtcctggtaaacagaagaggcatcacctggagctctctttgttggaagatccatggaagagcatggaatctgctgatcttgttgtggttcttgtggatgtctcagacaagtggacacggaaccagctcagcccccagttgctcaggtgcttgaccaagtactcccagatccctagtgtcctggtcatgaacaaggtagattgtttgaagcagaagtcagttctcctggagctcacggcagccctcactgaaggtgtggtcaatggcaaaaagctcaagatgaggcaggccttccactcacaccctggcacccattgccccagcccagcagttaaggacccaaacacacaatctgtgggaaatcctcagaggattggctggccccacttcaaggagatcttcatgttgtcagccctaagccaggaggatgtgaaaacactaaagcaataccttctgacacaggcccagccagggccctgggagtaccacagtgcagtcctcactagccagacaccagaagagatctgtgccaacattatccgagagaagctcctagaacacctgccccaggaggtgccttacaatgtacagcagaagacagcagtgtgggaggaaggaccaggtggggagctggttatccaacagaagcttctggtgcccaaagaatcttatgtgaaactcctgattggtccgaagggccacgtgatctcccagatagcacaggaggcaggccatgacctcatggacatcttcctctgcgatgttgacatccgcctctctgtgaagctcctcaagtgaccaccctctactgaccctcccagggcattccagctcaagctgctggcaggaactgaccagttctttccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcttctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttctca

SEQ ID NO: 21693 - DNA, 1813 bp, Homo sapiens
cctggtcggttcccgcagtgccttgcggctgtaatggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccctggaccacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggagccccgaatgcagggaagtcaacactctccaaccagctactgggccgaaaggtgttccctgtttccaggaaggtgcatactactcgctgccaagctctgggggtcatcacagagaaggagacccaggtgattctacttgacacacctggcattatcagtcctggtaaacagaagaggcatcacctggagctctctttgttggaagatccatggaagagcatggaatctgctgatcttgttgtggttcttgtggatgtctcagacaagtggacacggaaccagctcagcccccagttgctcaggtgcttgaccaagtactcccagatccctagtgtcctggtcatgaacaaggtagattgtttgaagcagaagtcagttctcctggagctcacggcagccctcactgaaggtgtggtcaatggcaaaaagctcaagatgaggcaggccttccactcacaccctggcacccattgccccagcccagcagttaaggacccaaacacacaatctgtgggaaatcctcagaggattggctggccccacttcaaggagatcttcatgttgtcagccctaagccaggaggatgtgaaaacactaaagcacagtgcagtcctcactagccagacaccagaagagatctgtgccaacattatccgagagaagctcctagaacacctgccccaggaggtgccttacaatgtacagcagaagacagcagtgtgggaggaaggaccaggtggggagctggttatccaacagaagcttctggtgcccaaagaatcttatgtgaaactcctgattggtccgaagggccacgtgatctcccagatagcacaggaggcaggccatgacctcatggacatcttcctctgcgatgttgacatccgcctctctgtgaagctcctcaagtgaccaccctctactgaccctcccagggcattccagctcaagctgctggcaggaactgaccagttctttccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcttctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttctca

SEQ ID NO: 21694 - DNA, 1817 bp, Homo sapiens
taggctagtacaggccggtggtaatcggccgagggagagagaactagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccctggaccacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggagccccgaatgcagggaagtcaacactctccaaccagctactgggccgaaaggtgttccctgtttccaggaaggtgcatactactcgctgccaagctctgggggtcatcacagagaaggagacccaggtgattctacttgacacacctggcattatcagtcctggtaaacagaagaggcatcacctggagctctctttgttggaagatccatggaagagcatggaatctgctgatcttgttgtggttcttgtggatgtctcagacaagtggacacggaaccagctcagcccccagttgctcaggtgcttgaccaagtactcccagatccctagtgtcctggtcatgaacaaggtagattgtttgaagcagaagtcagttctcctggagctcacggcagccctcactgaaggtgtggtcaatggcaaaaagctcaagatgaggcaggccttccactcacaccctggcacccattgccccagcccagcagttaaggacccaaacacacaatctgtgggaaatcctcagaggattggctggccccacttcaaggagatcttcatgttgtcagccctaagccaggaggatgtgaaaacactaaagcaataccttctgacacaggcccagccagggccctgggagtaccacagtgcagtcctcactagccagacaccagaagagatctgtgccaacattatccgagagaagctcctagaacacctgccccaggaggtgccttacaatgtacagcagaagacagcagtgtgggaggaaggaccaggtggggagctggttatccaacagaagcttctggtgcccaaagaatcttatgtgaaactcctgattggtccgaagggccacgtgatctcccagatagcacaggaggcaggccatgacctcatggacatcttcctctgcgatgttgacatccgcctctctgtgaagctcctcaagtgaccaccctctactgaccctcccagggcattccagctcaagctgctggcaggaactgaccagttctttccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcttctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttctca

SEQ ID NO: 21695 - DNA, 1961 bp, Homo sapiens
cctggtcggttcccgcagtgccttgcggctgtaatggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccctggaccacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggagccccgaatgcagggaagtcaacactctccaaccagctactgggccgaaaggtgttccctgtttccaggaaggtgcatactactcgctgccaagctctgggggtcatcacagagaaggagacccaggtgggtgggtacctacaaagggagtccttgaaacaggacagagggtgaagctaagagggtctcccttaccatcagccttgaagaaaatgatggtcacattcatttatgtattctacttgacacacctggcattatcagtcctggtaaacagaagaggcatcacctggagctctctttgttggaagatccatggaagagcatggaatctgctgatcttgttgtggttcttgtggatgtctcagacaagtggacacggaaccagctcagcccccagttgctcaggtgcttgaccaagtactcccagatccctagtgtcctggtcatgaacaaggtagattgtttgaagcagaagtcagttctcctggagctcacggcagccctcactgaaggtgtggtcaatggcaaaaagctcaagatgaggcaggccttccactcacaccctggcacccattgccccagcccagcagttaaggacccaaacacacaatctgtgggaaatcctcagaggattggctggccccacttcaaggagatcttcatgttgtcagccctaagccaggaggatgtgaaaacactaaagcaataccttctgacacaggcccagccagggccctgggagtaccacagtgcagtcctcactagccagacaccagaagagatctgtgccaacattatccgagagaagctcctagaacacctgccccaggaggtgccttacaatgtacagcagaagacagcagtgtgggaggaaggaccaggtggggagctggttatccaacagaagcttctggtgcccaaagaatcttatgtgaaactcctgattggtccgaagggccacgtgatctcccagatagcacaggaggcaggccatgacctcatggacatcttcctctgcgatgttgacatccgcctctctgtgaagctcctcaagtgaccaccctctactgaccctcccagggcattccagctcaagctgctggcaggaactgaccagttctttccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcttctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttctca

SEQ ID NO: 21696 - DNA, 1398 bp, Homo sapiens
ggctgacctgaggacctcaaaagtgcctcttctatatctacatcacagagaaggagacccaggtgattctacttgacacacctggcattatcagtcctggtaaacagaagaggcatcacctggagctctctttgttggaagatccatggaagagcatggaatctgctgatcttgttgtggttcttgtggatgtctcagacaagtggacacggaaccagctcagcccccagttgctcaggtgcttgaccaagtactcccagatccctagtgtcctggtcatgaacaaggtagattgtttgaagcagaagtcagttctcctggagctcacggcagccctcactgaaggtgtggtcaatggcaaaaagctcaagatgaggcaggccttccactcacaccctggcacccattgccccagcccagcagttaaggacccaaacacacaatctgtgggaaatcctcagaggattggctggccccacttcaaggagatcttcatgttgtcagccctaagccaggaggatgtgaaaacactaaagcaataccttctgacacaggcccagccagggccctgggagtaccacagtgcagtcctcactagccagacaccagaagagatctgtgccaacattatccgagagaagctcctagaacacctgccccaggaggtgccttacaatgtacagcagaagacagcagtgtgggaggaaggaccaggtggggagctggttatccaacagaagcttctggtgcccaaagaatcttatgtgaaactcctgattggtccgaagggccacgtgatctcccagatagcacaggaggcaggccatgacctcatggacatcttcctctgcgatgttgacatccgcctctctgtgaagctcctcaagtgaccaccctctactgaccctcccagggcattccagctcaagctgctggcaggaactgaccagttctttccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcttctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttctca

SEQ ID NO: 21697 - DNA, 1606 bp, Homo sapiens
cctggtcggttcccgcagtgccttgcggctgtaatggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccctggaccacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggagccccgaatgcagggaagtcaacactctccaaccagctactgggccgaaaggtgttccctgtttccaggaaggtgcatactactcgctgccaagctctgggggtcatcacagagaaggagacccaggtgattctacttgacacacctggcattatcagtcctggtaaacagaagaggcatcacctggagctctctttgttggaagatccatggaagagcatggaatctgctgatcttgttgtggttcttgtggatgtctcagacaagtggacacggaaccagctcagcccccagttgctcaggtgcttgaccaagtactcccagatccctagtgtcctggtcatgaacaagcaataccttctgacacaggcccagccagggccctgggagtaccacagtgcagtcctcactagccagacaccagaagagatctgtgccaacattatccgagagaagctcctagaacacctgccccaggaggtgccttacaatgtacagcagaagacagcagtgtgggaggaaggaccaggtggggagctggttatccaacagaagcttctggtgcccaaagaatcttatgtgaaactcctgattggtccgaagggccacgtgatctcccagatagcacaggaggcaggccatgacctcatggacatcttcctctgcgatgttgacatccgcctctctgtgaagctcctcaagtgaccaccctctactgaccctcccagggcattccagctcaagctgctggcaggaactgaccagttctttccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcttctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttctca

SEQ ID NO: 21698 - DNA, 1871 bp, Homo sapiens
gcaggagttctctcggttgactactatcgctgtcatgtctggtcgtggcaagcaaggaggcaaggcccgcgccaaggccaagtcgcgctcgtcccgcgctggccttcagttcccggtagggcgagtgcatcgcttgctgcgctaatagcgcaactacgcggagcgagtgggggccggcgcgccctgtctacatggctgctggtcctcgagtatctgacctgtcgagatcctggagctggcgggctaactgctggctcgggacaacaagaagacgcgcatcatccctcgtcagctccagctggccatccgcaacgacgaggaactgaacaagctgctgggcaatagtcagccatctgcccaggggtcggcgtctttgcctacacatccaggccgtactgctccctaaagaacgaccggagatgtcaccacaatggcaagagggcaagtgaggctgacgtccggcccaagtgggcccagcccggcccgcgtctcgcaaggggcacctgtgaactcaagaaggctcttttcagtagccacccacgttttcgaattaaagagttgttaatgctggcaaaggcatcacctggaagctacatacataaagtaggcaagatccatggaacgagcatggaatctgctgaatctagttgtggttcttgtggatgtctcagacaagtggacacggaaccagctcagcccccagttgctcaggtgcttgaccaagtactcccagatccctagtgtcctggtcatgaacaaggtagattgtttgaagcagaagtcagttctcctggagctcacggcagccctcactgaaggtgtggtcaatggcaaaaagctcaagatgaggcaggccttccactcacaccctggcacccattgccccagcccagcagttaaggacccaaacacacaatctgtgggaaatcctcagaggattggctggccccacttcaaggagatcttcatgttgtcagccctaagccaggaggatgtgaaaacactaaagcaataccttctgacacaggcccagccagggccctgggagtaccacagtgcagtcctcactagccagacaccagaagagatctgtgccaacattatccgagagaagctcctagaacacctgccccaggaggtgccttacaatgtacagcagaagacagcagtgtgggaggaaggaccaggtggggagctggttatccaacagaagcttctggtgcccaaagaatcttatgtgaaactcctgattggtccgaagggccacgtgatctcccagatagcacaggaggcaggccatgacctcatggacatcttcctctgcgatgttgacatccgcctctctgtgaagctcctcaagtgaccaccctctactgaccctcccagggcattccagctcaagctgctggcaggaactgaccagttctttccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcttctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttctca

SEQ ID NO: 21699 - DNA, 1035 bp, Homo sapiens
cctggtcggttcccgcagtgccttgcggctgtaatggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccctggaccacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggagccccgaatgcagggaagtcaacactctccaaccagctactgggccgaaaggtgttccctgtttccaggaaggtgcatactactcgctgccaagctctgggggtcatcacagagaaggagacccaggtgattctacttgacacacctggcattatcagtcctggtaaacagaagaggcatcacctggagctctctttgttggaagatccatggaagagcatggaatctgctgatcttgttgtggttcttgtggatgtctcagacaagtggacacggaaccagctcagcccccagttgctcaggtgcttgaccaagtactcccagatccctagtgtcctggtcatgaacaaggtagattgtttgaagcagaagtcagttctcctggagctcacggcagccctcactgaaggtgtggtcaatggcaaaaagctcaagatgaggcaggccttccactcacacctgggccatgcccaccagagtaggcccaaccaactggggaacccaagatggggcccctcagggaatccgtgtgggctagcggggggtaccaagaacttgaggcccgggcgggaaccagggtctcgcgccaatggttcagcgaaccgggaatgaacaggggagggcggccctgaggacacacct

SEQ ID NO: 21700 - DNA, 1106 bp, Homo sapiens
tgctggggggagaaacctgacaatatgacagagcacccactgcccaagactcagccatagaagatgccgccccaccttctacttgggtagctgggctgggacgctgggacaggaccccgtcctccttcatgactcccactgctgcctctcctgggcatggctgttagctgttctgccttctgggtgagctggcactcttctccctgagaccaaagatttgacctgtcggtcttgatgtcaaggtccccaaagaccaggttaagtgacgacacctgtctgttcctgccctgttgcttccagccactgtgatgtttgaaatatgtgatagtacctggttgtgaaaaaaagacaatgaactgctagtgacattcctcaatgacctctcccaaaccccaagacagcagtgtgggaggaaggaccaggtggggagctggttatccaacagaagcttctggtgcccaaagaatcttatgtgaaactcctgattggtccgaagggccacgtgatctcccagatagcacaggaggcaggccatgacctcatggacatcttcctctgcgatgttgacatccgcctctctgtgaagctcctcaagtgaccaccctctactgaccctcccagggcattccagctcaagctgctggcaggaactgaccagttctttccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcttctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttctca

SEQ ID NO: 21701 - DNA, 654 bp, Homo sapiens
cctggtcggttcccgcagtgccttgcggctgtaatggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccctggaccacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggagccccgaatgcagggaagtcaacactctccaaccagctactgggccgaaaggtgttccctgtttccaggaaggtgcatactactcgctgccaagctctgggggtcatcacagagaaggagacccaggtgggtgggtacctacaaagggagtccttgaaacaggacagagggtgaagctaagagggtctcccttaccatcagccttgaagaaaatgatggtcacattcatttatgtagagggaatcgtgagagaggaaggat

SEQ ID NO: 21702 - DNA, 1884 bp, Homo sapiens
taaaaggcatagtgatacgagggccccgagcgcgtgttttaaatcggccgattgcggctgtaatggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccctggaccacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggagccccgaatgcagggaagtcaacactctccaaccagctactgggccgaaaggtgttccctgtttccaggaaggtgcatactactcgctgccaagctctgggggtcatcacagagaaggagacccaggtgattctacttgacacacctggcattatcagtcctggtaaacagaagaggcatcacctggagctctctttgttggaagatccatggaagagcatggaatctgctgatcttgttgtggttcttgtggatgtctcagacaagtggacacggaaccagctcagcccccagttgctcaggtgcttgaccaagtactcccagatccctagtgtcctggtcatgaacaaggtagattgtttgaagcagaagtcagttctcctggagctcacggcagccctcactgaaggtgtggtcaatggcaaaaagctcaagatgaggcaggccttccactcacaccctggcacccattgccccagcccagcagttaaggacccaaacacacaatctgtgggaaatcctcagaggattggctggccccacttcaaggagatcttcatgttgtcagccctaagccaggaggatgtgaaaacactaaagcaataccttctgacacaggcccagccagggccctgggagtaccacagtgcagtcctcactagccagacaccagaagagatctgtgccaacattatccgagagaagctcctagaacacctgccccaggaggtgccttacaatgtacagcagaagacagcagtgtgggaggaaggaccaggtggggagctggttatccaacagaagcttctggtgcccaaagaatcttatgtgaaactcctgattggtccgaagggccacgtgatctcccagatagcacaggaggcaggccatgacctcatggacatcttcctctgcgatgttgacatccgcctctctgtgaagctcctcaagtgaccaccctctactgaccctcccagggcattccagctcaagctgctggcaggaactgaccagttctttccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcttctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttctca

SEQ ID NO: 21703 - DNA, 1996 bp, Homo sapiens
cctggtcggttcccgcagtgccttgcggctgtaatggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccctggaccacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggagccccgaatgcagggaagtcaacactctccaaccagctactgggccgaaaggtgttccctgtttccaggaaggtgcatactactcgctgccaagctctgggggtcatcacagagaaggagacccaggtgattctacttgacacacctggcattatcagtcctggtaaacagaagaggcatcacctggagctctctttgttggaagatccatggaagagcatggaatctgctgatcttgttgtggttcttgtggatgtctcagacaagtggacacggaaccagctcagcccccagttgctcaggtgcttgaccaagtactcccagatccctagtgtcctggtcatgaacaaggtagattgtttgaagcagaagtcagttctcctggagctcacggcagccctcactgaaggtgtggtcaatggcaaaaagctcaagatgaggcaggccttccactcacaccctggcacccattgccccagcccagcagttaaggacccaaacacacaatctgtgggaaatcctcagaggattggctggccccacttcaaggagatcttcatgttgtcagccctaagccaggaggatgtgaaaacactaaagaggtcagttagtcttggccatagcctggcccttggtttctaccatatgaagacagccctcaaatttcctcctggaagcaaaagtgaggagaaaagtcctggttgggattaagatgcccatctattccctctgttcccacagcaataccttctgacacaggcccagccagggccctgggagtaccacagtgcagtcctcactagccagacaccagaagagatctgtgccaacattatccgagagaagctcctagaacacctgccccaggaggtgccttacaatgtacagcagaagacagcagtgtgggaggaaggaccaggtggggagctggttatccaacagaagcttctggtgcccaaagaatcttatgtgaaactcctgattggtccgaagggccacgtgatctcccagatagcacaggaggcaggccatgacctcatggacatcttcctctgcgatgttgacatccgcctctctgtgaagctcctcaagtgaccaccctctactgaccctcccagggcattccagctcaagctgctggcaggaactgaccagttctttccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcttctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttctca

SEQ ID NO: 21704 - DNA, 1664 bp, Homo sapiens
cctggtcggttcccgcagtgccttgcggctgtaatggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccctggaccacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggagccccgaatgcagggaagtcaacactctccaaccagctactgggccgaaaggtgttccctgtttccaggaaggtgcatactactcgctgccaagctctgggggtcatcacagagaaggagacccaggtgattctacttgacacacctggcattatcagtcctggtaaacagaagaggcatcacctggagctctctttgttggaagatccatggaagagcatggaatctgctgatcttgttgtggttcttgtggatgtctcagacaagtggacacggaaccagctcagcccccagttgctcaggtgcttgaccaagtactcccagatccctagtgtcctggtcatgaacaaggtagattgtttgaagcagaagtcagttctcctggagctcacggcagccctcactgaagcaataccttctgacacaggcccagccagggccctgggagtaccacagtgcagtcctcactagccagacaccagaagagatctgtgccaacattatccgagagaagctcctagaacacctgccccaggaggtgccttacaatgtacagcagaagacagcagtgtgggaggaaggaccaggtggggagctggttatccaacagaagcttctggtgcccaaagaatcttatgtgaaactcctgattggtccgaagggccacgtgatctcccagatagcacaggaggcaggccatgacctcatggacatcttcctctgcgatgttgacatccgcctctctgtgaagctcctcaagtgaccaccctctactgaccctcccagggcattccagctcaagctgctggcaggaactgaccagttctttccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcttctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttctca

SEQ ID NO: 21705 - DNA, 1978 bp, Homo sapiens
aggatccttaattttattaatcccccccccccccggcagttgcggctgtaatggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccctggaccacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggagccccgaatgcagggaagtcaacactctccaaccagctactgggccgaaaggtgttccctgtttccaggaaggtgcatactactcgctgccaagctctgggggtcatcacagagaaggagacccaggtgggtgggtacctacaaagggagtccttgaaacaggacagagggtgaagctaagagggtctcccttaccatcagccttgaagaaaatgatggtcacattcatttatgtattctacttgacacacctggcattatcagtcctggtaaacagaagaggcatcacctggagctctctttgttggaagatccatggaagagcatggaatctgctgatcttgttgtggttcttgtggatgtctcagacaagtggacacggaaccagctcagcccccagttgctcaggtgcttgaccaagtactcccagatccctagtgtcctggtcatgaacaaggtagattgtttgaagcagaagtcagttctcctggagctcacggcagccctcactgaaggtgtggtcaatggcaaaaagctcaagatgaggcaggccttccactcacaccctggcacccattgccccagcccagcagttaaggacccaaacacacaatctgtgggaaatcctcagaggattggctggccccacttcaaggagatcttcatgttgtcagccctaagccaggaggatgtgaaaacactaaagcaataccttctgacacaggcccagccagggccctgggagtaccacagtgcagtcctcactagccagacaccagaagagatctgtgccaacattatccgagagaagctcctagaacacctgccccaggaggtgccttacaatgtacagcagaagacagcagtgtgggaggaaggaccaggtggggagctggttatccaacagaagcttctggtgcccaaagaatcttatgtgaaactcctgattggtccgaagggccacgtgatctcccagatagcacaggaggcaggccatgacctcatggacatcttcctctgcgatgttgacatccgcctctctgtgaagctcctcaagtgaccaccctctactgaccctcccagggcattccagctcaagctgctggcaggaactgaccagttctttccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcttctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttctca

SEQ ID NO: 21706 - DNA, 1415 bp, Homo sapiens
gggaggtactgaaagagggtggggagattccattataggggctggaaaacccctttaccataccacatccctcatcagaaatgccttagtcataagacctttcctgactgatgtatgtctgtccctcaggcatcacctggagctctctttgttggaagatccatggaagagcatggaatctgctgatcttgttgtggttcttgtggatgtctcagacaagtggacacggaaccagctcagcccccagttgctcaggtgcttgaccaagtactcccagatccctagtgtcctggtcatgaacaaggtagattgtttgaagcagaagtcagttctcctggagctcacggcagccctcactgaaggtgtggtcaatggcaaaaagctcaagatgaggcaggccttccactcacaccctggcacccattgccccagcccagcagttaaggacccaaacacacaatctgtgggaaatcctcagaggattggctggccccacttcaaggagatcttcatgttgtcagccctaagccaggaggatgtgaaaacactaaagcaataccttctgacacaggcccagccagggccctgggagtaccacagtgcagtcctcactagccagacaccagaagagatctgtgccaacattatccgagagaagctcctagaacacctgccccaggaggtgccttacaatgtacagcagaagacagcagtgtgggaggaaggaccaggtggggagctggttatccaacagaagcttctggtgcccaaagaatcttatgtgaaactcctgattggtccgaagggccacgtgatctcccagatagcacaggaggcaggccatgacctcatggacatcttcctctgcgatgttgacatccgcctctctgtgaagctcctcaagtgaccaccctctactgaccctcccagggcattccagctcaagctgctggcaggaactgaccagttctttccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcttctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttctca

SEQ ID NO: 21707 - DNA, 1581 bp, Homo sapiens
gggaggtactgaaagagggtggggagattccattataggggctggaaaacccctttaccataccacatccctcatcagaaatgccttagtcataagacctttcctgactgatgtatgtctgtccctcaggcatcacctggagctctctttgttggaagatccatggaagagcatggaatctgctgatcttggttaggttcaggatgggaaccttaagcccagtttacaggggtcatggcctttcattccttggtagtttggggggcaaaagccaagctcataccatggaagtttttgtcagggcaggaggaagagtgaccatttccttttccttcttcctgccttgccatcttctagttgtggttcttgtggatgtctcagacaagtggacacggaaccagctcagcccccagttgctcaggtgcttgaccaagtactcccagatccctagtgtcctggtcatgaacaaggtagattgtttgaagcagaagtcagttctcctggagctcacggcagccctcactgaaggtgtggtcaatggcaaaaagctcaagatgaggcaggccttccactcacaccctggcacccattgccccagcccagcagttaaggacccaaacacacaatctgtgggaaatcctcagaggattggctggccccacttcaaggagatcttcatgttgtcagccctaagccaggaggatgtgaaaacactaaagcaataccttctgacacaggcccagccagggccctgggagtaccacagtgcagtcctcactagccagacaccagaagagatctgtgccaacattatccgagagaagctcctagaacacctgccccaggaggtgccttacaatgtacagcagaagacagcagtgtgggaggaaggaccaggtggggagctggttatccaacagaagcttctggtgcccaaagaatcttatgtgaaactcctgattggtccgaagggccacgtgatctcccagatagcacaggaggcaggccatgacctcatggacatcttcctctgcgatgttgacatccgcctctctgtgaagctcctcaagtgaccaccctctactgaccctcccagggcattccagctcaagctgctggcaggaactgaccagttctttccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcttctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttctca

SEQ ID NO: 21708 - DNA, 967 bp, Homo sapiens
ggtaccagttcgacggagactctgcggataatgattggctggccccacttcaaggagatcttcatgttgtcagccctaagccaggaggatgtgaaaacactaaagcaataccttctgacacaggcccagccagggccctgggagtaccacagtgcagtcctcactagccagacaccagaagagatctgtgccaacattatccgagagaagctcctagaacacctgccccaggaggtgccttacaatgtacagcagaagacagcagtgtgggaggaaggaccaggtggggagctggttatccaacagaagcttctggtgcccaaagaatcttatgtgaaactcctgattggtccgaagggccacgtgatctcccagatagcacaggaggcaggccatgacctcatggacatcttcctctgcgatgttgacatccgcctctctgtgaagctcctcaagtgaccaccctctactgaccctcccagggcattccagctcaagctgctggcaggaactgaccagttctttccttggctggggaccctccaggcactggtgagagacatgaacactgactggccactagctggcctggccctgttgagtctgcacagtccctgcccagctgtgtcttctgttggaagaaggaacctgccttagctcagtttccaggtggttcttctgcctggcaccacagctacaaaggtgtagctaagaagatggcccattggtgggagcaatgtcaccctgcctccagctagctatgggcccagagtttctccctgagtcgctgttgctagcagggagatttctcttcctgccctcacttctttcaccttgaacttggataagaactcgtgtctcctgagtgaggtagcgcctcccatctgctccccaattcttgatctctcccaccccatccctctccccagtcttggatactaataaaatataagcattctggttctca

SEQ ID NO: 21709 - DNA, 680 bp, Homo sapiens
cctggtcggttcccgcagtgccttgcggctgtaatggctgcccccagctggcgcggggctaggcttgttcaatcggtgttaagagtctggcaggtgggccctcatgtcgcgagggagcgggtgatccctttttcctcactcttaggcttccaacggaggtgcgtgtcctgcgtcgcggggtccgctttctctggtccccgcttggcctcggcttctcgcagtaatggccagggctctgccctggaccacttcctcggattctctcagcccgacagttcggtgactccttgcgtccccgcggtgtccatgaacagagatgagcaggatgtcctcttggtccatcaccctgatatgcctgagaattcccgggtcctacgagtggtcctcctgggagccccgaatgcagggaagtcaacactctccaaccagctactgggccgaaaggtgttccctgtttccaggaaggtgcatactactcgctgccaagctctgggggtcatcacagagaaggagacccaggtgctgattctacttggcacacctggcactatcagtcccggtccgacgaggcatcacctggagccctcttctgctgcacgacccactggcagagcaggcaatctgctgcccttgctgcggccctcgcgcactgctgccccgtggtccatcgcccctgtcct

SEQ ID NO: 21710 - DNA, 1913 bp, Homo sapiens
cgcgggccggggcggagggttcggctgcgcggcggggctgaggcggccgcggggcccgagcgcagggagtggagcttggtttcgggatctcggtgctgcagacggcgagacctcctgcacagggtgtacagcaagctgtgattcctgggaaaactaaaaaagctctctggacaacggggcccagagctgatggcagacaatgtcagccactaacaacatagcccaggcccggaagctggtggaacagctacgcatagaagccgggattgagcgcatcaaggtctccaaagcggcgtctgacctcatgagctactgtgagcaacatgcccggaacgaccccctgctggtcggagtccctgcctcggagaacccctttaaggacaagaaaccttgtattattttataactgtgttctcatatgttctctctctctctctctctttctctctctctctctctgtctctgtctctgtctcaggcagggcatcattcagtaattagctcaaacaaaacatctcaagtccccaaaacctttaattccaaaagaaatcccccctctccccgccaaaaaaggcgttcccaccgcccggatggggtagaatggaccttgtaggtggagatgaattttcaggtccgaccccatggccctctcagtttgggccaaaagggatggaggctttacggccacttcccgttcggaataactgaaatcccccagcgatggggtaacaattttttaaaactctcgattgccgtttcaattgtggaccggcgccgagggggaaagggaggtgacttcgcccggtggcaatagttccgggagaattggccattggtaaaaagacttcatagggtcactggaatgctttgtgttgtttttaagtagaggtaaaattgagatggggggcgggaggtgacatcatgaagttttttggaaatatctctttatttaaaaaattgttactccatacggctaaaatcggattgtgatggttgaacccgtcgctaaactgcacgatcctgcaatgaatgcacgatggagtgtgggggtctggagggggcttcgtctatgaaaagttgccaagtgtgactcccctgcatgatgttagccatgggtcctttctgcagggtcccctctgtgccagaaatgggttttcgggacttgccccagggaagccgtcaccggcccggcccatcatgtttttggattttttttttttttctttttttgagatggagtttcattcttgttacccaggctggagtgcagctgcatgatttcagctcaccgcaacctctgcctccaccggttcaagcgattctcctgcctcagcctcccgagtagctgagactacaggcgtgtgccactacgcccggctaattgttgtatttttagtagagacggggtttcaccgtattggccaggccgctctcaaactcctgacctcgggatccgcccacctcggcctcccaaagtgctgggattacaggcatgagccaccgcgcccagtggtgttttaagcatgaggcatccgcgtggctgggagaggctttgaccatccttggctcttccaggttgtcctaccctctggcatccaccatagacgtttttcaaacagaaaatgcaggctggggagccgcggcagggcgggtggggctaccctgtgctgctgtgtgtacaaaattgttccatgatcttggagtgactctgaaggactctgggaggtgagacgttgtcccggagatcaaaacgtccgctcaaaacgttaccctgtcgctcgaacccgatctttttgcttttccacccccgtgcaacccaggacggctgtctgaggccgggagatgccttagacgcaggatgggccactcctcccagcggcaagtggaaatcgaagatgtcatggggtcggggg

SEQ ID NO: 21711 - DNA, 394 bp, Homo sapiens
gtagctctgtgagttccttgtaagtaaaaaatatgtaaccatgcttttctctttctctctccttttttaaacagggtgtacagcaagctgtgattcctgggaaaactaaaaaaggtatgtggcattttctcttacttcatgaggttggaatctcttgttttttagaaaaaggaacaaacaagccccagtcttttatgtgtgcctgacactttgggaggttgagtcatcccataaaagggctccgggctcagagccaggaaacctgagttcaaatcccagatccccttttaccagctctgccccgtttgggtgggttcgcgtcaactgtctgcagtggagatgacgttctccgttttgcaggaaggttgcaaagattaaacaagcatatagatac

SEQ ID NO: 21712 - DNA, 1842 bp, Homo sapiens
cagcagcgtgtcgccatgtcttgtgtggctgggatacgctgcaggggtgtggagtcgccgccccaatagcgccccgccctctcccggcttgtccctgcagagccccgaggcctcagaggctcctcagagctcccagtgccctggacggttccgtgcagcgctctccagttctgatggttgctctcaggaggcggctggtctgaaacaattcagtttccattgctgtgtcctgcaccacggtgtgggactggtggtttcttactgtttttctcagttctctgacgctttgaggaattgtttttaaagcgagttatccatcattttagttgttttctctgtgttctcatatgttctctctctctctctctctttctctctctctctctctgtctctgtctctgtctcaggcagggcatcattcagtaattagctcaaacaaaacatctcaagtccccaaaacctttaattccaaaagaaatcccccctctccccgccaaaaaaggcgttcccaccgcccggatggggtagaatggaccttgtaggtggagatgaattttcaggtccgaccccatggccctctcagtttgggccaaaagggatggaggctttacggccacttcccgttcggaataactgaaatcccccagcgatggggtaacaattttttaaaactctcgattgccgtttcaattgtggaccggcgccgagggggaaagggaggtgacttcgcccggtggcaatagttccgggagaattggccattggtaaaaagacttcatagggtcactggaatgctttgtgttgtttttaagtagaggtaaaattgagatggggggcgggaggtgacatcatgaagttttttggaaatatctctttatttaaaaaattgttactccatacggctaaaatcggattgtgatggttgaacccgtcgctaaactgcacgatcctgcaatgaatgcacgatggagtgtgggggtctggagggggcttcgtctatgaaaagttgccaagtgtgactcccctgcatgatgttagccatgggtcctttctgcagggtcccctctgtgccagaaatgggttttcgggacttgccccagggaagccgtcaccggcccggcccatcatgtttttggattttttttttttttctttttttgagatggagtttcattcttgttacccaggctggagtgcagctgcatgatttcagctcaccgcaacctctgcctccaccggttcaagcgattctcctgcctcagcctcccgagtagctgagactacaggcgtgtgccactacgcccggctaattgttgtatttttagtagagacggggtttcaccgtattggccaggccgctctcaaactcctgacctcgggatccgcccacctcggcctcccaaagtgctgggattacaggcatgagccaccgcgcccagtggtgttttaagcatgaggcatccgcgtggctgggagaggctttgaccatccttggctcttccaggttgtcctaccctctggcatccaccatagacgtttttcaaacagaaaatgcaggctggggagccgcggcagggcgggtggggctaccctgtgctgctgtgtgtacaaaattgttccatgatcttggagtgactctgaaggactctgggaggtgagacgttgtcccggagatcaaaacgtccgctcaaaacgttaccctgtcgctcgaacccgatctttttgcttttccacccccgtgcaacccaggacggctgtctgaggccgggagatgccttagacgcaggatgggccactcctcccagcggcaagtggaaatcgaagatgtcatggggtcggggg

SEQ ID NO: 21713 - DNA, 488 bp, Homo sapiens
caaggatcaaatatatatactttttctttttacttggtataattaagcaacttttatttggtgttctgtaagaatttatttcttattatgccacaaataccttttgagtcttcccattgattagccctcttattttagaggcctttgacagtgtttctgccaactttaggccttaggaaaagcctctgaaacttaaactttggtatcccattcaggtaccagatgtcttgaaaagccccctagagcctctgtaagccctcagagccacaaggaacacaccatggctgctggtattcattcttcagcttctcatggtgacaagctggtgaaaaccctggggagctaagagtgggggactggtgctgagactactccttgccaccccaacctcaccccaacccacactatgcccttgttccaaggtcctcatggcagggcacacagccttctgggcttggcagatgcacctacccgtgtgggcttccctg

SEQ ID NO: 21714 - DNA, 313 bp, Homo sapiens
tttaaatgggagtatgaaaaaaataatttactccgaaatggcatttaatacatagagtacttactatatggtttttgttatttttctcatattaagaaaactatgattaccaatttagaagagatttctaaatatagctctctagaatacaatattcttaataaaaactaatctgaatccacagctgttgaagtttaaccggccacttttttgatataattggtagtcatgcatttgtatcagaatgtgtagttatagtttgtctttacaatgcaatcatatgcattgtcttcatgtacacaccaaaaaaaac

SEQ ID NO: 21715 - DNA, 540 bp, Homo sapiens
  misc_feature (18)..(18): n is a, c, g, or t
  misc_feature (52)..(52): n is a, c, g, or t
  misc_feature (93)..(93): n is a, c, g, or t
  misc_feature (99)..(99): n is a, c, g, or t
  misc_feature (105)..(105): n is a, c, g, or t
  misc_feature (117)..(117): n is a, c, g, or t
  misc_feature (155)..(155): n is a, c, g, or t
  misc_feature (162)..(162): n is a, c, g, or t
tgagggaccctatatacngcactcaaacaagggcctttttaccccgggagcnccaacacaaagaagaatcgcccctgaaccccggcctatggnaaaacnccttantaataaattcgnatgaaacttgttgttggccgttccagatgccaattggncccaagngaacaatgggaacccagtcctttcaaaatgatggccatccagtaatgagaatgaacagtctccaactaaaggcaacaatatagatgaatctcggaaacatgatattgaccagacagaaaagattccacttacataaacttcaaaagaagataaaactgatctatgacattaatagtcagaatattcattatccttgagggaactaaactgggaagccacatgatagggcatctggaagctagtaatgtcctctttcttgatctgttacattggtgtgtttatttcattagatttattgagctatacatttaccaccgtgtacttgtctctgtatatgttttgcattgaaataaattttaccaataaaatgataaagca

SEQ ID NO: 21716 - DNA, 424 bp, Homo sapiens
catgtgccaccacacctggctatttttttttttttttgtatttttagtagagctggggtttcaccatgttggccatctgttctcgaactcctgacctcaggtgatccacctgcctcggcctcccaaagtgttgggattacaggcatgagccaccatgccctgccaaaagcgtttctttatgttaccatgtaagtttgccatataacctctaggaccctccccccgacaaaaaaacaatctaaataatccaggtagtcacaacagataaatctaaagatagcagaaggatggaaatgataaagattagaaccgaacttattgaaatagaaaagtgaacagcatcaacaaaaccaaaagctgattatttgaaaactctttttttcaaacaaaagagaaacttctggaaaaactactgaaaaaaaaa

SEQ ID NO: 21717 - DNA, 577 bp, Homo sapiens
cacacgcacccacattccttctgaatcgtattttctaggcatcttactaatataatccccacaacaacgagctgcagaaggttgtttctctcacagatttctgcatattctctgtacttgtagaatttgggggaacaagtcaagttacacaagctaatccctgaaacgtgagccccacggctcctcagccctctcccagagccggtggcctgcgtgccaggtccccgacaaatgctggctccatggcagctgcgatgacttccctcgagaagtgccagtccgcagggcaatctcgaggtcctcgtgcgggtgaccagctgcggcacggccagcacggcacagggagggaggggctgtgctgaccctcaggtgtctcgcgggggcccttggcggtcccagcagagggtttgcccgtgagaaggtctggaagtgctgcttcttacagggctgccttcaattatttcagctgctccgaggtatttcaaagtcagaccaaataaacatttgtatctaaaaaaggcgaaacagggtcatttgaaatggagaagaaagcctttcccgtatccggagggtgtgg

SEQ ID NO: 21718 - DNA, 456 bp, Homo sapiens
tattgagcaattttaaaattcaacttgcagaaatggattatacatgataatttgctgtgcatccataaaaaccataaaatataagagaagtgttgttagagtagctgttcccatttcctggcagtcattacatgcttccaatacaaaaacatttttctcctaactatcttttctgagctcaaaaatggatttccctccagcccctgtcattcaattatcacctcgggaaatgcacagatataactgatgatccctttcaaacgtcctgcggcaggcctcgctctctcatccttcatcgttcgtcccgctcccgtcattaaacgttacattgccgatgtatattttataaggtgaccctgacggatgtcactttgatgctgtgcagggataataagattgcacatataatgaaaggccaataaatagaaaaatgtttacgagatagagaatggtagt

SEQ ID NO: 21719 - DNA, 377 bp, Homo sapiens
caggctcaccctggtgcttgtatctgacttgccttcacttctagttcctctcacaaaacttgacctggaatccatacttgacccctgcctctggtccttcacttttggaagcccatgtttccccaaaatctttacactgacctcttctgtaccttgcacttttttttgagacagtttctcattgtctctcaggctggagtgcagtggcaccatctcagcttactgcaaactcgaccctctgggctcaagcgattctcccacctcagcctccagagcagttgggactacaggcatgtgccaccatgcccgctaatttttttgtattttaaatagagacagggtttcgccatgttggccaggctggtctcaaactcctg

SEQ ID NO: 21720 - DNA, 505 bp, Homo sapiens
cattgtgtttgggaaaggcaattgaacagtggtagccaaatattattcctccgtcggtcatccttcagggtaactgcctcggtttccacttttaaaaacgtgtggtgattgatgctttcatggactctgttgccccaagtccccaagccttgtaccagcgtttgctcattggtcctttgacctgttgagaacacaatctctgtattgtgttcaatgcagggatgcatttagagttgcccctgcatctacccattaagtttatactcctgtgttctcatattaacgtctgtgtttgcgaatagtctctctagtctttgattcactaactcccccaattctaacccaccaatggccaccaacaaacagccacactcaaaggactcaacatatttaaatattccctagaattctttgctctgttctaaaagctatgtattccgtctacataatttgattctattgtaatttctcatggttttaaaattttccttaccagtaaaaaaaa

SEQ ID NO: 21721 - DNA, 296 bp, Homo sapiens
atgcaagaaagttagagcatcagagtttgtaaagatgaaactgatgacactgcaaagcaggagccaataagactacaaaaccaaagcaacctgataattacaattattaatataaatttaaaggagctgggcagaaatgcaggaaccagatggaaaaccacagagttaaaaccagtgagtcagccaggcgcagtggctcatgcctgtaatctcagcactttgggaggctgaggtgggcggatcacctgaggtcaggagttcgagaccagcctggccaacgtggtgaaaccccatct

SEQ ID NO: 21722 - DNA, 151 bp, Homo sapiens
tgtctttcatgtcgctgtcacctctctttcaggtctcctgacttcccaccatgtgatgcaatgatcatcttgctggatttctgtgatgagagagggatgctgtggtatagaataaacatggaaatgggtcttgggaaattcctctggagtc

SEQ ID NO: 21723 - DNA, 330 bp, Homo sapiens
tccatctactgattcaaatgctaatctctcctggaaacactctcacagccacacccagaaataatgttttaccagctatctggacatccttagcttagtcaagctgacacataaaattaatcatcacatgtcctatttctttttcaatgatatttccttgctccatcttatttatatctttttaaaaatatgtattgttgctatgacctaaaaacaatctctctctttgctattatttactagctcctctcccatgtgactatatgaccgccttcaatgtacacattcatcccttattggaactttggcctttaaattagctatagtagg

SEQ ID NO: 21724 - DNA, 412 bp, Homo sapiens
aaaaaagcagtaggaaccactgatgagtgttaagcagcctttgacacgagcagagtagtgttttgaagaagattgaattggtgggtgcagagaggacaataggttgtagacaatatcctgcctgcttttgttgtggtctgtgggatggggaaatcacaatgatttggactagattggtggtggccatggggatggagagaaatggacagatttgagagatatttaacagtttcaacgaataggacttggggatagatgcgctctcaagagggagatctcagggcatataggtttctagcatgttccctgcttggctggttggctactgatcctattcacagaggcaagaatcagatctgctgaagatttgagaaggaagctcatgagttcttgtagcatatgactgaggtag

SEQ ID NO: 21725 - DNA, 404 bp, Homo sapiens
gagcccgtttgggatgtagattcctaccgtgatgtttctagaatgagagtgggatgggtcctgctgtgtggagcacacgtggactcgggacagggattgtgcatgtagcacgcgtggactcggggagagaggtggtgtgatttgggctgctccagacccatcgaagtatctcttttgatctcctggtcctgggtggtgagctggggtccagagagcttgttcccagtggacagggcactgtccgcacagctgagatgcactcatgcacacgtgggagccccaccatgtcctgcatgtttctctgggagaagtcacttctagagtggctcatggcacatgctcactcctgtgaggagtcattagcaatgggtggaccacttgagtgtaacacctacttacaagtg

SEQ ID NO: 21726 - DNA, 562 bp, Homo sapiens
agtaaagaagagtgagtcaggtgtactaaaaggacaggaagcccaagaaaagaaggagagttttgaggataaaggaaataatgataaagaaaaggagagagatgcagagaaagatccaaataaaaaagaaaaaggtgacaaaaacacaaaaggtgacaaaggaaaggacaaagttaaaggaaagagagaatcagaaatcaatggtgaaaaatcaaaaggctcgaaaagggcgaaggcaaatacaggaaggaagtacaacaaaaaagtggaagagtaaggataaattttttaaaggcccataagacaagtgattattatgattcccatactccagatacaaaccatatcccagccattgcctaaacagattacaattataaaatccctttcatcttcatatcacagtttctgctcttcagaagtttcaccctttttaatctctcagccacaaacctcagtttccaaatatttgtttcataagttaagacgtatatgattccgtcaagaaagactggatactttctgaagtaaaacattttaattaaagaaatatatagtaaat

SEQ ID NO: 21727 - DNA, 230 bp, Homo sapiens
actgaaataaaacaggtttcatatacactgtggaggaacttaactgtgcatttgcactgtgacatggctaaactctttaacaaagacgaaagcacagaaatttaacctgggatcgcccagcctgaaacaccatgaaatataagctttttgtgccacattatccttgagcattttatagtagcagaaagaagtcaaacttcacgccaagctaggggacttctgggtgctcc

SEQ ID NO: 21728 - DNA, 995 bp, Homo sapiens
caggtgaattacttgaggtcaggagttcgagaccagcctgaccaacatggtgaaaccctgtctatactaaaatatacaaaaatcagtctagcgtggtggtgggcgcctgtaatcccagctattcgggaggctgaggcaggagaattgctcgatcccgggaggcagaggttgcagtgagccgagatcgtgccactgcactccagcctgggcgacagagcgagactccgtctcaaaaagaaacttgtatcatggctagcaaagtggaatttggttttatgctaaaataaaatcctagagccaggtgtggaggcgagtgcctataatcccagctactcagaggctgaggcaggaggatttgttgagaccaggagttcaagaccagcctgggcaacataataagacctcatctcaaaaaaaaaataataaagtaaaataaaataaaaatcctactctagggcacctgggaaccaaccagtggtgcctttggaaatcttggtttatgcttcctctctgacagtaggaaaaagctattgtgggagtttctcctgccatgtagagtgatggaagagcagaattgtggaggagcagggttgctttgttttgtctttgttgtactcagctggaaagctgtttaaggaaagaatctggtcatatgacctcctttctgcaattggaaatgaacgccacagggaaaagaagatataagacacagaatgctccttgcctggctaaaatggaagaggacaaaggaagcagaatactttctgggcttttggcttttgctaccctcctctggcagacccctgtccaagacgctggctgtgttgtgtgccaggctagagcttgtacctactgtaaaatctgtgtgtgatgtctgttgagttttttggaaaacaaaaaacttatattttaaaatacaaggtattagataataccaagggcagataattccacccttggaaataaaaaagattttcttttcttcagcttgaatg

SEQ ID NO: 21729 - DNA, 813 bp, Homo sapiens
caggtgaattacttgaggtcaggagttcgagaccagcctgaccaacatggtgaaaccctgtctatactaaaatatacaaaaatcagtctagcgtggtggtgggcgcctgtaatcccagctattcgggaggctgaggcaggagaattgctcgatcccgggaggcagaggttgcagtgagccgagatcgtgccactgcactccagcctgggcgacagagcgagactccgtctcaaaaaaataataaagtaaaataaaataaaaatcctactctagggcacctgggaaccaaccagtggtgcctttggaaatcttggtttatgcttcctctctgacagtaggaaaaagctattgtgggagtttctcctgccatgtagagtgatggaagagcagaattgtggaggagcagggttgctttgttttgtctttgttgtactcagctggaaagctgtttaaggaaagaatctggtcatatgacctcctttctgcaattggaaatgaacgccacagggaaaagaagatataagacacagaatgctccttgcctggctaaaatggaagaggacaaaggaagcagaatactttctgggcttttggcttttgctaccctcctctggcagacccctgtccaagacgctggctgtgttgtgtgccaggctagagcttgtacctactgtaaaatctgtgtgtgatgtctgttgagttttttggaaaacaaaaaacttatattttaaaatacaaggtattagataataccaagggcagataattccacccttggaaataaaaaagattttcttttcttcagcttgaatg

SEQ ID NO: 21730 - DNA, 1563 bp, Homo sapiens
gaattcccggagaccagcgctgcgggccgcggcggctggggcgaggccagctggcggccccggctctcagcccccagagcagcacctgggaggtcacatcttgcagtccctggatggctttgtgttcgccttgaaccaggaaggaaaattcctctacatctcagagacagtctccatctatctgggtctctcacaggtggagatgacgggcagcagcgtcttcgactacattcaccctggggaccactcagaggtgctggagcaactggggctgcggacgccgacgcccggccccccaaccccgccctccgtctcctcttcctcctcctcttcctcttcgcttgcagatacccccgagatcgaggccagcctcaccaaggtgcccccctcctccctggtccaggagcgctccttctttgtccgcatgaaatccacgctcaccaagagggggctgcacgtcaaggcctcagggtacaaggtcatccacgtgactgggcgccttcgggcccacgccctgggccttgtggccctcgggcacacgttgcccccggcccccctggctgagctgccactccatggacacatgatcgtcttccgtctcagcctgggtctcaccatccttgcttgtgagagcagagtcagcgaccacatggacctggggccctcagagctggtgggccgcagctgctaccagtttgtccacggacaagacgccacgaggatccgccagagccacgtggacttgctggacaagggtcaggtgatgactggttactaccgttggctgcagcgtgccgggggcttcgtgtggctgcagtctgtggccacagtggctgggagcgggaagagccccggggagcaccatgtgctttgggtcagccacgtgctcagccaagccgagggtggccaaactcctttggatgccttccagcttccagccagcgtggcctgtgaggaggcatccagcccggggccagagcccacagagccggagcctccgacggaagggaagcaggctgccccagcggagaacgaggccccccagacccagggcaaacgcatcaaagtggagcccggcccgagggaaaccaaaggctccgaggacagtggcgacgaggatccctccagccacccggccacaccgaggcccgagttcacctctgtcatccgggcaggggtcctgaagcaggatccggtgcggccatggggcctggcgcctcccggggaccccccgcccaccctcctgcacgcgggcttcctgccgccggtggtgcggggcctgtgcacacccggcaccatccgctacggccccgcggagctgggcctggtgtacccgcacctgcagaggctgggtccgggccccgcgctcccggaggccttttacccgcccctgggcctgccctacccggggcccgcgggcaccaggctgccgcggaagggggactgaggactggcagagctgccggcgccggaccctgcgacaaccggggtcccccaggacagtaggcccggctctgcccgtagccctgagaattaaacgccggctctccctgcagtggtttg

SEQ ID NO: 21731 - DNA, 744 bp, Homo sapiens
gctgagcccagagggcgagcgagttactgcgcgcgcacctcacccgccccctgcattcccctccttcgccggcaggtggagatgacgggcagcagcgtcttcgactacattcaccctggggaccactcagaggtgctggagcaactggggctgcggacgccgacgcccggccccccaaccccgccctccgtctcctcttcctcctcctcttcctcttcgcttgcagatacccccgagatcggagcgctccttctttgtccgcatgaaatccacgctcaccaagagggggctgcacgtcaaggcctcagggtacaaggtcatccacgtgactgggcgccttcgggcccacgccctgggccttgtggccctcgggcacacgttgcccccggcccccctggctgagctgccactccatggacacatgatcgtcttccgtctcagcctgggtctcaccatccttgcttgtgagagcagagtcagcgaccacatggacctggggccctcagagctggtgggccgcagctgctaccagtttgtccacggacaagacgccacgaggatccgccagagccacgtggactgtgagacccacctccagccacaagcctgcctaccaccccccagacccgagcatccactccctggtccctggaagtccttcttcagggctgcccacagtccctcctgctgcacctacagctccagggactccgtttagcattggaagagcagcaaggagactga

SEQ ID NO: 21732 - DNA, 2109 bp, Homo sapiens
gtctccaagtctgcgaggccgaggtgggcgccgagagctgggcgccacagcccgcgcgtcccgctgcgccccgcgcgccccggggtctatggagctgcccctccgcgccgcccggccggccccacgccgcgcccggagcctgctctgcggccaagtaatcggactggcggtcctgcgggagactcggggctcggagcccgcctgagcgagccccccggagatggcggccccctatcccggcagtggcggcggaagcgaggtcaaatgcgtgggaggccgcggcgccagcgtcccctgggactttctacccgggctgatggtcaaggcgccgtccggaccgtgcctgcaggcgcagcgcaaggagaagtcccggaacgcggcgcgctcgcggcgcgggaaggagaacctggagttcttcgagctggccaagcttctcccgctgcccggcgccatctccagccagctggacaaggcttccatcgtgcgcctcagcgtcacctacctccgcctgcgccggttcgccgcgctgggggcgccgccctgggggctgagagccgcggggccgccagctggcctcgccccaggccgccgcggccccgcagcgctggtctccgaagtcttcgagcagcacctgggaggtcacatcttgcagtccctggatggctttgtgttcgccttgaaccaggaaggaaaattcctctacatctcagagacagtctccatctatctgggtctctcacaggtggagatgacgggcagcagcgtcttcgactacattcaccctggggaccactcagaggtgctggagcaactggggctgcggacgccgacgcccggccccccaaccccgccctccgtctcctcttcctcctcctcttcctcttcgcttgcagatacccccgagatcgaggccagcctcaccaaggtgcccccctcctccctggtccaggagcgctccttctttgtccgcatgaaatccacgctcaccaagagggggctgcacgtcaaggcctcagggtacaaggtcatccacgtgactgggcgccttcgggcccacgccctgggccttgtggccctcgggcacacgttgcccccggcccccctggctgagctgccactccatggacacatgatcgtcttccgtctcagcctgggtctcaccatccttgcttgtgagagcagagtcagcgaccacatggacctggggccctcagagctggtgggccgcagctgctaccagtttgtccacggacaagacgccacgaggatccgccagagccacgtggacttgctggacaagggtcaggtgatgactggttactaccgttggctgcagcgtgccgggggcttcgtgtggctgcagtctgtggccacagtggctgggagcgggaagagccccggggagcaccatgtgctttgggtcagccacgtgctcagccaagccgagggtggccaaactcctttggatgccttccagcttccagccagcgtggcctgtgaggaggcatccagcccggggccagagcccacagagccggagcctccgacggaagggaagcaggctgccccagcggagaacgaggccccccagacccagggcaaacgcatcaaagtggagcccggcccgagggaaaccaaaggctccgaggacagtggcgacgaggatccctccagccacccggccacaccgaggcccgagttcacctctgtcatccgggcaggggtcctgaagcaggatccggtgcggccatggggcctggcgcctcccggggaccccccgcccaccctcctgcacgcgggcttcctgccgccggtggtgcggggcctgtgcacacccggcaccatccgctacggccccgcggagctgggcctggtgtacccgcacctgcagaggctgggtccgggccccgcgctcccggaggccttttacccgcccctgggcctgccctacccggggcccgcgggcaccaggctgccgcggaagggggactgaggactggcagagctgccggcgccggaccctgcgacaaccggggtcccccaggacagtaggcccggctctgcccgtagccctgagaattaaacgccggctctccctgcagtggtttg

SEQ ID NO: 21733 - DNA, 1891 bp, Homo sapiens
gtctccaagtctgcgaggccgaggtgggcgccgagagctgggcgccacagcccgcgcgtcccgctgcgccccgcgcgccccggggtctatggagctgcccctccgcgccgcccggccggccccacgccgcgcccggagcctgctctgcggccaagtaatcggactggcggtcctgcgggagactcggggctcggagcccgcctgagcgagccccccggagatggcggccccctatcccggcagtggcggcggaagcgaggtcaaatgcgtgggaggccgcggcgccagcgtcccctgggactttctacccgggctgatggtcaaggcgccgtccggaccgtgcctgcaggcgcagcgcaaggagaagtcccggaacgcggcgcgctcgcggcgcgggaaggagaacctggagttcttcgagctggccaagcttctcccgctgcccggcgccatctccagccagctggacaaggcttccatcgtgcgcctcagcgtcacctacctccgcctgcgccggttcgccgcgctgggggcgccgccctgggggctgagagccgcggggccgccagctggcctcgccccaggccgccgcggccccgcagcgctggtctccgaagtcttcgagcagcacctgggaggtcacatcttgcagtccctggatggctttgtgttcgccttgaaccaggaaggaaaattcctctacatctcagagacagtctccatctatctgggtctctcacaggtggagatgacgggcagcagcgtcttcgactacattcaccctggggaccactcagaggtgctggagcaactggggctgcggacgccgacgcccggccccccaaccccgccctccgtctcctcttcctcctcctcttcctcttcgcttgcagatacccccgagatcgagtcagcgaccacatggacctggggccctcagagctggtgggccgcagctgctaccagtttgtccacggacaagacgccacgaggatccgccagagccacgtggacttgctggacaagggtcaggtgatgactggttactaccgttggctgcagcgtgccgggggcttcgtgtggctgcagtctgtggccacagtggctgggagcgggaagagccccggggagcaccatgtgctttgggtcagccacgtgctcagccaagccgagggtggccaaactcctttggatgccttccagcttccagccagcgtggcctgtgaggaggcatccagcccggggccagagcccacagatgggaagactgagggctggggacacacacaggccctcagcatcttcctcttccagagccggagcctccgacggaagggaagcaggctgccccagcggagaacgaggccccccagacccagggcaaacgcatcaaagtggagcccggcccgagggaaaccaaaggctccgaggacagtggcgacgaggatccctccagccacccggccacaccgaggcccgagttcacctctgtcatccgggcaggggtcctgaagcaggatccggtgcggccatggggcctggcgcctcccggggaccccccgcccaccctcctgcacgcgggcttcctgccgccggtggtgcggggcctgtgcacacccggcaccatccgctacggccccgcggagctgggcctggtgtacccgcacctgcagaggctgggtccgggccccgcgctcccggaggccttttacccgcccctgggcctgccctacccggggcccgcgggcaccaggctgccgcggaagggggactgaggactggcagagctgccggcgccggaccctgcgacaaccggggtcccccaggacagtaggcccggctctgcccgtagccctgagaattaaacgccggctctccctgcagtggtttg

SEQ ID NO: 21734 - DNA, 1873 bp, Homo sapiens
gtctccaagtctgcgaggccgaggtgggcgccgagagctgggcgccacagcccgcgcgtcccgctgcgccccgcgcgccccggggtctatggagctgcccctccgcgccgcccggccggccccacgccgcgcccggagcctgctctgcggccaagtaatcggactggcggtcctgcgggagactcggggctcggagcccgcctgagcgagccccccggagatggcggccccctatcccggcagtggcggcggaagcgaggtcaaatgcgtgggaggccgcggcgccagcgtcccctgggactttctacccgggctgatggtcaaggcgccgtccggaccgtgccccaggccgccgcggccccgcagcgctggtctccgaagtcttcgagcagcacctgggaggtcacatcttgcagtccctggatggctttgtgttcgccttgaaccaggaaggaaaattcctctacatctcagagacagtctccatctatctgggtctctcacaggtggagatgacgggcagcagcgtcttcgactacattcaccctggggaccactcagaggtgctggagcaactggggctgcggacgccgacgcccggccccccaaccccgccctccgtctcctcttcctcctcctcttcctcttcgcttgcagatacccccgagatcgaggccagcctcaccaaggtgcccccctcctccctggtccaggagcgctccttctttgtccgcatgaaatccacgctcaccaagagggggctgcacgtcaaggcctcagggtacaaggtcatccacgtgactgggcgccttcgggcccacgccctgggccttgtggccctcgggcacacgttgcccccggcccccctggctgagctgccactccatggacacatgatcgtcttccgtctcagcctgggtctcaccatccttgcttgtgagagcagagtcagcgaccacatggacctggggccctcagagctggtgggccgcagctgctaccagtttgtccacggacaagacgccacgaggatccgccagagccacgtggacttgctggacaagggtcaggtgatgactggttactaccgttggctgcagcgtgccgggggcttcgtgtggctgcagtctgtggccacagtggctgggagcgggaagagccccggggagcaccatgtgctttgggtcagccacgtgctcagccaagccgagggtggccaaactcctttggatgccttccagcttccagccagcgtggcctgtgaggaggcatccagcccggggccagagcccacagagccggagcctccgacggaagggaagcaggctgccccagcggagaacgaggccccccagacccagggcaaacgcatcaaagtggagcccggcccgagggaaaccaaaggctccgaggacagtggcgacgaggatccctccagccacccggccacaccgaggcccgagttcacctctgtcatccgggcaggggtcctgaagcaggatccggtgcggccatggggcctggcgcctcccggggaccccccgcccaccctcctgcacgcgggcttcctgccgccggtggtgcggggcctgtgcacacccggcaccatccgctacggccccgcggagctgggcctggtgtacccgcacctgcagaggctgggtccgggccccgcgctcccggaggccttttacccgcccctgggcctgccctacccggggcccgcgggcaccaggctgccgcggaagggggactgaggactggcagagctgccggcgccggaccctgcgacaaccggggtcccccaggacagtaggcccggctctgcccgtagccctgagaattaaacgccggctctccctgcagtggtttg

SEQ ID NO: 21735 - DNA, 762 bp, Homo sapiens
ctcgctgctgggctacctctcagtctctctgactctgcctctctgtgctttcacctttttctcttctccccaccgtctccctgcccactcccctgctctcactcctcctgtctcctcctgtctacctggctctctgtcttgcccctgtccccaccccacccccttcccggggccagagcccacagagccggagcctccgacggaagggaagcaggctgccccagcggagaacgaggccccccagacccagggcaaacgcatcaaagtggagcccggcccgagggaaaccaaaggctccgaggacagtggcgacgaggatccctccagccacccggccacaccgaggcccgagttcacctctgtcatccgggcaggggtcctgaagcaggatccggtgcggccatggggcctggcgcctcccggggaccccccgcccaccctcctgcacgcgggcttcctgccgccggtggtgcggggcctgtgcacacccggcaccatccgctacggccccgcggagctgggcctggtgtacccgcacctgcagaggctgggtccgggccccgcgctcccggaggccttttacccgcccctgggcctgccctacccggggcccgcgggcaccaggctgccgcggaagggggactgaggactggcagagctgccggcgccggaccctgcgacaaccggggtcccccaggacagtaggcccggctctgcccgtagccctgagaattaaacgccggctctccctgcagtggtttg

SEQ ID NO: 21736 - DNA, 352 bp, Homo sapiens
cagcagcctcttcagcatccatctattgtggggggtacctggactgggaaggcgaatgctcaagatccctccactccctgccccttccgaggaccactgaagccccctccccaccaaaacagtccacctcaggtggagacccaggtttcagaacctcttaccacttggcggctggacagagggacaccgggtcctctccttccccctccctgtctctcccggctctagtccctggatggctttgtgttcgccttgaaccaggaaggaaaattcctctacatctcagagacagtctccatctatctgggtctctcacaggtaagggacccccagtggacctggattggctcag

SEQ ID NO: 21737 - DNA, 2049 bp, Homo sapiens
tcatccaggcccccccccccagctccttgctgggaccctgagccctgcacggatctcagtttccctagaaggtctcccgagggcactaagcgttgcccctggccccctcccgctgcaggagactcggggctcggagcccgcctgagcgagccccccggagatggcggccccctatcccggcagtggcggcggaagcgaggtcaaatgcgtgggaggccgcggcgccagcgtcccctgggactttctacccgggctgatggtcaaggcgccgtccggaccgtgcctgcaggcgcagcgcaaggagaagtcccggaacgcggcgcgctcgcggcgcgggaaggagaacctggagttcttcgagctggccaagcttctcccgctgcccggcgccatctccagccagctggacaaggcttccatcgtgcgcctcagcgtcacctacctccgcctgcgccggttcgccgcgctgggggcgccgccctgggggctgagagccgcggggccgccagctggcctcgccccaggccgccgcggccccgcagcgctggtctccgaagtcttcgagcagcacctgggaggtcacatcttgcagtccctggatggctttgtgttcgccttgaaccaggaaggaaaattcctctacatctcagagacagtctccatctatctgggtctctcacaggtggagatgacgggcagcagcgtcttcgactacattcaccctggggaccactcagaggtgctggagcaactggggctgcggacgccgacgcccggccccccaaccccgccctccgtctcctcttcctcctcctcttcctcttcgcttgcagatacccccgagatcgaggccagcctcaccaaggtgcccccctcctccctggtccaggagcgctccttctttgtccgcatgaaatccacgctcaccaagagggggctgcacgtcaaggcctcagggtacaaggtcatccacgtgactgggcgccttcgggcccacgccctgggccttgtggccctcgggcacacgttgcccccggcccccctggctgagctgccactccatggacacatgatcgtcttccgtctcagcctgggtctcaccatccttgcttgtgagagcagagtcagcgaccacatggacctggggccctcagagctggtgggccgcagctgctaccagtttgtccacggacaagacgccacgaggatccgccagagccacgtggacttgctggacaagggtcaggtgatgactggttactaccgttggctgcagcgtgccgggggcttcgtgtggctgcagtctgtggccacagtggctgggagcgggaagagccccggggagcaccatgtgctttgggtcagccacgtgctcagccaagccgagggtggccaaactcctttggatgccttccagcttccagccagcgtggcctgtgaggaggcatccagcccggggccagagcccacagagccggagcctccgacggaagggaagcaggctgccccagcggagaacgaggccccccagacccagggcaaacgcatcaaagtggagcccggcccgagggaaaccaaaggctccgaggacagtggcgacgaggatccctccagccacccggccacaccgaggcccgagttcacctctgtcatccgggcaggggtcctgaagcaggatccggtgcggccatggggcctggcgcctcccggggaccccccgcccaccctcctgcacgcgggcttcctgccgccggtggtgcggggcctgtgcacacccggcaccatccgctacggccccgcggagctgggcctggtgtacccgcacctgcagaggctgggtccgggccccgcgctcccggaggccttttacccgcccctgggcctgccctacccggggcccgcgggcaccaggctgccgcggaagggggactgaggactggcagagctgccggcgccggaccctgcgacaaccggggtcccccaggacagtaggcccggctctgcccgtagccctgagaattaaacgccggctctccctgcagtggtttg

SEQ ID NO: 21738 - DNA, 778 bp, Homo sapiens
gtctccaagtctgcgaggccgaggtgggcgccgagagctgggcgccacagcccgcgcgtcccgctgcgccccgcgcgccccggggtctatggagctgcccctccgcgccgcccggccggccccacgccgcgcccggagcctgctctgcggccaagtaatcggactggcggtcctgcggccccaggccgccgcggccccgcagcgctggtctccgaagtcttcgagcagcacctgggaggtcacatcttgcagtccctggatggctttgtgttcgccttgaaccaggaaggaaaattcctctacatctcagagacagtctccatctatctgggtctctcacaggtggagatgacgggcagcagcgtcttcgactacattcaccctggggaccactcagaggtgctggagcaactggggctgcggacgccgacgcccggccccccaaccccgccctccgtctcctcttcctcctcctcttcctcttcgcttgcagatacccccgagatcgagtcagcgaccacatggacctggggccctcagagctggtgggccgcagctgctaccagtttgtccacggacaagacgccacgaggatccgccagagccacgtggactgtgagacccacctccagccacaagcctgcctaccaccccccagacccgagcatccactccctggtccctggaagtccttcttcagggctgcccacagtccctcctgctgcacctacagctccagggactccgtttagcattggaagagcagcaaggagactga

SEQ ID NO: 21739 - DNA, 1835 bp, Homo sapiens
gtctccaagtctgcgaggccgaggtgggcgccgagagctgggcgccacagcccgcgcgtcccgctgcgccccgcgcgccccggggtctatggagctgcccctccgcgccgcccggccggccccacgccgcgcccggagcctgctctgcggccaagtaatcggactggcggtcctgcgggagactcggggctcggagcccgcctgagcgagccccccggagatggcggccccctatcccggcagtggcggcggaagcgaggtcaaatgcgtgggaggccgcggcgccagcgtcccctgggactttctacccgggctgatggtcaaggcgccgtccggaccgtgcctgcaggcgcagcgcaaggagaagtcccggaacgcggcgcgctcgcggcgcgggaaggagaacctggagttcttcgagctggccaagcttctcccgctgcccggcgccatctccagccagctggacaaggcttccatcgtgcgcctcagcgtcacctacctccgcctgcgccggttcgccgcgctgggggcgccgccctgggggctgagagccgcggggccgccagctggcctcgccccaggccgccgcggccccgcagcgctggtctccgaagtcttcgagcagcacctgggaggtcacatcttgcagtccctggatggctttgtgttcgccttgaaccaggaaggaaaattcctctacatctcagagacagtctccatctatctgggtctctcacaggtggagatgacgggcagcagcgtcttcgactacattcaccctggggaccactcagaggtgctggagcaactggggctgcggacgccgacgcccggccccccaaccccgccctccgtctcctcttcctcctcctcttcctcttcgcttgcagatacccccgagatcgagtcagcgaccacatggacctggggccctcagagctggtgggccgcagctgctaccagtttgtccacggacaagacgccacgaggatccgccagagccacgtggacttgctggacaagggtcaggtgatgactggttactaccgttggctgcagcgtgccgggggcttcgtgtggctgcagtctgtggccacagtggctgggagcgggaagagccccggggagcaccatgtgctttgggtcagccacgtgctcagccaagccgagggtggccaaactcctttggatgccttccagcttccagccagcgtggcctgtgaggaggcatccagcccggggccagagcccacagagccggagcctccgacggaagggaagcaggctgccccagcggagaacgaggccccccagacccagggcaaacgcatcaaagtggagcccggcccgagggaaaccaaaggctccgaggacagtggcgacgaggatccctccagccacccggccacaccgaggcccgagttcacctctgtcatccgggcaggggtcctgaagcaggatccggtgcggccatggggcctggcgcctcccggggaccccccgcccaccctcctgcacgcgggcttcctgccgccggtggtgcggggcctgtgcacacccggcaccatccgctacggccccgcggagctgggcctggtgtacccgcacctgcagaggctgggtccgggccccgcgctcccggaggccttttacccgcccctgggcctgccctacccggggcccgcgggcaccaggctgccgcggaagggggactgaggactggcagagctgccggcgccggaccctgcgacaaccggggtcccccaggacagtaggcccggctctgcccgtagccctgagaattaaacgccggctctccctgcagtggtttg

SEQ ID NO: 21740 - DNA, 1878 bp, Homo sapiens
ttggtgcgccggagtaggctagggcagcgacacgcccgcgtcgtattccggtgtgccccgatgcgccccaggggtcctatggagctgtccgctccgtcgccgctcgcggccttcctggatgccagagctgaggcagcgtgctctgcggcctgtttatcggcagtggtgggtcctgcagggtagcactcggagtcctcgcgacgtctcagaccttgcagcggatgccctcgccttggcacgattggatggcctgctctattccgggctaggtgagcggggcgaagccgaagagtaagacatgccgatgggaaggactgtcgcgtgctcgacgcgtcccctgggactttctacccgggctgatggtcaaggcgccgtccggaccgtgcctgcaggcgcagcgcaaggagaagtcccggaacgcggcgcgctcgcggcgcgggaaggagaacctggagttcttcgagctggccaagcttctcccgctgcccggcgccatctccagccagctggacaaggcttccatcgtgcgcctcagcgtcacctacctccgcctgcgccggttcgccgcgctgggggcgccgccctgggggctgagagccgcggggccgccagctggcctcgccccaggccgccgcggccccgcagcgctggtctccgaagtcttcgagcagcacctgggaggtcacatcttgcagtccctggatggctttgtgttcgccttgaaccaggaaggaaaattcctctacatctcagagacagtctccatctatctgggtctctcacaggtggagatgacgggcagcagcgtcttcgactacattcaccctggggaccactcagaggtgctggagcaactggggctgcggacgccgacgcccggccccccaaccccgccctccgtctcctcttcctcctcctcttcctcttcgcttgcagatacccccgagatcgagtcagcgaccacatggacctggggccctcagagctggtgggccgcagctgctaccagtttgtccacggacaagacgccacgaggatccgccagagccacgtggacttgctggacaagggtcaggtgatgactggttactaccgttggctgcagcgtgccgggggcttcgtgtggctgcagtctgtggccacagtggctgggagcgggaagagccccggggagcaccatgtgctttgggtcagccacgtgctcagccaagccgagggtggccaaactcctttggatgccttccagcttccagccagcgtggcctgtgaggaggcatccagcccggggccagagcccacagagccggagcctccgacggaagggaagcaggctgccccagcggagaacgaggccccccagacccagggcaaacgcatcaaagtggagcccggcccgagggaaaccaaaggctccgaggacagtggcgacgaggatccctccagccacccggccacaccgaggcccgagttcacctctgtcatccgggcaggggtcctgaagcaggatccggtgcggccatggggcctggcgcctcccggggaccccccgcccaccctcctgcacgcgggcttcctgccgccggtggtgcggggcctgtgcacacccggcaccatccgctacggccccgcggagctgggcctggtgtacccgcacctgcagaggctgggtccgggccccgcgctcccggaggccttttacccgcccctgggcctgccctacccggggcccgcgggcaccaggctgccgcggaagggggactgaggactggcagagctgccggcgccggaccctgcgacaaccggggtcccccaggacagtaggcccggctctgcccgtagccctgagaattaaacgccggctctccctgcagtggtttg

SEQ ID NO: 21741 - DNA, 928 bp, Homo sapiens
gtctccaagtctgcgaggccgaggtgggcgccgagagctgggcgccacagcccgcgcgtcccgctgcgccccgcgcgccccggggtctatggagctgcccctccgcgccgcccggccggccccacgccgcgcccggagcctgctctgcggccaagtaatcggactggcggtcctgcgggagactcggggctcggagcccgcctgagcgagccccccggagatggcggccccctatcccggcagtggcggcggaagcgaggtcaaatgcgtgggaggccgcggcgccagcgtcccctgggactttctacccgggctgatggtcaaggcgccgtccggaccgtgcctgcaggcgcagcgcaaggagaagtcccggaacgcggcgcgctcgcggcgcgggaaggagaacctggagttcttcgagctggccaagcttctcccgctgcccggcgccatctccagccagctggacaaggcttccatcgtgcgcctcagcgtcacctacctccgcctgcgccggttcgccgcgctgggggcgccgccctgggggctgagagccgcggggccgccagctggcctcgccccaggccgccgcggccccgcagcgctggtctccgaagtcttcgagcagcacctgggaggtcacatcttgcagtccctggatggctttgtgttcgccttgaaccaggaaggaaaattcctctacatctcagagacagtctccatctatctgggtctctcacaggtggagatgacgggcagcagcgtcttcgactacattcaccctggggaccactcagaggtgctggagcaactggggctgcggacgccgacgcccggccccccaaccccgccctccgtctcctcttcctcctcctcttcctcttcgcttgcagatacccccgagatcggtaattctaagggctcctaa

SEQ ID NO: 21742 - DNA, 1122 bp, Homo sapiens
agggaaattaggaaagggcgatgtaagtttggcttttataagttcattgtcacagtagttcctggtatttagtttgtcacattgaagctttgctggatgtgactaagctggcagagaaatcttgcaaaatatctttttgaaattagtatcacacccaactgcattctgttgcaaattaccaacattgtgtgtgacatttttccttcctgccccctcagctagccccagttattgggatttagatgtgttttcctgcttgaaaaagaaaagagccttaacaggtagcagtatgtcaagttggactttgcccaccgaggaaacagcatctgccattgattgacatgatactaatttcagctgggtgcccaggaggcctctggccgatagttgttttggttggtttgtttatttggatttgttttgcagttcgtgtctgggatgtccggccatttgcccccaaagagagatgtgtaaagatatttcaaggaaatgtgcacaactttgaaaagaaccttctgagatgttcttggtcacctgatggaagcaaaatagcagctggctcagccgacaggtttgtttatgtgtgggataccacaagcaggagaatattgtataagctgcccggccatgctggctccatcaatgaagtggctttccaccctgatgagcccatcattatctcagcatcgagtgacaagagactgtatatgggagagattcagtgaagatatggactggaagactccaaggccgcttgtctttgagacctcagactgcataagtgatgccaaatgttggatgtccaggctagcaccctcccttcagatgaccattgctagcaagaaacaggaggcggtggccatattccaaaaaccacttctgtcccatttcaccaggatgactaaggcaagctccctgtggcctctaaaaaccacctgccagatttcagggactgtttttttttttctttttcttttttcctgttttctaatgcaggcccaatgtgacaaatttgttggttgggatttttttttttttttgtaactggcttgtatgatattttctttctgtatttctctatatcattttgtattaaaagccaaatagatgcctttttacaag

SEQ ID NO: 21743 - DNA, 2115 bp, Homo sapiens
aagctggaagttgtggaggaaggactaatttggaaccaattgcgtggcgcctgagagcggcagcgcggtcagtggcggcgctgaagagaccggttgccgccatgatagaacagcagaagcgtaagggcccagagttgccgctggttccagtcaagcggcagcggcatgagttgctgttgggagcggggtctggcccaggagccgggcagcagcaggcgacgccgggagccttgctgcaagcgggacctccaagatgttcctcccttcaagccccaatcatgctgctctctggacatgaaggggaagtctactgctgcaagttccaccccaacggatccaccttagcatctgcaggatttgaccgactgatattactgtggaatgtctatggtgactgtgataactatgccacactgaagggacacagtggagcagtgatggaattgcattacaacacagatggcagtatgcttttctcagcatccacagataaaaccgtggctgtgtgggatagtgaaacaggtgagagggttaaaaggctaaagggacatacttcctttgtgaattcctgttatccagccaggagaggccctcagcttgtctgcactggcagtgacgatggcacagttaagctttgggacatccggaagaaagcagccatccagacatttcagaacacgtaccaggtgttagctgtgaccttcaatgacacaagtgatcagattatttctggtggaatagacaatgatatcaaggtctgggacctgcgccagaacaagctaacctacaccatgagaggccatgcagattcagtgactggcctgagtttaagttctgaaggctcttatcttttgtccaatgcaatggacaatacagttcgtgtctgggatgtccggccatttgcccccaaagagagatgtgtaaagatatttcaaggaaatgtgcacaactttgaaaagaaccttctgagatgttcttggtcacctgatggaagcaaaatagcagctggctcagccgacaggtttgtttatgtgtgggataccacaagcaggagaatattgtataagctgcccggccatgctggctccatcaatgaagtggctttccaccctgatgagcccatcattatctcagcatcgagtgacaagagactgtatatgggagagattcagtgaagatatggactggaagactccaaggccgcttgtctttgagacctcagactgcataagtgatgccaaatgttggatgtccaggctagcaccctcccttcagatgaccattgctagcaagaaacaggaggcggtggccatattccaaaaaccacttctgtcccatttcaccaggatgactaaggcaagctccctgtggcctctaaaaaccacctgccagatttcagggactgtttttttttttctttttcttttttcctgttttctaatgcaggcccaatgtgacaaatttgttggttgggatttttttttttttttgtaactggcttgtatgatattttctttctgtatttctctatatcattttgtattaaaagccaaatagatgcctttttacaagagccatgtggattggatttattgctgtcttttttttgaggcttgattgctataaatcagaatagagcatgatgtggccacagaatacaattcatttaaacttccaaaaaaaaaaaaaaaaaaaaaaaaaaaaaaaaaaaaaaaaaaaataaaaaaaaaaaaaaccaaacaaaatacctataaaacacctataacatcacacaacatatatataccataataccagaaaaaaatccttggggggggccccttacccactttgccctttatcggctggttttccaaaatagtagtctctttatcaacttaattcgccggaaaaaccctgtaattcccctattaaattcacctgttagcacatccttgttcatctatctggataataggaaaaaagcctgctcaaatcccctttccctaaaatcctccattccgtcatggaaaaacccccctattaacacttctttcttgttataaaataccacctaaattatcctaaaaaactttctttcttatcacactgactcgacctatcaaaaccctttat

SEQ ID NO: 21744 - DNA, 1833 bp, Homo sapiens
  misc_feature (1734)..(1734): n is a, c, g, or t
aagctggaagttgtggaggaaggactaatttggaaccaattgcgtggcgcctgagagcggcagcgcggtcagtggcggcgctgaagagaccggttgccgccatgatagaacagcagaagcgtaagggcccagagttgccgctggttccagtcaagcggcagcggcatgagttgctgttgggagcggggtctggcccaggagccgggcagcagcaggcgacgccgggagccttgctgcaagcgggacctccaagatgttcctcccttcaagccccaatcatgctgctctctggacatgaaggggaagtctactgctgcaagttccaccccaacggatccaccttagcatctgcaggatttgaccgactgatattactgtggaatgtctatggtgactgtgataactatgccacactgaagggacacagtggagcagtgatggaattgcattacaacacagatggcagtatgcttttctcagcatccacagataaaaccgtggctgtgtgggatagtgaaacaggtgagagggttaaaaggctaaagggacatacttcctttgtgaattcctgttatccagccaggagaggccctcagcttgtctgcactggcagtgacgatggcacagttaagctttgggacatccggaagaaagcagccatccagacatttcagaacacgtaccaggtgttagctgtgaccttcaatgacacaagtgatcagattatttctggtggaatagacaatgatatcaaggtctgggacctgcgccagaacaagctaacctacaccatgagaggccatgcagattcagtgactggcctgagtttaagttctgaaggctcttatcttttgtccaatgcaatggacaatacagttcgtgtctgggatgtccggccatttgcccccaaagagagatgtgtaaagatatttcaaggaaatgtgcacaactttgaaaagaaccttctgagatgttcttggtcacctgatggaagcaaaatagcagctggctcagccgacaggtttgtttatgtgtgggataccacaagcaggagaatattgtataagctgcccggccatgctggctccatcaatgaagtggctttccaccctgatgagcccatcattatctcagcatcgagtgacaagagactgtatatgggagagattcagtgaagatatggactggaagactccaaggccgcttgtctttgagacctcagactgcataagtgatgccaaatgttggatgtccaggctagcaccctcccttcagatgaccattgctagcaagaaacaggaggcggtggccatattccaaaaaccacttctgtcccatttcaccaggatgactaaggcaagctccctgtggcctctaaaaaccacctgccagatttcagggactgtttttttttttctttttcttttttcctgttttctaatgcaggcccaatgtgacaaatttgttggttgggatttttttttttttttgtaactggcttgtatgatattttctttctgtatttctctatatcattttgtattaaaagccaaatagatgcctttttacaagagccatgtggattggatttattgctgtcttttttttgaggcttgattgctataaatcagaatagagcatgatgtggccacagaatacaattcatttaaacttccaaaaaaaaaaaaaaaaaaaaaaaaaaaaaaaaaaaaaaaaaaaataaaaaaaactcgngactagttccacgcacacaccaccacgcccatgtgctcctagttttttttctaagccaaattcagccttggcctgactgatttccacatccaagaatcc

SEQ ID NO: 21745 - DNA, 703 bp, Homo sapiens
ctctgtgttcctagtttctaaaagccagaacatggttcagtaaatgtaaggtaagtaaataattgttgcttccatttcctttaaaaagccatgcctctgtcctacccccagctctaagaggacttacccttgcttttcatgataccttacaggtttgtttatgtgtgggataccacaagcaggagaatattgtataagctgcccggccatgctggctccatcaatgaagtggctttccaccctgatgagcccatcattatctcagcatcgagtgacaagagactgtatatgggagagattcagtgaagatatggactggaagactccaaggccgcttgtctttgagacctcagactgcataagtgatgccaaatgttggatgtccaggctagcaccctcccttcagatgaccattgctagcaagaaacaggaggcggtggccatattccaaaaaccacttctgtcccatttcaccaggatgactaaggcaagctccctgtggcctctaaaaaccacctgccagatttcagggactgtttttttttttctttttcttttttcctgttttctaatgcaggcccaatgtgacaaatttgttggttgggatttttttttttttttgtaactggcttgtatgatattttctttctgtatttctctatatcattttgtattaaaagccaaatagatgcctttttacaag

SEQ ID NO: 21746 - DNA, 274 bp, Homo sapiens
gtaagtctgtcccaacgagggggaaagggaaactggaaatctccccgtagggatcctgggaatagagagtcaaaagcgggtatctgttttatacgaatttccatgcaaacagcctttgggtgtttttgttgttgttgttgttggtttttttgttgttgggttttgttttgttttgtttttgagacagtgtctcgctgttttgcccaggttggagcaatggtgcaatcttggctcactgcaacctctgcctcctgggttcaagcagttctcctgc

SEQ ID NO: 21747 - DNA, 405 bp, Homo sapiens
tactgtggaatgtctatggtgactgtgataactatgccacactgaagggacacagtggagcagtgatggaattgcattacaacacagatggcaggtgagtattctgcataatggaaggacagcttctcatactaattcttggcgtcctttcacctttcatcctttctcaggagaccctgctatcaaaaactactaattttgggtagctactttagtatccgatttatcactgtcaccccaagtgaggtgtttatagtctgtgtatgcaaatataaagatgttacatcggtcatttcaacaacccagacaaatttttctttttttaagacataaaataaatgtgatttttatatgtaggctggagtgcagtgacacaaacatggctcactgcagcctcaacctctt

SEQ ID NO: 21748 - DNA, 1572 bp, Homo sapiens
aagctggaagttgtggaggaaggactaatttggaaccaattgcgtggcgcctgagagcggcagcgcggtcagtggcggcgctgaagagaccggttgccgccatgatagaacagcagaagcgtaagggcccagagttgccgctggttccagtcaagcggcagcggcatgagttgctgttgggagcggggtctggcccaggagccgggcagcagcaggcgacgccgggagccttgctgcaagcgggacctccaagatgttcctcccttcaagccccaatcatgctgctctctggacatgaaggggaagtctactgctgcaagttccaccccaacggatccaccttagcatctgcaggatttgaccgactgatattactgtggaatgtctatggtgactgtgataactatgccacactgaagggacacagtggagcagtgatggaattgcattacaacacagatggcagtatgcttttctcagcatccacagataaaaccgtggctgtgtgggatagtgaaacaggtgagagggttaaaaggctaaagggacatacttcctttgtgaattcctgttatccagccaggagaggccctcagcttgtctgcactggcagtgacgatggcacagttaagctttgggacatccggaagaaagcagccatccagacatttcagaacacgtaccaggtgttagctgtgaccttcaatgacacaagtgatcagattatttctggtggaatagacaatgatatcaaggtctgggacctgcgccagaacaagctaacctacaccatgagaggccatgcagattcagtgactggcctgagtttaagttctgaaggctcttatcttttgtccaatgcaatggacaatacagttcgtgtctgggatgtccggccatttgcccccaaagagagatgtgtaaagatatttcaaggaaatgtgcacaactttgaaaagaaccttctgagatgttcttggtcacctgatggaagcaaaatagcagctggctcagccgacaggtttgtttatgtgtgggataccacaagcaggagaatattgtataagctgcccggccatgctggctccatcaatgaagtggctttccaccctgatgagcccatcattatctcagcatcgagtgacaagagactgtatatgggagagattcagtgaagatatggactggaagactccaaggccgcttgtctttgagacctcagactgcataagtgatgccaaatgttggatgtccaggctagcaccctcccttcagatgaccattgctagcaagaaacaggaggcggtggccatattccaaaaaccacttctgtcccatttcaccaggatgactaaggcaagctccctgtggcctctaaaaaccacctgccagatttcagggactgtttttttttttctttttcttttttcctgttttctaatgcaggcccaatgtgacaaatttgttggttgggatttttttttttttttgtaactggcttgtatgatattttctttctgtatttctctatatcattttgtattaaaagccaaatagatgcctttttacaag

SEQ ID NO: 21749 - DNA, 574 bp, Homo sapiens
  misc_feature (484)..(484): n is a, c, g, or t
  misc_feature (503)..(503): n is a, c, g, or t
  misc_feature (539)..(539): n is a, c, g, or t
aagctggaagttgtggaggaaggactaatttggaaccaattgcgtggcgcctgagagcggcagcgcggtcagtggcggcgctgaagagaccggttgccgccatgatagaacagcagaagcgtaagggcccagagttgccgctggttccagtcaagcggcagcggcatgagttgctgttgggagcggggtctggcccaggagccgggcagcagcaggcgacgccgggagccttgctgcaagcgggacctccaagatgttcctcccttcaagccccaatcatgctgctctctggacatgaaggggaagtctactgctgcaagttccaccccaacggatccaccttagcatctgcaggatttgaccgactgatattactgtggaatgtctatggtgactgtgataactatgccacactgaagggacacagtggagcagtgatggaattgcattacaacacagatggcagtatgcttttcttagcatnacagataaaccgtggttgntggatagtgaaacagttaaagggtggtaaaggacancttctttggtcctgtatccaccggggcctcttgct

SEQ ID NO: 21750 - DNA, 1887 bp, Homo sapiens
  misc_feature (1734)..(1734): n is a, c, g, or t
aagctggaagttgtggaggaaggactaatttggaaccaattgcgtggcgcctgagagcggcagcgcggtcagtggcggcgctgaagagaccggttgccgccatgatagaacagcagaagcgtaagggcccagagttgccgctggttccagtcaagcggcagcggcatgagttgctgttgggagcggggtctggcccaggagccgggcagcagcaggcgacgccgggagccttgctgcaagcgggacctccaagatgttcctcccttcaagccccaatcatgctgctctctggacatgaaggggaagtctactgctgcaagttccaccccaacggatccaccttagcatctgcaggatttgaccgactgatattactgtggaatgtctatggtgactgtgataactatgccacactgaagggacacagtggagcagtgatggaattgcattacaacacagatggcagtatgcttttctcagcatccacagataaaaccgtggctgtgtgggatagtgaaacaggtgagagggttaaaaggctaaagggacatacttcctttgtgaattcctgttatccagccaggagaggccctcagcttgtctgcactggcagtgacgatggcacagttaagctttgggacatccggaagaaagcagccatccagacatttcagaacacgtaccaggtgttagctgtgaccttcaatgacacaagtgatcagattatttctggtggaatagacaatgatatcaaggtctgggacctgcgccagaacaagctaacctacaccatgagaggccatgcagattcagtgactggcctgagtttaagttctgaaggctcttatcttttgtccaatgcaatggacaatacagttcgtgtctgggatgtccggccatttgcccccaaagagagatgtgtaaagatatttcaaggaaatgtgcacaactttgaaaagaaccttctgagatgttcttggtcacctgatggaagcaaaatagcagctggctcagccgacaggtttgtttatgtgtgggataccacaagcaggagaatattgtataagctgcccggccatgctggctccatcaatgaagtggctttccaccctgatgagcccatcattatctcagcatcgagtgacaagagactgtatatgggagagattcagtgaagatatggactggaagactccaaggccgcttgtctttgagacctcagactgcataagtgatgccaaatgttggatgtccaggctagcaccctcccttcagatgaccattgctagcaagaaacaggaggcggtggccatattccaaaaaccacttctgtcccatttcaccaggatgactaaggcaagctccctgtggcctctaaaaaccacctgccagatttcagggactgtttttttttttctttttcttttttcctgttttctaatgcaggcccaatgtgacaaatttgttggttgggatttttttttttttttgtaactggcttgtatgatattttctttctgtatttctctatatcattttgtattaaaagccaaatagatgcctttttacaagagccatgtggattggatttattgctgtcttttttttgaggcttgattgctataaatcagaatagagcatgatgtggccacagaatacaattcatttaaacttccaaaaaaaaaaaaaaaaaaaaaaaaaaaaaaaaaaaaaaaaaaaataaaaaaaactcgngactagttccacgcacacaccaccacgcccatgtgctcctagttttttttctaaataagcaacctgagacacaaaggataagctttagcagctcatacacgtgacagagccaaattcagccttggcctgactgatttccacatccaagaatcc

SEQ ID NO: 21751 - DNA, 454 bp, Homo sapiens
ggttactacaaacctcttaggggaccgaaacagaaacctttgctatttatgtctcagacatgcagccaccatgaagaaagcaggtaattcgtggaaacgcagctcattagtagccaagatgaaatgaaaaggaaatatatattgcagtaatttaattaagaaactcacaagaggggctgggcatggtggttcatacctgtaatcccagcgctttgggaggccgaggtggcagatcacttgtggtcaggagttcgagaccagcctggccaacatggcgaaaccccatctctactgaaaatacaaaaattcgccgggcatggtggtgtctgcctgcagtctcaggtactagggagcctgaagtgggaggatcacttgaatccaggaggcagaggttgcagtgagccgagatcgcgccattgcactccaacctgggcgacagagtgagactctgtct

SEQ ID NO: 21752 - DNA, 456 bp, Homo sapiens
acaaatacaattagctattgcaaagccttttgggaattattcccagtgtaaataaacacataaccatatagcaagagccttgataaagtccaaaaacatgcaaacttggagtgtctaagagaaaagaccacaatgtaaatgaaaaaccaaataaactcgggcaaaccataggatagggccctgtctgtgatggcctgcatatgatgagccatagaaaaaggatggtgaattctggataataagaaatgtcaatgagatggaagaaccacctgttttatgtaaagctccaaataaccagatcacagtggacagccactcaaataatgccttcataatacagagtattattcaggaattaacttcaattcacagaggagctttaagggcagccaatatttggataggcctgttcagaaaaaaacagaacagtaattatagaaaagaatcatatcctcg

SEQ ID NO: 21753 - DNA, 391 bp, Homo sapiens
ttttcccctaagtccccaaagtccattgtatcattctgatgcctttgcatcctcatagcttagctcccacttatgagtgagaacatataatgtttggttttccattcttgaattactgaacttggaatattagcctccagttccatccaggttgctgccaatgcaattaatttgttcctttttatggctgagtggcattccatcatatacatatgatggaatatatatatacacacatatatatgtatgtatatatacatatatgtatatgcatgtatatatacacatgtacacatatgtatatgtatgtatatatacatatatacatgtgtgtgtatatacacacatatatatacacatatgtatatataccaaagccctcaccaaaatt

SEQ ID NO: 21754 - DNA, 432 bp, Homo sapiens
ccaccacccagctctgtgactttgggctggtcactcatactttttgtgcctcagtttcctcatctgtaaaatgagaatgataacagtatcctagagtactcagtttcaaagaccatgggctagaactcaagacctaatgttccgatccagacccgaagcaagctggggtagctgacctcgaggcagagctgtgggaagagcccactcgtgacctggatgcgaacccttgacttgccagaagtccatgggcaagttctggctcctgtgccagccttagtttccacatctataaaataaagacaggccgggcatggtggctcacgcctgtaatcccagcactttgggaggccaaggcaggcggatcacttgaggtcaggagttcgagaccagcctggccaacatggtgtaaccccatctctactaaaaatacaa

SEQ ID NO: 21755 - DNA, 411 bp, Homo sapiens
aaactcatacatcttacataaaaggaaatcatcagcatttcagacacacctttattggagggtaaaatcacttaagatttgctagttgcctatttttttttaaatcatcttttccagcgataatctgctaaagcatccttccaccctctttgttctccagaatgccagcccctctcaaggtagaggagctggagaagcctgcactgggccgggtccaaggaagcctgtgatttactcctgtggcttgatgagaccaagtcatgtgcatatggtggattatttttcctgactttgtctcaaaattttgtgtagaaaggatgacgattattagatttttccaggggcttgaggtataggaatggggaaaatgtatatggaaatcatgaaactgaattatgagttttggcaaaa

SEQ ID NO: 21756 - DNA, 840 bp, Homo sapiens
ggacaggatggaaggggcatgctggacaagagttaaccgatgacgaagggaaaaaaactcccaaaaaatggagtaaagaccccttttctttaacatgacagtctaaatgaatgtcataattatgaaactttgctaactagatgctgtcaacagtacaccttggaccaatagaaactttgacgttgattttgcttttttcacagtcgtggtcgtggtttgcagtttgttgttggtggtggcagtggtggtggttggttgtggtgagtgtgtctgtgtgtatgtgtttgccagttactggtttctcctaattgtaagaggtttagagggttctttacttcactaatgtagtcttctttgttctggtagttagatcagcccccacggtatttgtggaagacttttcattataagggcttttgaatgtggtttgtgtctaggctttagtaaaactaagaattctagaacagctatttaatgaaaccttgtttctcaagtcttgatttagctacaggcagaaaaaagaaaaaaaaaaaaacaatagcaacattcttgcctcaaccagtaatgcactttggaaatactttctctgagaaacttactccatcagtttgaggctgtcacattgagaaacatgcaatttcggtttttttcctgttatttttcccgtgccattaattaaaactgagcagctacctctgtaaatgcagcggttcaaaatgaactgtgaaaaaggatttttcatttgtgttggatttctaattagaaaactgcattcaaagttgcttagaggtggaaatgttaacatttgtgaataaatggtacttggtgacacacttattt

SEQ ID NO: 21757 - DNA, 389 bp, Homo sapiens
cagcgtcctgaaacctctcgtcccctcccactgaaatccccgatctgtctgaatctgttccttgctgtaaaataaatcctccctcccgcagacctgtggggcccttcggatttcctgccgctgccatgatccttaacaatgcgattgaaaagccagtgctcggctggaaaaaaatccccaggtgccagccggccgcgccttgaccttgctgaaggagcctttaacccggctgccagaggggctctggtccagccgtgggaatccaggaagaaggagggcgccccggaggcggctgggttagctccccgggcagggcgggaatcaggtcgcggcggggaccgcagagggggaggggacgggactccgcggcaacctgtttcccggcgagc

SEQ ID NO: 21758 - DNA, 189 bp, Homo sapiens
gaaaatcgacgttatatgtctacagagtttgaagattcgaatagtttagcaaggcttggtatgaaaaagaactatccttcagccttcctcctctcatccctggattcttcaaggcaatcacattcgactattttagctggttcttttgatattaatcttattatcactaaatgtcatgtttatgtcatt

SEQ ID NO: 21759 - DNA, 654 bp, Homo sapiens
tcttttttttcaggtgggttgggggagaaggagccaattcaatgtctagtctttactggaaagaagaaactttacagcgcattttgagcaatttagtgcagagtctcagtgggtcaactggcggggcaccagatagtaatggatttcacagttagggcattgctgggtctcacctttgtgcagccaaaaactagaggacagcactgttgtactcttcacagatgcagcccactattcacttgttggtgatggaggagactaaattagggtcttctttggtgccagaagcttccttttggagtagtgtattctatgggtccagtccctttcatgcagccattatgacctacatctccagtccagacacatcaccatcagtaggaacaccaccttcagatgccatggagcacatcaaggccacccactggaaccatgggccctcagagtctgcaagggcagcactccaactctgtggcataacctcaaagccatatgctcacgacaagcagcagcacttctgggaacaggcttcagagacaacttgagttcttccttaatttctctcagtaagatttatagttttctatgtacaggttgtgtactttttctttgtgtgaacttattcctatttgaaacttcagatgctgtggaaat

SEQ ID NO: 21760 - DNA, 180 bp, Homo sapiens
acagcacctaaacaagaattatagcctgggaaggtcatttacttgcttactagctgtttcctgtgtcataatgtaagctgcataagggcaggaatcttttctgcctcacctccatatttatagcctcacctccaaaatggtgtctagcacatagaaggcacttaacagatatttgttgaa

SEQ ID NO: 21761 - DNA, 296 bp, Homo sapiens
taattttattaatttgggcttcttatttaaatccctgtctgactcattggctccttctgagaataataacaatacctacattatagggttgttgcagtgattaactgagttatcacatgtaaatcatatagaacataggtgctgagataagctgataagattattagaaatcctgcttgttggccatggctcacacctgtaatcctagcacttggtggggccaaggcaggcagattgcctgaactcaggagttcaagaccagtctgggcaacatggcgaacccgtttctactaaaa

SEQ ID NO: 21762 - DNA, 318 bp, Homo sapiens
ccccaaatgcttaacttcagtcactctttatgatctgagatactacagaagattacaaagtatatagttaactcctcctaatactaatgatgggcaaaaggtaagtagatacacctgtgattaaaaacacagtaagatacaccatgggtaaggagatataccagtgattaaaggacattttaattctttcttcacttttattctaaagattttcataagaaatgtttgctgatttcaactcacatattaatagacatgttgctgacaagttgaataacttcaaattaggttgtaagaaaatgtttaaaaaatgttaaa

SEQ ID NO: 21763 - DNA, 483 bp, Homo sapiens
aaacttttacatcctgtgtctgcggcctctgggtgtgtatatttgcttatcagagaccacaggtgtgagagaagttagaagcactgacttggaaatggacccccagtcttggttctttgggtgaccttgggcaaatcctatctctctgagcctctggttcctcatgtgtaaaatggagagatgttggtttgcatgataataataaaaagctatcttttaactgggcatggtggctcacacctgcagttccagcattttgggaggccgagttgggttgatggcttaagccaggagtttgagaccagcctggtcaacatggtgaaaccctgtctctactgaaaatacgtgctgggatgctcctgtaatcctagctacttgggaggctgaggtatgagaattgcttaaaccctggagacggaggttacagtaagctgaaatcacgccactgcactccagcctggatgacagaacaatactgtctca

SEQ ID NO: 21764 - DNA, 848 bp, Homo sapiens
atagctacaagtttttatgttgagggctggccagtgtggctcactcctgtaatcccagcactttgggaggccttggcaagaggaccgcttgaggccaggagttcaagaccagtgtgggcaacataacaagatactgtctctacaaataataataataattcatgttgaggtttatgatgagcttgcttctttcatctcacacacaaaaaaatgggttgtgttttgttgttgttgtttttggatgtgtatcagggaattaggctaggacaggatttagactagctactaagagaaattaaggagttggtcatgacaggttaaatgtttcctgcccaaaaaattgcctcaaaacttagtggcttaaaagagcaaacacatattatattatctgacagtttctatgggtccaggattaggagcagtttagctatgtggttctagcttaggttctctcatgaaattactgttaaggtgttggccagggctgcagctagaggattcatttccaagatgactcattcatatggctagctaagtgaattgtgcatctatcctaggtaaaagagagtaggaataaagatattttagaagaaatggtaaaaggaacccaggagaactttatcttgctgagaataaagacatttttactaaacaaattagctgactctgttgcagtttcaagttgctataggtggttaaaaataactttgctgtaagggaagcagtatagcattatagttaacagtacactctctgtaatcaagctttctgccttactaattgtgtgacttggacaaatgactgaatttgtgtttcttgtccataaaatgagagataataagagtacc

SEQ ID NO: 21765 - DNA, 382 bp, Homo sapiens
ttttcaaattcagtaggagttgtagcccttacttttgtctcccaggcaagatgctattaggggtcacttcccatgtacggagaaaacaatcttcatggataataatgataaaaccttatggaatgcaaaaacaaccaaaatatgtattctcggatgactgcattagggccaagtcaatattagtcccacttcacccacgcattgcatagtctaaaaatgctgtcagcctgataagaatttcctgatttactctcttttccaatagaaaatgtaggtcatcaaaataaacttctgacactaaaagaacagtagttacactgtcaagtctttttttttttatttcgttagccagttatggtcaaacagtttctttacttgacca

SEQ ID NO: 21766 - DNA, 662 bp, Homo sapiens
atgatagaaaagcatatatttaaatatcaaattataattggatagattatcagaattgaacattaaatctatttaccaagaaagtatgtttatttgtaaatgaaaataaaaatttgaatttcaaaggctaatcattccataaaagtttccatttctattcgtaatttaaattttattttgaaaaagtgatagtctaaggaactcatttaatttttggcctaaatgtgaaatatagaataaaaaacacacatatctattacagaaatacttgagatcctatatgtactatacaaatcctatatgtactgttatctacaaccatttgaacacttatccataaacccctaataagtaccttttgcttcaagacctatattccttagacccaccattagaaaattggatgttcactccagctatatgatatttaaaaaaaaaatgaatcagctgggagcagtggctcacacttgtaatcccagcattttgggaggcagaggatggcttgaggccaggaattcaagaccagcctgggcaacatagtaacaccttgtttctattaaaaaattagttttaaattttaaattacaataaaataaagtgtaagtattaaaaggccacttgtctatttctcacttggaatattaaatgctggaagctgtgtt

SEQ ID NO: 21767 - DNA, 405 bp, Homo sapiens
tatatgggaaaaaccagagacctggaagcactgcagggaagtaattcaatcagcaggttctgctaatgtaataagcgacacaagggtgaaacctgagtagtttacatgtaccagaaatgcccttcagttgaattattgtcttatcatggttgcctgcctgtgcactactgttatgaatattaaaagacagcacagctcactttttccccagatggaaaaggcccaaatcttcatcaccttagtaatttgtttcctcctcttcccactccttaccgcctttagtcaaagctcatgctttgggtttattacttagaaatcttgtccgggataataaagcatacagacttggtgttgtataaaaactaccacactccagcctgggcgacacagtgaaaccctgtctca

SEQ ID NO: 21768 - DNA, 967 bp, Homo sapiens
agaaaaaagataatatactaattcttaattttagtaagtagacagttgtagtgtatggatgttttgttaaatctttgttgatacagaatatataatttcctttttctgtttgtgtgagaagtaaagattgaacaaaaatatgtgagtgctaaactgtctttaaaaagtagataactatatcaaaaagagtaaggaccagtgggcaccatgcagaacaagcaaatagaagctcagcctttgagtagcagctttggtagtatacaaaaatgaactgaaaataggaactcagcagtgttttaagatgacagattaaacaaacatcccaccagaaagaggtaatcacttagactaatttcctcatcccctaggataaaatcttaagtcagtgacttgaaaactattttgacccaatccattgagaaatgcatttttacattgcagcccagcacacacatatgtataactgaagcaagagttgtacttaacaatacttacttatccgtgtgttatgcatcttgatatttcttattctcttttaccccttcctctgtgtgtctgtgtgtattctttttcccccccacccacccgataccgttcaggaaacactacgttgatttcattacctgctaatgtgttgcaacccctttgagatgatcctactagttatgatgagatgcttctaataaaagttacaccagtagaaaatgccaatatttcataaggccaggatgatgacttagatagtactaatattactacactttaggaaagttcatttcattttatttttaggaaggacactaatagagttccataaaagaaaagtctttagtgcatgttatttattattcagggtgtagatactattttaacttccacattctaaattatagtgtgggtatcaatctatgaagtaggtgctgacaagttgtcaacattactgacttttatggtgaagttttaaatt

SEQ ID NO: 21769 - DNA, 241 bp, Homo sapiens
ggcaaacgtgtaacatgcatcccatgtccacttgggggtgaggttctagcattaaaatgaggtggatttggcttttgacttcaaaaggtgagctatagggcacaaagttggtgcacaccctgtcggcgctcaagctggccccgggtctgcagtgttatgaggagagccggtagggccgccctcggtcccagcagagttgtaatggtctgtgttgtaaatcagagttaggaggggtctgaca

SEQ ID NO: 21770 - DNA, 377 bp, Homo sapiens
aaaaaatcctatgctgaggttgctaagaactacagtaagaaagaaattttctatctgtgaaattgtgaagaaggaaaaaaaaactcgttcatagtatattattagtttggtaatatctgtgtttcaggcatccactgggggtcttggaatgtatcccccaaggataaggggggaccagtatacaattgcattaatacagcatcatcaaagagcaggaataaagaaaaatgcaatgatggtagtgggagaaacatttacccatccctaaaaagtgcctctagcaggagaatcgcttgaaccctggaagcggaagttgcagtgagctgagatcccgccactgcactccagcttgggtgacaaagtgagactccatctca

SEQ ID NO: 21771 - DNA, 522 bp, Homo sapiens
ggcacttgagtgtagtcttcagatgcttacagatgtgcacgctgttctataatcatttcttaatccttttgctcccctacttctaaaagtattatgctggatgtggtggaagctgtaaaacaggaatttcccagggcttgtaaggccaggcaggagatcacagtaccttttttaaggctcagaagcaatgtagagaatactggtggaatctcagtctgggtgcagaggttcatcctctttctcctctgctcctagaagcgagatgagcgcagtgtgaagagcacagctgtgcgggttggtagactttggcagtgccacctttgaccatgagcaccatagcaccattgtctccactcgccattaccgagcaccagaagtcatccttggtaagggagggcaaggctgttccaagtgtgtgagatgatgtgagggtgggggccacctaagcctcataacaccttttccctcccattctcacccagagttgggctggtcacagccttgtgatgtgtggagtatagg

SEQ ID NO: 21772 - DNA, 403 bp, Homo sapiens
ttcctcccatgacacatgaaaattatgggaattacaattcaagatgagatttgggtggggacacaaccaaaccatatcagccacttagtcctggatcactttaaaaatggagggctagaactctactccagatttccctaaacccaactctgttctaccctcatattgtcttcatttcagcctagagaaaaggactgaatgtacctcatattcttattttttcccaacttcctgattgcagctattgagcaatagcccatgtgcatgcatttcaaaaaagtaactttccgttaagggggggtttaaaccctgatttaggggaaaatgtaataagcagatttgcataattttgcaaaagctaatacctattttatagcacccaaataaagagagcatgatatct

SEQ ID NO: 21773 - DNA, 239 bp, Homo sapiens
aataataatccttccttcctgagtcagacgggcatggagacgcttctggaaggaacaccgcaatggctgcgcagggacagccccaggtccagttcaaacttgtattggttggtgatggtggtactggaaaaacgactttcgtgaaacatcatttgactggtgaatttgagaagaagtatgtagccaccttgggtgttgaggttcatcccctagtgttccataccaacagaggacctgtt

SEQ ID NO: 21774 - DNA, 450 bp, Homo sapiens
gctgggactacagatgtgtgcctccatgcctggctaactttttaattttttgtagagacgggttcttgcccatgttaccctagactggttttgaacttctaagctctagcagtcctcccactgtggcctgcccaaagtgctgggattacaggcatgaggcaccacacgcagccagaaaatttcagcatattcaaaactagtattacacatcttcgtgtactcattaccccagcctcagggctggcattttgaagcaaatcccaggtactgtaccacttcatctttcaatattttattaatagtatgtgactgtaaaatataaggccaggtgttgtggctcacacctgtaatcccagcactttgggaagccaaggcaggagaatcacttgaacccaggagttggaaagcagcctgggcagcacagtgagatccccaccccatctctaccaa

SEQ ID NO: 21775 - DNA, 458 bp, Homo sapiens
acaataattttacaatgacgatatcttcattttatagatgaggaaattaagtcatagaaagctttactagtgtaagaaagttggtacagtttttagaattggcacagtggagattcaaattctggtctttctgacattttttctactgaacttccctaccttaattcagcttaagtttcttgttgaatgatataaatgaccatctgaagacctgagaacaaaccccaaccttgagatgctgatgtaattggactgaggtgaatccagtgcattcagtcttgaaaagcgttcctggtgatttcaatgcctgatacattttgagaaccactggacaaaattgtattattaactccacccaatagatatcttcctaacagcaaaaataattgcagctctgatttaccaaactggcctgcaggtggaatggaaagtcaacagctgaattaggcagaaatgag

SEQ ID NO: 21776 - DNA, 237 bp, Homo sapiens
tgttatcccagcctgagatcttttgttctcctgtgtcagccggtccctggccaagggctgcagactctcttggggccccagcagactggaggagaagcagcatggtctgcggtctactcttttgtgcacaccaacccacctcttccccagctgacactgctggaggaggagagggaagagatatcatcccctcctatggcaacctgtgggatagcaatggcccttttcctgttgggt

SEQ ID NO: 21777 - DNA, 371 bp, Homo sapiens
aagcacctggcttcagtgctcagaggagcagacacagttgctcactctccactcaaagttggtccaggccttgtgctaattaaaggaggaagcactgctgtagcgcagaaggaaaaggccagtcctccacctgttcagcatgataatgcagctcccctgtggtaagggttggtcggactacaatatctttgtgactttgatgaaagcatctgcagttataatgtggcaaagaaaaggataattccagaatttcccatttccatcatttgagcttgaaatatctgaatagatatttacaaaaccttgtgaagaagtcaccttatttctcatgtttctaatgaacatatataaacttctcatttccagctcta

SEQ ID NO: 21778 - DNA, 324 bp, Homo sapiens
cctcctgagtagctgggattacaggcacaagccaccatacccagctaatttttgtatttttagtagagatggtgtttcatcaagttggtcaacctggtctcgaactcctgacctcaagtgacctgcccacctcagcctcccggagtgctgggattacaggcgtgagctgccgcacctggctgaaaactttaaatcagtgaaagctatctgaatagatgggaaacaactgcctatttttggtgtaaaaagtgtcaatcatttatttgtgatttatatgtaagagggaaaatgttgctgtcatatttactgaaagataaatgctaa

SEQ ID NO: 21779 - DNA, 219 bp, Homo sapiens
ctggggaagggcggcccctccgctgccctctaagcctcagtttcctccgttgtgaaacattgcagttgtactaggtcgtggttctggaggtatgcctgaaggggtgtgcaggagtctgcatgggtatgcacatatgtgttggtgcacgtgttggtgcatgtgtgtgttggaggcagcctatggccgtctgagaagggctatgtctccatgcgtgggtgc

SEQ ID NO: 21780 - DNA, 324 bp, Homo sapiens
aaaagaatggctactccataggcagagcagcagcatgggctgctttaactgaatatacttatagttatttcttgattatatacaagcagttctccagttctctgcagatgctaatgccacgtcctgcaattcaattctgaccttatctacctggagttagtgcagacccaacaggttgaaggctgagtcccaaaagactgtccccacttcagatgccagtcgcacaagtgatgagtctccaggttatcctcaacttctgtccaactcaactacagatcagaggttcccatggccccctactcaggttctataatttgctagaag

SEQ ID NO: 21781 - DNA, 339 bp, Homo sapiens
tatgtacacattgtgatcagtgctgtgaagaaagataataaagggcgctgtggaggacagcctccacgatcccccatgatccctacctcctggaattcaagcccttatttcgtaccttccccttgtatgggggtaggactcattgacttgatgatcacagacactaaagcaaaagtgttggagtgtgacctctgagattgggttataaaaagactgtagctggctgggcacagtggctcacacctgtaatcccagcactttaggaggccaaggcaggaggattgcttgagcccaagaattcaagaccagcttggacaacataggaagaccctgactcta

SEQ ID NO: 21782 - DNA, 435 bp, Homo sapiens
accctaatccgatgtgactggtgtccttagaagaagaggacatttggatacgcagagacacacagaggaatgaccctgtgaggacacgatgaaagatcacatctacaagtcatgagagaggccttgggagaaaccgaccctgcccatgctttgatctcgacttccagcctccagagctgtgagaaaatagatttctgggtttcagctgcccagtgtgtagtatttgttatggcagcctgcatagaataatacaagcactcgaggtgtccccggcattgttacgggtgaaggagacatggtgaatgaacaccaggcaatgccctcttgtcttatgttctagtggaaaatccacatacaatttgctgaagagcgtagctgaacgagtgagtgtataaatgaattaataaataaactatttttccagagttcacaaaa

SEQ ID NO: 21783 - DNA, 191 bp, Homo sapiens
ttactttaatgcataactgtatgttatacatatgttataatgtataaaaatttattttaagatataccaaatcatgagtagttttattttttaactactagctccacaacatcttacctacatggcttctctttactttttaacattgagtatacctctttttttttttgagacagagtctctctgtgtcg

SEQ ID NO: 21784 - DNA, 478 bp, Homo sapiens
aagcgtggtctgagcacaccccttatcaaaatttggcaacctagaataaatgcaggttcctggatcctgccccagacctaatcacatccccaagggtgagtctgcaaggcaatcttctacaaccaccatctgagtcctaaagcaggcttccccaggagcctaagtcctaattctaaatccatataatctagtgataacaatcccttgcccatgtaaccctctcaagtctgagatccttgatctttgcacaaccgagtgcaggaggcaaggtttcgcgcagggccccctttcagaagaccggtaaggtgagttgccctcggtggaatgggactagacctggtgtcaacacaccgcgcggtctggagagaggttcccagtccctgcctgccgggtgggagctgggacctaagacccaggtggccatctgtcgcgacccccagcctagggcaggtccagagtccttcctctgaccctctcc

SEQ ID NO: 21785 - DNA, 355 bp, Homo sapiens
cagtcacttccctgcttaaaaacttctactgactctctactgctctgaaggtaaaaggcgaactccttaccatgagatacaaggtctgttatgagtttgaccctgcttccttcacctctgcaaactgccgttcatcttctctgctctagctatgctatgcctggaatgtagcattatttctcatgtttgtagctttgcacatgcctccttctgtctgcaatgctcattcatcaaaattcagctcagatgtaaccttttccagaaagccttctgggaccttcttcattagggttgccgagcaaaatactgcttaggatacacttatgctgaaaaattattgttgtttattggcaat

SEQ ID NO: 21786 - DNA, 657 bp, Homo sapiens
atctcatattgtgggattgcaattaccttgcccaagaaaagattatttacgattccattgtttatattgtttgttgaaataattaattctcaaaacttctggatacctgagactcagctaggaacttatttttaaaatataaattcctagtcccactccctaaagattctgagttagtacattcaggatggggtctaggaatcagtgtgtttaagaagtgcatcaggttcttctggtactgattgtccatgaaccacactttgagaaagctccatctaaagagataagttactgacgtgtgttaccagagagagcctagaaaacctgggcacaacagtagttgttaagaactaccagacctgggccaggcccggtggctcatgcccgtaatcttagcactttgggaggctgaggcgggtggatcacttgagcccaggggtttcagatcagtctgggcaacatggtgaaaccctacctctacaaaaaatagaaaaaattagctgggcatggtagtgcatgcctgtggtcccagctacttgggaggctgaggttcgagggttgcttgagcctgggaggtcaaagctgcagtgagccaagatcatgccactgcactccagcctgggagagtgtgagaccttgtctcagaaaaaaaaaaaa

SEQ ID NO: 21787 - DNA, 317 bp, Homo sapiens
aatgatcctatcacccaagtgcttgttacttagccctctttagtattctcctcattctcatgctccccttctggtcaaagcccaaaactcagatagcatagagagcagtgccccttaggacaatctgcacttccttaagaattcctttgaaggagtgaaataccaacatgaggcagtcctctcctcttctgatgttcccctctcctgtttaccttcctataagtaccgaacaaagtaagtaggtatatcagtcttaagggcttcccatgccataagatataacttaaagcagttatatcttatgaaggaaattattt

SEQ ID NO: 21788 - DNA, 103 bp, Homo sapiens
ttaccgcccaccaaattctccttaagaaccctagcctctgagttcttgtggggactgatttgagaaataaactcccatcctttcacttggctagctctgtgtt

SEQ ID NO: 21789 - DNA, 208 bp, Homo sapiens
tcccaggcttgaagaactgaaatgtaatgtcttttactaaagttgttgatattaccataactttgtataatcccatcctgaactttccatggatgatgaattataattaagtcctaatgccaagctttcccaggaaagaaaggcataaggattcagctcacaatttctaagctcttcctctctcatccttttaactcatcctatttaa

SEQ ID NO: 21790 - DNA, 407 bp, Homo sapiens
gcagctgcccatataaaagtaaatatgtaactgggcatgctgatgcacaggtactcacatactcgagaggctgaggtaggaggctctcttgaggctgggaatccaaggctgcagtgtgctgtaattgcacctgcaaatacgcattgcactccagcctgagcaacatagtgagaacctgtcactatttggtaagtaaaaattgtaaatatgtactagtggcttaggtttatgactgtcttgagaattatttattttctctgtcctcaacacagtcctgtagagtaggaaagtctttgtccaaggagttccaagttacaagcaccacatacctttgtgtatgtatcattatattttgccatatcactggaaatgggatttctgagtcacggaggaaattcatacgtaat

SEQ ID NO: 21791 - DNA, 477 bp, Homo sapiens
ggaagatccaagagcaagcttccaagaggaccagacagaagctgtgtattgcccttttacagcctaggcttggaagtcacatagtgtcacttcagcagcagtcacaagcctgcctggattgaaggggaagaaatgcagaacccgcctcatgctgggagggaggtcaacgtcactctgtgagaagagcttctgggatgggagacgtcgttctgaccatcttgcaaataacatttgccacgttcctcctctggcaacaatttacattcttcatatctgcaaaatgatgccttatttccttcccgtgagattcccaaaccgcatcccatcagggcatccgcttcaagtccagcatctcatcattgaaatcaagtccagctgcagatgaggcttctcagatgggattctttgaacgtagttccttgagtgttaatcttacggatttaaagatctgttaatgaaagatacaagttacctaca

SEQ ID NO: 21792 - DNA, 6679 bp, Homo sapiens
  misc_feature (1874)..(1874): n is a, c, g, or t
  misc_feature (5539)..(5539): n is a, c, g, or t
  misc_feature (5563)..(5563): n is a, c, g, or t
  misc_feature (6330)..(6330): n is a, c, g, or t
  misc_feature (6468)..(6468): n is a, c, g, or t
  misc_feature (6617)..(6617): n is a, c, g, or t
gcggcggcccaagcggtttcaaacggcttagagcaggccgcttggttctgacccagctgaggaaatactcttaattctaaggaaaacctggaagcacaatgggagatgacagtgagtggttgaaactgccagttgatcagaaatgtgaacacaagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaaaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaagtgaatttggttccaaaatcatcttgcttaagccaattatcaaagtgttgccaaaactctttgagtctcgagagaaggctgttcgagatgaagccaaactaattgctgtggagatttacagatggattcgggatgctctgagacccccattacaaaatataaactctgttcagttgaaagaactagaagaagaatgggtcaaactgccaacaagtgctcctagacctactcgatttcttcgttcccaacaagaactagaagctaaattggaacaacaacagtctgctggtggagatgctgaaggaggtggtgatgatggtgatgaggtgccacaaatagatgcttatgagcttttagaagctgtagaaatcctttccaaacttcccaaagacttttatgacaaaattgaggcaaaaaaatggcaagagagaaaagaggccctggagtctgtagaagtactaataaaaaaccccaaactggaagctggcgattatgcagatttagtaaaagcattaaagaaggttgttggaaaggacaccaatgtcatgttggtggctttggcagcaaaatgtcttactggcctggctgttgggctaaggaagaaatttggacaatatgcaggacatgttgtgccaaccatcttggagaaattcaaagagaagaaacctcaagtggtacaagccctgcaggaggcaattgatgcaatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcagtaaaaccattcctagctgatgtggacaaactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgngaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttgacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagnaaagggagcatctcgaatagatgnaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggngtcattgtggcacaagtatttgtacatactctgcttctctctgtcagcgtcctgctgctctagaagactgtccgtggatgagtttagtgtacagacttgtaaacagctgccccctctctgctcagtctagttcccagntccttttctttttaattgctcatttgtaaaattgtcctaatctttcctagctttttaatagttaatattagaaactctttaatagttttcctttcagtttgtgagctcttctctgtcgccctgaagggtcactgtattctgtatgaatncatggcatgatacaactaatttaagagtcttttataaataaagtttgcattaactatacctg

SEQ ID NO: 21793 - DNA, 6499 bp, Homo sapiens
  misc_feature (1874)..(1874): n is a, c, g, or t
  misc_feature (5359)..(5359): n is a, c, g, or t
  misc_feature (5383)..(5383): n is a, c, g, or t
  misc_feature (6150)..(6150): n is a, c, g, or t
  misc_feature (6288)..(6288): n is a, c, g, or t
  misc_feature (6437)..(6437): n is a, c, g, or t
gcggcggcccaagcggtttcaaacggcttagagcaggccgcttggttctgacccagctgaggaaatactcttaattctaaggaaaacctggaagcacaatgggagatgacagtgagtggttgaaactgccagttgatcagaaatgtgaacacaagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaaaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaagtgaatttggttccaaaatcatcttgcttaagccaattatcaaagtgttgccaaaactctttgagtctcgagagaaggctgttcgagatgaagccaaactaattgctgtggagatttacagatggattcgggatgctctgagacccccattacaaaatataaactctgttcagttgaaagaactagaagaagaatgggtcaaactgccaacaagtgctcctagacctactcgatttcttcgttcccaacaagaactagaagctaaattggaacaacaacagtctgctggtggagatgctgaaggaggtggtgatgatggtgatgaggtgccacaaatagatgcttatgagcttttagaagctgtagaaatcctttccaaacttcccaaagacttttatgacaaaattgaggcaaaaaaatggcaagagagaaaagaggccctggagtctgtagaagtactaataaaaaaccccaaactggaagctggcgattatgcagatttagtaaaagcattaaagaaggttgttggaaaggacaccaatgtcatgttggtggctttggcagcaaaatgtcttactggcctggctgttgggctaaggaagaaatttggacaatatgcaggacatgttgtgccaaccatcttggagaaattcaaagagaagaaacctcaagtggtacaagccctgcaggaggcaattgatgcaatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcagtaaaaccattcctagctgatgtggacaaactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgngaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttgacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagnaaagggagcatctcgaatagatgnaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggngtcattgtggcacaagtatttgtacatactctgcttctctctgtcagcgtcctgctgctctagaagactgtccgtggatgagtttagtgtacagacttgtaaacagctgccccctctctgctcagtctagttcccagntccttttctttttaattgctcatttgtaaaattgtcctaatctttcctagctttttaatagttaatattagaaactctttaatagttttcctttcagtttgtgagctcttctctgtcgccctgaagggtcactgtattctgtatgaatncatggcatgatacaactaatttaagagtcttttataaataaagtttgcattaactatacctg

SEQ ID NO: 21794 - DNA, 464 bp, Homo sapiens
tagcaacggatcatgctagtccccatggttactgggaactgagctcaagtggattgttatcctgaacaagtctgtgtcaggatattcttgtcacctttcagctctttggtatttgctctctttcttgaatcagcaaaagaaatcgctgtaaagttaatgtaatttacgggaagttcccgtgccacactgcatgcttttgtgtgtcacaagacttaagcttcctgctaccctctgttaaaggagaactttttatgttcctaacaatatacgattctttcaggagctatttacatagctgggttggttaatagacaactggggactgggctataagcattttgacctggaaatatttctttggggttatgtgaactactgtacaataaaacctcaattaactaggattacttggagaaaagacagtttctggttgaattttcttttaaatggaaggttaaacactt

SEQ ID NO: 21795 - DNA, 327 bp, Homo sapiens
ccctgtcccggatactggttaaaatttgcaccatcaccaaggagattaaggatgggaaggtcatttcttcttacgagcatgtgcagccttgtttcatcatcagacctgccaaagtctaacatcccaaggtgatgaaaatgacccacatttatgaaacagaggccaatacatgctcctgccagagaggtttaagaaaactccccagtcccttaaggtacttagtttcttactactacagcgggtccccattgctaggtagaatatcttttattctgctccttccctaactcaccactgctaacatgataataaattacatttctctgg

SEQ ID NO: 21796 - DNA, 476 bp, Homo sapiens
tactgtggctattgaagaaaggtttgctttttggcaacactgaaacagatttaaattcatattgaaacaaatgacgcaagcatctctagttaaaatagctttgttgggagaactggctagccatatgcagaaaattcaaactgaaccccttccttataccttatgcaaaaattaactcaagatagattaaagacttaaatgtaaaactgaaaatgataaaaaccctagaagaaagtctaggcaataccattcaggacataggcacgggcaaagatttcatgatgaaaatgtcaaaagcaattgcaacagaagcaaaaattgaccaatgggacctaattaaatgaaagagcttctccacagcaaagaaactatcatcagagtgaacaggcaacctacagaatgagagaaaatttttgcaatctatccatctgacaattctaacatctagaatctacaaggaacttaaacaaatttgc

SEQ ID NO: 21797 - DNA, 417 bp, Homo sapiens
ttagctaggcgtggtggtgcatgcctgtaaccccagctactcaggaggctgagttgggagaatcactggaacccaggaggcagaagttgtagtgagccaagattgtgccactgcactctagcctgggtgacagagcaagactccatctcaaaaaaaaagaaaaaagaaaaagaaaaagtcagaaacatcttgaggcaggcatagtgctgtcatctgtccaatattgaagatgatttaagaataagaaagaagagaacaaagaagagacaaagaagttgccttaggtgtacccacccagaaaaggacaaaggcattcttgtagtcattgtgttgtattttagctcttaaactttttaagagattagaataatttgacacatagaagatctaaaccactgaagaggctctgaagcagat

SEQ ID NO: 21798 - DNA, 411 bp, Homo sapiens
atgggttttgacagatgtatgtacccctcaaaccccagtcccactcaagatccagaacatttccatccctacaaaagttttctttgcagcttctctttctctctctctcaacactgcattcacttccaagtctggcctctgtgtcattaatttgatcttcagccatgtttcttctgttttttcctagttatgaattgttagacttgtgacaatagtgttattatgtttcacagttggtttccattttcccttttactctgttgttttatcatctcatctcgaaactctcacatcagtgaaatgatattctttttaagttcttccatgtgcaaagacgtaggtaacacagcctgttcctctggttgtgttttgcccagacatggctctttcaatgtattcctttctttcttt

SEQ ID NO: 21799 - DNA, 224 bp, Homo sapiens
agaactgccataccattttccaaagtggctgcaccattttactttcccacaaataatgcacaaacagttactatttcttcacatccttgccaacatttgctattttatgttgttttccttcaagaccagaatgagataccactttaaatctattttatgatagacatatatatacaatatatatatatacatatagccatactaaaatacatgtaaagtggtat

SEQ ID NO: 21800 - DNA, 380 bp, Homo sapiens
aatcagtcctggctaaaggctgagaaacttaagattgtaagcccaaattccacccaatcactgtaactaaactgctgctcccaaagaaaccagttttatcatccatttctgcagaacgtcatctaaatggattccgctttcattcatgtccttatccagtaagaggaagcttctgatttttccagcagagggttttatttagaagcatattcacatttaatttggttttagaaaacccttaatgttttttaatattgagctaggttgagttcaggggattgagaaaaaagactaaaagctttgcatatagctagcatgctcgtgctattattgaacatgcaagaaaagtgacggctcaatattgcactaggttaagaaaa

SEQ ID NO: 21801 - DNA, 225 bp, Homo sapiens
attcataaaaacaggcaaggggtcagatttggcctgcaggccacagtttgccaaccttggatctaaaggaagaacattctaggcagccggtacagccgaatgtaaaaatgaatgcgcttaatgaatttgaaggctagcatgaggaggccatgtacctagaggttggaattgagtggacaggggcaggagattaggccagaaaggtaggcaggggctggatcttag

SEQ ID NO: 21802 - DNA, 1020 bp, Homo sapiens
ccaggtcacagacttaggcagatcttccagaggttgacacgtttcattacacagtatccaaaaatccagtttttgaacttgaccacccatctctttgaagtctttaagtgttgtgaagttcagagtggcagatacatatttccaaaattttaattttttgcttgaaagctgtaattttcactaacaaacactgccagttgtttgccttgaaatgacaggcttattttgttcatgttcaagaaaatgtctagcagatacccaagagtaaataattatagtttgtgtcaatcattcttccaagtaaaaatggtggtccataaaaaaaagtggttagttccactcacaactcggttacataagtgctttttcttgagacatttatcaagtgcaattaaagtgttatgtggacatcatcttgtcacaagaatgttaaaaacgtatatactccctggttgagttttaataaaaagaataatgtttactcatccaggacattcttaagtgaaaccagttttgttttgttttttactataaatttgtggcagtgaagagtttttgccaaggtgccagcaatttcacccaccattggttttgcacatcagcacagatgtcagcacaacaaaaaggacaactgacatcttagtggtatttagaaaatagttgtgaccaaatggagccactgaaaggactcagggggccctgggggtctgcacactgtactttgaggatcactgatttatggaaaggctcattgtctacattttttttcttcctgcctttaggatttgagattaaagagcttcttctctactaaaaccaaccaggcttactaggactgttggcagggtttggagtgatggcagtaattctttgtttaatattaagaagggtgttgcggccaggtgtggtggctcatgcctgtaatcccaacactttgggcagccaaggcaggagggttgctgaggctagttttgagaccaggctgggtgaaaaagcaggactccatccctacaaaaaaaa

SEQ ID NO: 21803 - DNA, 876 bp, Homo sapiens
ccaggtcacagacttaggcagatcttccagaggttgacacgtttcattacacagtatccaaaaatccagtttttgaacttgaccacccatctctttgaagtctttaagtgttgtgaagttcagagtggcagatacatatttccaaaattttaattttttgcttgaaagctgtaattttcactaacaaacactgccagttgtttgccttgaaatgacaggcttattttgttcatgttcaagaaaatgtctagcagatacccaagagtaaataattatagtttgtgtcaatcattcttccaagtaaaaatggtggtccataaaaaaaagtggttagttccactcacaactcggttacataagtgctttttcttgagacatttatcaagtgcaattaaagtgttatgtggacatcatcttgtcacaagaatgttaaaaacgtatatactccctggttgagttttaataaaaagaataatgtttactcatccaggacattcttaagtgaaaccagttttgttttgttttttactataaatttgtggcagtgaagagtttttgccaaggtgccagcaatttcacccaccattggttttgcacatcagcacagatgtcagcacaacaaaaaggacaactgacatcttagtggtatttagaaaatagttgtgaccaaatggagccactgaaaggactcagggggccctgggggtctgcacactgtactttgaggatcactgatttatggaaaggctcattgtctacattttttttcttcctgccttggctgcccaaagtgttgggattacaggcatgagccaccacacctggccgcaacacccttcttaatattaaacaaagaattactgccatcactccaaa

SEQ ID NO: 21804 - DNA, 689 bp, Homo sapiens
agcacagatttagtaccgtaatctgccctagaaccgtagccttccttagccattgccattttgtcttgcttcctctgcctagtctctaggacaggtggtttaactacattttagcttatactgtaggggtcatcaggggaagataggttttgtgggtcatcatggaggtagtattaaacctcattaatttgggctaattgggggaaaacctagtgagagtgttgtaggttatttttctttagatgcagctgttactttgagttcatacagtaattgaaactaggctaatagtgttaccaggttattttgttagatagagatccttgtacctggtttaatgaatagctgagaatggtgtgcaaattaactttaattgtatgtaaattagacttgaaatgcttaaaaacagctcattaaacatttctccctgcaatcttatttacactgttttcttagtctttattagagtgcagaggtaaacttcagctcagttctgaatatatctcaactttcatgtgtggagtctatattaataaagtgtggctgtagcgttcagagaattttagaaagatatttgagaagtaaagaggaacagcatctgaaagtcagacatctggcagtctcagccagtcagaatgtgtttccttgcgtctttaaaagtaagctgtttttctcctgctgctttcgga

SEQ ID NO: 21805 - DNA, 1119 bp, Homo sapiens
gagataattcttctcccctgactggacctctggcagcagcttcactaaggtgggatggatagcagggtctcaggcacaaccagtaatggagagacaaaaccagtgtatccagtcatggaaaagaaggaggaagatggcaccctggagcgggggcactggaacaacaagatggagtttgtgctgtcagtggctggggagatcattggcttaggcaacgtctggaggtttccctatctctgctacaaaaatgggggaggtgagatgagagcccttgtgccaccccacccactcctggaaggaggatacttccatctcctgcacttacggcccctctggggagtcccatagatgtatagaattctggaggtaggaggacgcttagaggtcattaaggacactctgtaagagactaagacctagaaaggttacgtgactatcccagggctctttctattataacgtggcatcgtagaaatatgagcacaagctggaaccaggtggatgagagtttggattctggctctgctacttaacactctgtgtgatcttggacaagttacttaagctctcagagcatcaattgccgctcctgcaaattgagataataatgcctgcctttcaaggtcattgtaaggattagagacaatgtgtgtaaagcacttaataaatagtagctctgctgatgatgacgttgataaccaaactgttctgtggtcttaagtaataaatagtagctctgctgatgatgacgttgataaccaaactgttctgtggtcttaagtaataagtagtagctctgttgatgatgacgttgataaccaaactgttctgtggtcttaagtaataagtagtagctctgctgatgatgacgttgataaccaaactgttctgtggtcttaagtaataaatagtagctctgctgatgatgatgttgataaccaaactgttctgtggtcttaagtaataaatagtagctctgctgatgatgacgttgataaccaaactgttctgtggtcttaagtaataaatagtagctctgctgatgatgacgttgataaccaaactgttctgtggtcttaagtaataaatagtagctctgctgatgatgacgttgataac

SEQ ID NO: 21806 - DNA, 2114 bp, Homo sapiens
gagataattcttctcccctgactggacctctggcagcagcttcactaaggtgggatggatagcagggtctcaggcacaaccagtaatggagagacaaaaccagtgtatccaaagatggagtttgtgctgtcagtggctggggagatcattggcttaggcaacgtctggaggtttccctatctctgctacaaaaatgggggaggtgccttcttcatcccctacctcgtcttcctctttacctgtggcattcctgtcttccttctggagacagcactaggccagtacactagccagggaggcgtcacagcctggaggaagatctgccccatctttgagggcattggctatgcctcccagatgatcgtcatcctcctcaacgtctactacatcattgtgttggcctgggccctgttctacctcttcagcagcttcaccatcgacctgccctggggcggctgctaccatgagtggaacacagaacactgtatggagttccagaagaccaacggctccctgaatggtacctctgagaatgccacctctcctgtcatcgagttctgggagcggcgggtcttgaagatctctgatgggatccagcacctgggggccctgcgctgggagctggctctgtgcctcctgctggcctgggtcatctgctacttctgcatctggaagggggtgaagtccacaggcaaggtggtgtacttcacggccacatttccttacctcatgctggtggtcctgttaattcgaggggtgacgttgcctggggcagcccaaggaattcagttttacctgtacccaaacctcacgcgtctgtgggatccccaggtgtggatggatgcaggcacccagatattcttctccttcgccatctgtcttgggtgcctgacagccctgggcagctacaacaagtaccacaacaactgctacagcggcaccagctttgtggccggctttgccatcttctccatcctgggcttcatgtctcaggagcagggggtgcccatttctgaggtggccgagtcaggccctggcctggctttcatcgcttacccgcgggctgtggtgatgctgcccttctctcctctctgggcctgctgtttcttcttcatggtcgttctcctgggactggatagccagtttgtgtgtgtagaaagcctggtgacagcgctggtggacatgtaccctcacgtgttccgcaagaagaaccggagggaagtcctcatccttggagtatctgtcgtctccttccctgtggggctgatcatgctcacagagggcggaatgtacgtgttccagctctttgactactatgcggccagtggcatgtgcctcctgttcgtggccatcttcgagtccctctgtgtggcttgggtttacggagccaagcgcttctacgacaacatcgaagacatgattgggtacaggccatggcctcttatcaaatactgttggctcttcctcacaccagctgtgtgcacagccacctttctcttctccctgataaagtacactccgctgacctacaacaagaagtacacgtacccgtggtggggcgatgccctgggctggctcctggctctgtcctccatggtctgcattcctgcctggagcctctacagactcggaaccctcaagggccccttcagagagagaatccgtcagctcatgtgcccagccgaggacctgccccagcggaacccagcaggaccctcggctcccgccacccccaggacctcactgctcagactcacagagctagagtctcactgctagggggcaggcccttggatggtgcctgtgtgcctggccttggggatggctgtggagggaacgtggcagaagcagccccatgtgcttccctgcccccgacctggagtggataagacaagaggggtattttggagtccacctgctgagctggaggcctcccactgcaacttttcagctcaggggttgttgaacagatgtgaaaggccagtgccaagagtgtccctctgagacccttgggaagctgggtgggggctggtaggtggggcgagacttgctggcttcgggccctctcatccttcattccattaaatccacattcttcccgctgactgctagcg

SEQ ID NO: 21807 - DNA, 2268 bp, Homo sapiens
gagataattcttctcccctgactggacctctggcagcagcttcactaaggtgggatggatagcagggtctcaggcacaaccagtaatggagagacaaaaccagtgtatccagtcatggaaaagaaggaggaagatggcaccctggagcgggggcactggaacaacaagatggagtttgtgctgtcagtggctggggagatcattggcttaggcaacgtctggaggtttccctatctctgctacaaaaatgggggaggtgccttcttcatcccctacctcgtcttcctctttacctgtggcattcctgtcttccttctggagacagcactaggccagtacactagccagggaggcgtcacagcctggaggaagatctgccccatctttgagggcattggctatgcctcccagatgatcgtcatcctcctcaacgtctactacatcattgtgttggcctgggccctgttctacctcttcagcagcttcaccatcgacctgccctggggcggctgctaccatgagtggaacacagaacactgtatggagttccagaagaccaacggctccctgaatggtacctctgagaatgccacctctcctgtcatcgagttctgggagcggcgggtcttgaagatctctgatgggatccagcacctgggggccctgcgctgggagctggctctgtgcctcctgctggcctgggtcatctgctacttctgcatctggaagggggtgaagtccacaggcaaggtggtgtacttcacggccacatttccttacctcatgctggtggtcctgttaattcgaggggtgacgttgcctggggcagcccaaggaattcagttttacctgtacccaaacctcacgcgtctgtgggatccccaggtgtggatggatgcaggcacccagatattcttctccttcgccatctgtcttgggtgcctgacagccctgggcagctacaacaagtaccacaacaactgctacagcggcaccagctttgtggccggctttgccatcttctccatcctgggcttcatgtctcaggagcagggggtgcccatttctgaggtggccgagtcaggccctggcctggctttcatcgcttacccgcgggctgtggtgatgctgcccttctctcctctctgggcctgctgtttcttcttcatggtcgttctcctgggactggatagccagtttgtgtgtgtagaaagcctggtgacagcgctggtggacatgtaccctcacgtgttccgcaagaagaaccggagggaagtcctcatccttggagtatctgtcgtctccttccctgtggggctgatcatgctcacagaggaacgacaaagtaggcaggtccctcctctggcctttgggcatggaccacccacctccagggatgggtgaggagccatttggctccacagtaagtgaagagggcggaatgtacgtgttccagctctttgactactatgcggccagtggcatgtgcctcctgttcgtggccatcttcgagtccctctgtgtggcttgggtttacggagccaagcgcttctacgacaacatcgaagacatgattgggtacaggccatggcctcttatcaaatactgttggctcttcctcacaccagctgtgtgcacagccacctttctcttctccctgataaagtacactccgctgacctacaacaagaagtacacgtacccgtggtggggcgatgccctgggctggctcctggctctgtcctccatggtctgcattcctgcctggagcctctacagactcggaaccctcaagggccccttcagagagagaatccgtcagctcatgtgcccagccgaggacctgccccagcggaacccagcaggaccctcggctcccgccacccccaggacctcactgctcagactcacagagctagagtctcactgctagggggcaggcccttggatggtgcctgtgtgcctggccttggggatggctgtggagggaacgtggcagaagcagccccatgtgcttccctgcccccgacctggagtggataagacaagaggggtattttggagtccacctgctgagctggaggcctcccactgcaacttttcagctcaggggttgttgaacagatgtgaaaggccagtgccaagagtgtccctctgagacccttgggaagctgggtgggggctggtaggtggggcgagacttgctggcttcgggccctctcatccttcattccattaaatccacattcttcccgctgactgctagcg

SEQ ID NO: 21808 - DNA, 1552 bp, Homo sapiens
cgcattcttttaggactaccttgatttattccgtccctgggctggtggggccgaggagtgtcggaggagagccagtgctttgcgtggtcctctgaattctgccaggtagccctgctccggcgtccgtgaaggggccaggacagtgtccgccaggaggggctgtgctcccagacaggaagcaggagaggttgcagccctgttctgaccctgccattccgccctctcctcacccctgccccacagggactgcatcgccctctgcttcctcaacagcggcaccagctttgtggccggctttgccatcttctccatcctgggcttcatgtctcaggagcagggggtgcccatttctgaggtggccgagtcaggccctggcctggctttcatcgcttacccgcgggctgtggtgatgctgcccttctctcctctctgggcctgctgtttcttcttcatggtcgttctcctgggactggatagccagtttgtgtgtgtagaaagcctggtgacagcgctggtggacatgtaccctcacgtgttccgcaagaagaaccggagggaagtcctcatccttggagtatctgtcgtctccttccctgtggggctgatcatgctcacagaggaacgacaaagtaggcaggtccctcctctggcctttgggcatggaccacccacctccagggatgggtgaggagccatttggctccacagtaagtgaagagggcggaatgtacgtgttccagctctttgactactatgcggccagtggcatgtgcctcctgttcgtggccatcttcgagtccctctgtgtggcttgggtttacggagccaagcgcttctacgacaacatcgaagacatgattgggtacaggccatggcctcttatcaaatactgttggctcttcctcacaccagctgtgtgcacagccacctttctcttctccctgataaagtacactccgctgacctacaacaagaagtacacgtacccgtggtggggcgatgccctgggctggctcctggctctgtcctccatggtctgcattcctgcctggagcctctacagactcggaaccctcaagggccccttcagagagagaatccgtcagctcatgtgcccagccgaggacctgccccagcggaacccagcaggaccctcggctcccgccacccccaggacctcactgctcagactcacagagctagagtctcactgctagggggcaggcccttggatggtgcctgtgtgcctggccttggggatggctgtggagggaacgtggcagaagcagccccatgtgcttccctgcccccgacctggagtggataagacaagaggggtattttggagtccacctgctgagctggaggcctcccactgcaacttttcagctcaggggttgttgaacagatgtgaaaggccagtgccaagagtgtccctctgagacccttgggaagctgggtgggggctggtaggtggggcgagacttgctggcttcgggccctctcatccttcattccattaaatccacattcttcccgctgactgctagcg

SEQ ID NO: 21809 - DNA, 785 bp, Homo sapiens
gagataattcttctcccctgactggacctctggcagcagcttcactaaggtgggatggatagcagggtctcaggcacaaccagtaatggagagacaaaaccagtgtatccagtcatggaaaagaaggaggaagatggcaccctggagcgggggcactggaacaacaagatggagtttgtgctgtcagtggctggggagatcattggcttaggcaacgtctggaggtttccctatctctgctacaaaaatgggggaggtgagatgagagcccttgtgccaccccacccactcctggaaggaggatacttccatctcctgcacttacggcccctctggggagtcccatagatgtatagaattctggaggtaggaggacgcttagaggtcattaaggacactctgtaagagactaagacctagaaaggttacgtgactatcccagggctctttctattataacgtggcatcgtagaaatatgagcacaagctggaaccaggtggatgagagtttggattctggctctgctacttaacactctgtgtgatcttggacaagttacttaagctctcagagcatcaattgccgctcctgcaaattgagataataatgcctgcctttcaaggtcattgtaaggattagagacaatgtgtgtaaagcacttaataaatagtagctttccccctcacgaatccgggacctaaacctccgtccgggggttgaggagagacccggggcttgagtggcgaaccgggactgggggtgaccggggcgatcagtgcggccg

SEQ ID NO: 21810 - DNA, 1010 bp, Homo sapiens
gagataattcttctcccctgactggacctctggcagcagcttcactaaggtgggatggatagcagggtctcaggcacaaccagtaatggagagacaaaaccagtgtatccagtcatggaaaagaaggaggaagatggcaccctggagcgggggcactggaacaacaagatggagtttgtgctgtcagtggctggggagatcattggcttaggcaacgtctggaggtttccctatctctgctacaaaaatgggggaggtgccttcttcatcccctacctcgtcttcctctttacctgtggcattcctgtcttccttctggagacagcactaggccagtacactagccagggaggcgtcacagcctggaggaagatctgccccatctttgagggcattggctatgcctcccagatgatcgtcatcctcctcaacgtctactacatcattgtgttggcctgggccctgttctacctcttcagcagcttcaccatcgacctgccctggggcggctgctaccatgagtggaacacagaacactgtatggagttccagaagaccaacggctccctgaatggtacctctgagaatgccacctctcctgtcatcgagttctgggagcggcgggtcttgaagatctctgatgggatccagcacctgggggccctgcgctgggagctggctctgtgcctcctgctggcctgggtcatctgctacttctgcatctggaagggggtgaagtccacaggcaaggttcgtgtggggagctcctgcccctcccattcccggactcctgccctcactgggggctgtcacccaggagttctctaagctgtggccccgttgaggatgggaggcgatgacccagcgaggatttgatgtggctcccttccttgattctccgcctctcctagactcacatacttctggtttttgggactggaagagagcgagaaaggcaggaaggacacctccagggtaatctgatcttggaactgacgatgggtgggcac

SEQ ID NO: 21811 - DNA, 377 bp, Homo sapiens
tctgtggccccacgctgggaagccatgggtcacccacagcctggagctggcccgggcactggcccgtgttcctctgctccttgtcgtaggccctggcctggctttcatcgcttacccgcgggctgtggtgatgctgcccttctctcctctctgggcctgctgtttcttcttcatggtcgttctcctgggactggatagccaggtatcaagaggcagccactcagaggctgagagatgagtgggggggtgtgtgctggggaggaggagccatgggtgaatgtcagaagtggatgcccttttggggacacaggagcttgagggtgagtcctgacctaaccaggcaaggacaatagctcaggggacctgagacagtgagg

SEQ ID NO: 21812 - DNA, 357 bp, Homo sapiens
aaaagttaaccacctatgaagtacacgatccccaaaggtcagggctgattctgccctgctggttacgaaagcgtcctctcccctggccaaacagactaacctgccctgtcatagagactgttcttagattaagttcagaagtaagcatcactgctagaatgtctgacctatttttccaaaacacagctctcttccccttactaaatatgcatttatactgaaatataccattgaccttgttttctataaaattatacacaataattcagaacttcatatcctactaacatagaccacaacagtcattttcaaagaatactgataattctatggaatgcaatttaaggacattaaaag

SEQ ID NO: 21813 - DNA, 417 bp, Homo sapiens
caggatctcgtgtggattttctttcctacgctggaaactactaaactctagctattcagatgccacttcatattctaaaatccaaatcaaatagaaataaacagtactgtatggcaaaggtgtacctcaccgagaactcaggtccactgagcccccagcgtagatagacattccacctcccagatggtggaaaaaaggattgatggctggttctgctccaccctcagagactgtgccagaacaccttctaccctgggatataacttttttaagtttccagaacaatgtatgtggtaaatatacatctattctcaaattagatgtttaaaaataaaaacccaaagtaaggatttgactgtaacagaatagacggtgccttcctgttaaatcattcatatgttcctagttagatggatt

SEQ ID NO: 21814 - DNA, 282 bp, Homo sapiens
gtaatataaaacatgctataattcttatgtcaaattaaaaaacagtgacaaactatgcatataaaataaagaccaggcagaaatacacaaaaatccatagttgttgagctagttggaactatagatcatcctcccttccatttactgaaatttatgaagtttttttatggcttctataaatttaaaaccaaacaaaatgaaaacaaatgaatagcagtgcacctttctagctttttttttttttctagcccccactgaccagtaaaaatgattctggatttg

SEQ ID NO: 21815 - DNA, 175 bp, Homo sapiens
ggaattatgggagctacaagatgagatttgcctgggatcacagagccaaaccatatcagtgtccatcaatggatgaatggataaagaaaatgtgacatatgtatagatagatacatacatatatagatacatagatagatagatagacatatacaatgaaatactattaagcctt

SEQ ID NO: 21816 - DNA, 442 bp, Homo sapiens
ggcacccaaataggaagggccagagaaaaaaaggaaaatcagaaaagtttcccaaagtgctagatggtatacaagaatattcctttattacttatttatttttggaggcagggtctcgctctatcacccaggttggagtatggtagtgtcatcacaggtcactgtggcctcaacctttaaggctcaagggatgctactgcctcagtctcccaagtagctgggactacaggtgtagtagtcaccatgcctagctaatttttatttatatttttttgtagagatgggttctcactatattgcccaggctggtctcaaactcttggcctcaagcaatcctctcacctcagcctcctaaaatgttgggattacaaatgtgagccaccacacccagccttcaatttcttatctgcatacacccccaccaagccagcaaatgtcattg

SEQ ID NO: 21817 - DNA, 317 bp, Homo sapiens
gctgaagtgggaggatggctggagtccaggagatggaggcttcagcgagccgtgatcgcaccaccgcactctatcttgggtgacacagtgagaccctgactcaaataaaataaaaaatgaccgggtgtggtggctcactcctgcattcccagcactttgggaggctgaagagggtggattgcctgagctcgataaatacaaagtatttatttgaaatcagcctggacaacatggcaaaactgcatctccacaaaaaatgcaaaaattaacagggtatggtagcacatgcctgtagttccagctacttgggggttgag

SEQ ID NO: 21818 - DNA, 482 bp, Homo sapiens
ctcagaaagattaagtcactttcactcaactaatcatcatcagagctggaatttgatccagttgtagactctgcactctcaacctccaagctgagctgagctgctaagtaaagttaaactgcttctgggagtctgggtagagagaaaaaagagaaatatgtttgctgaatcaactgctgccggccaagggccaggcctttgcacctggcatcacagctgactgaagctgcagaatccgcagaattcagagcctggggctcctgctgtgtgggacacagaatgggaagatgaagtcaccaccccagtgtgtcccaggtctttgtcagaggacgaaatgctgacatttcaggagggaggaagacccttgctgctatcatggcccttaatcctgaggttagggagccaaagcggaggtcctgtaggggtgagaacatccatcccaactgtgtccgcccaccctgctcaagaaaccgcctgcgggg

SEQ ID NO: 21819 - DNA, 242 bp, Homo sapiens
atggcatttacagactatgttttgtgtatttttattttttactttttgtttttttttcttatgttagcaaaagtatgcttgctattgaaatgttgaaaatatttcattggtcttaaaatgatgcttatttttccagatgcttgcattcattctgcatgtgctattttgtcatttggtttaatttattaaacaattttattaattaaatttattaattataaattaatttataattaattaca

SEQ ID NO: 21820 - DNA, 469 bp, Homo sapiens
atgttatgtgaatgttcactgcagcactatttgtaatagcccaaatgtgaaaacgtttactatcaagagtagaatgggtaaagtgtaatatactatactttggaacactgtataaagaacaggaaagaactacacacagcagagatgaacccacaaacctaatattgaatgaaagcaggcagacccaaaagatgaacattatatgagtccatttgtataaagtacaaaaaagcccaaactagtattttgttagttgatatgggtgctggttccatggctgtgttcgctttgtgaaaacgtgttgtgtttttatgctttgggtacttctctgcattaaaaattaaaaatattaacttttcaatataaaatgcacagtctgcagcttatgatggttcaatttaaattcttttcaactttacgacggtgcaaaagcaagcattcagtaaaaactctactttgaactttgaat

SEQ ID NO: 21821 - DNA, 705 bp, Homo sapiens
cggagccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttctacctcgccatgcctttcgcgacacccatggaagcagagctggcccgcaggagcctggcccaggatgccccaccgcttcccgtgccaggggtgcttctgaaggagttcactgtgtccggcaacatactgactatccgactgactgctgcagaccaccgccaactgcagctctccatcagctcctgtctccagcagctttccctgttgatgtggatcacgcagtgctttctgcccgtgtttttggctcagcctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaaactgagctacgattc

SEQ ID NO: 21822 - DNA, 238 bp, Homo sapiens
cttattccatttgcactgttataacaaagtaccattagctgggtgcctcattaacaacagaaatttgcttattgtggttctggaggctgagaaatccaagatcgaggcactagcagattccatgtctagtgagagcctgcttcctcatggatgactgtcttctcactgtaactttacatggcagaggcggaatgaacctctctctggcctcttttataagaacactgacctaatcacc

SEQ ID NO: 21823 - DNA, 1394 bp, Homo sapiens
  misc_feature (1)..(2): n is a, c, g, or t
nngggccctttctactgtgaacacacagtagttaggagagtatggactttggagccacacccaagttcgtattccagctatgcctcttacaaactgtgtgatttggagtagtaactaaccatctctgccttgttttcctttctaaaaaatgggtgtaaaatcacctacctaatgcagttatcatgaagatcaaatgagttaatgtatggaaaggggtggcacatagttactcctcagtaatgttggcctcattccctctccctgctttctgtaatgcagagaattatcttctggtaacttcattgaaaaggcctctttaggcatgaaatcacctgccagctgtgctgaggacaggcttcacagagctcctggaggctaattaaggtgcagagttcagagcagaaagatgcttcactatacctgtggcaggatggccaccagggctgttccctggccagagtaagcactctttccctagggatttggaacagccccattctcacctggtgtttaccccaggttttgaagagattccaaactagagcagcaagcaaagtctagagctgactggggaaccagccctaccctgggatattggcctctgatgaaagcaccactaaacctcaccttctctcctaaatctcttcagaaatgcttactctctgtgatagacatgggaacagattgttttgcctcagggatttattgattgattttgccaaagtctttcccaaggctcctttcaaaactggactgatcccttggttctgggaatgagtggtgaacatcagacctctggaatggtggctggtcaatgtctttgccctctcaagttgctcttgaatgttgattcaactcattaggacatacttggatgatgaattagaaggagcatctttgccctctacttacagatcctaggaacaatttgtggaattatcagtaagcaatatctgtaacagataaaatgtctgctttccctttgcccctcttagcctatgacatgccacatccaatttgtcttcgttccaactgtgagaggtcttaatttcatcattctggcccttttgccagttaaatattctcccaaggatatgatctatggggagaggactgatagtggaactaatctttcaaggttctgcttaagcaattgtagataacataggagaagaaactctggaaacaattatgattatcctagttctgcccctgtggaaattcaatccgaaacccttcatgtttttgcttctctcttctctacatggatggaatatgttatacttttttgagctgaaaaatctaaataattagaaaaagacaaagttgtaatgagttttctgtttaaacttataggaccctttctaataaaagtgttattttaatcattgaat

SEQ ID NO: 21824 - DNA, 817 bp, Homo sapiens
agactcggtgtcatcaccaatccatcgccagaaggggaggaaactggaatccagcagcggcgagcagcagctgggcggtcacatctggaaatggaaagccgacctccccctcctcctccacctcctcctcctcctcctccttctcctcctctcacccaggatcacttccgaaaccagttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagttctgtttcatcaaatggaaatgggacatggacagtttctcctatcccatgcagaccatgctcctgaattaaaactgcagaatgtgttaaagcatcattcaacatcgtgagcacatttgagatactgtacaggacaacctgcttttcatattctctgtgaatttcaaagacgactgggattttcttcctcctctaccaccctgaacagcaagaccaatacatcctgtatttcctcctcttcagcctacttgtgaagacaaggatgaagacctccatgatgagccatctccacttaatgactgtctcacattggccggcaacttgttccaggtatagttgtgccggatgtggaactccacatctatgttcatgatgcggcggccagggccggcggcgggggccacgaccgcgacccacactaggcctcccg

SEQ ID NO: 21825 - DNA, 1090 bp, Homo sapiens
ctcgatctcctgacctcgtgatccgccctcctcagtctcccaaagtattaggattacaggcgtgagccaccgcccccggccctcaaagattgttatgagtcctcacagatgtcagaggacgatgctgtgacctatatttgcaaacgcccggaagacttaaagctattgttttgcaaatgcacagataacaataataacatgatgctgtggatgagcatgaaagtttttctcttactcctaattataatgttttccctcttactgctttgccctgctgatggaattcagtaaaggaatctctaccagcagacacttggtttttacccttcctaggacctttaatagatatctttttattactaatctttgctctttgcttgtttaacctccttgtaaagtttgtgtcttccagattacaataattccatgtaaagatgatgctggcacaaggctttcaacccatcccctcttctgacccagaagataaagacatcctacctttgagccttttagaacaggtatccagggattttacctctccagtgctaggcagggtctatgcccataacatcagcaggaagcagttacagaagatgaacctccgcccttctgcaagccccttaagattaaggaggagtatataatctctgatggggaaatgaggtaggagaccagaaggacttattttccattcccaaccccattgaacagagcaggatctggtcaaaacagggtgcagtggagaagcctgctgaaaccagcagatgatgatgaaagtgacctctagttgccctcactgcttatgagcataaagacactaccactgggaccatggccagtttacaaatgtcatggcaacacaccttggcaatggcctggaagttactttatatggttctggaaactccctgcccctttcccagaaagttctgaataacctacctcttaattggcatgcaattaaaagtggctctaaatacaactagctagtagcccacaggcacaaactctgggcacactgcctataggttagccctgctctgcaagaagtagcaccagttcaataaaagttgctttctctcaaaaaaaa

SEQ ID NO: 21826 - DNA, 1409 bp, Homo sapiens
agactcggtgtcatcaccaatccatcgccagaaggggaggaaactggaatccagcagcggcgagcagcagctgggcggtcacatctggaaatggaaagccgacctccccctcctcctccacctcctcctcctcctcctccttctcctcctctcacccaggatcacttccgaaaccagttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagttctgtttcatcaaatggaaatgggacatggacagtttctcctatcccatgcagaccatgctcctgaattaaaactgcagaatgtgttaaagcatcattcaacatcgtgagcacatttgagatactgtacaggacaacctgcttttcatattctctgtgaatttcaaagacgactgggattttcttcctcctctaccaccctgaacagcaagaccaatacatcctgtatttcctcctcttcagcctacttgtgaagacaaggatgaagacctccatgatgagccatctccacttaatgactgtctcacattggccggcaacttgttccagtttgtgtcttccagattacaataattccatgtaaagatgatgctggcacaaggctttcaacccatcccctcttctgacccagaagataaagacatcctacctttgagccttttagaacaggtatccagggattttacctctccagtgctaggcagggtctatgcccataacatcagcaggaagcagttacagaagatgaacctccgcccttctgcaagccccttaagattaaggaggagtatataatctctgatggggaaatgaggtaggagaccagaaggacttattttccattcccaaccccattgaacagagcaggatctggtcaaaacagggtgcagtggagaagcctgctgaaaccagcagatgatgatgaaagtgacctctagttgccctcactgcttatgagcataaagacactaccactgggaccatggccagtttacaaatgtcatggcaacacaccttggcaatggcctggaagttactttatatggttctggaaactccctgcccctttcccagaaagttctgaataacctacctcttaattggcatgcaattaaaagtggctctaaatacaactagctagtagcccacaggcacaaactctgggcacactgcctataggttagccctgctctgcaagaagtagcaccagttcaataaaagttgctttctctcaaaaaaaa

SEQ ID NO: 21827 - DNA, 1166 bp, Homo sapiens
agactcggtgtcatcaccaatccatcgccagaaggggaggaaactggaatccagcagcggcgagcagcagctgggcggtcacatctggaaatggaaagccgacctccccctcctcctccacctcctcctcctcctcctccttctcctcctctcacccaggatcacttccgaaaccagttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagcctacttgtgaagacaaggatgaagacctccatgatgagccatctccacttaatgactgtctcacattggccggcaacttgttccagtttgtgtcttccagattacaataattccatgtaaagatgatgctggcacaaggctttcaacccatcccctcttctgacccagaagataaagacatcctacctttgagccttttagaacaggtatccagggattttacctctccagtgctaggcagggtctatgcccataacatcagcaggaagcagttacagaagatgaacctccgcccttctgcaagccccttaagattaaggaggagtatataatctctgatggggaaatgaggtaggagaccagaaggacttattttccattcccaaccccattgaacagagcaggatctggtcaaaacagggtgcagtggagaagcctgctgaaaccagcagatgatgatgaaagtgacctctagttgccctcactgcttatgagcataaagacactaccactgggaccatggccagtttacaaatgtcatggcaacacaccttggcaatggcctggaagttactttatatggttctggaaactccctgcccctttcccagaaagttctgaataacctacctcttaattggcatgcaattaaaagtggctctaaatacaactagctagtagcccacaggcacaaactctgggcacactgcctataggttagccctgctctgcaagaagtagcaccagttcaataaaagttgctttctctcaaaaaaaa

SEQ ID NO: 21828 - DNA, 1814 bp, Homo sapiens
agactcggtgtcatcaccaatccatcgccagaaggggaggaaactggaatccagcagcggcgagcagcagctgggcggtcacatctggaaatggaaagccgacctccccctcctcctccacctcctcctcctcctcctccttctcctcctctcacccaggatcacttccgaaaccagttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagatactgtacaggacaacctgcttttcatattctctgtgaatttcaaagacgactgggattttcttcctcctctaccaccctgaacagcaagaccaatacatcctgtatttcctcctcttcagcctacttgtgaagacaaggatgaagacctccatgatgagccatctccacttaatgactgtctcacattggccggcaacttgttccaggctggagtgcaatggtgcaatcttggctcaccacaacctccacccccagggttcaagcaattctgcctcagcctcccaagtagctgtgattacaggcaggcaccaccacacccaggtaatttttttttttttgtatttttagtagagatggggttcctccatgttggtcaggctgatctcaaactcccaacctcaggtgatcctcccaaagtgctgggattacaggctcaagccaccaagcctggccaaaaaaaatttctaattgcaattctgaacaagttatgggttgtgaaatcaatatagtggactgcttgctactacaggctttatttaaatactaggaaggttggattacacataatgaaagattttttaaaaactgatcacaaagaattgtatatttctcactgcatcttgtggtcagataagtttgagaaactgctctacataggcaaattataggttcaatctatccatctacctctttttctcttctcttttttccatgctatgcaaacaaaaccatggcgagaggaaggaaaattccatcaatgggtggtgttaagccttttctatgaggtagctgtacatttgggacacttctatgttggcgacttgacattctaatagatagatggtccttttcatctctagccacatgtgaaaattacttgggagctttttaagactactagtggcttccacccacctggaagcatttaaatcagaatctctaggtgtagagtccaggcacttgtgttcccaccctatttcccaccattctctttgtttctctttcaccataggcttctttcccatgagaaagtaaagattttagtctctctttccacagtctgaagtaaatcactatctttctcaactggacttccaaggcaaagatttctttccatttatctatctggagttttacaaagttggcctctggattcccttttcccaaagctaattcaccacaaaggcacccctcaagtcaaggagctggactttcatacacctgcacctgtcaatcatgggtaaataatttgcaggcaaggttgctgggtgctgtgggattgacataaactcccaggtattgccagctctgagcctcaggcaagcttgtgactaaatgactccagtagtctgaggacagtccttactcagaagggtctttggaagcaaaagcagacataggcatgagagggtaaaaaaaaaaaa

SEQ ID NO: 21829 - DNA, 1245 bp, Homo sapiens
tgaaacaatttcgctcttgttgcccaggctggagtgcaatggtgcaatcttggctcaccacaacctccacccccagggttcaagcaattctgcctcagcctcccaagtagctgtgattacaggcaggcaccaccacacccaggtaatttttttttttttgtatttttagtagagatggggttcctccatgttggtcaggctgatctcaaactcccaacctcaggtgatcctcccaaagtgctgggattacaggctcaagccaccaagcctggccaaaaaaaatttctaattgcaattctgaacaagttatgggttgtgaaatcaatatagtggactgcttgctactacaggctttatttaaatactaggaaggttggattacacataatgaaagattttttaaaaactgatcacaaagaattgtatatttctcactgcatcttgtggtcagataagtttgagaaactgctctacataggcaaattataggttcaatctatccatctacctctttttctcttctcttttttccatgctatgcaaacaaaaccatggcgagaggaaggaaaattccatcaatgggtggtgttaagccttttctatgaggtagctgtacatttgggacacttctatgttggcgacttgacattctaatagatagatggtccttttcatctctagccacatgtgaaaattacttgggagctttttaagactactagtggcttccacccacctggaagcatttaaatcagaatctctaggtgtagagtccaggcacttgtgttcccaccctatttcccaccattctctttgtttctctttcaccataggcttctttcccatgagaaagtaaagattttagtctctctttccacagtctgaagtaaatcactatctttctcaactggacttccaaggcaaagatttctttccatttatctatctggagttttacaaagttggcctctggattcccttttcccaaagctaattcaccacaaaggcacccctcaagtcaaggagctggactttcatacacctgcacctgtcaatcatgggtaaataatttgcaggcaaggttgctgggtgctgtgggattgacataaactcccaggtattgccagctctgagcctcaggcaagcttgtgactaaatgactccagtagtctgaggacagtccttactcagaagggtctttggaagcaaaagcagacataggcatgagagggtaaaaaaaaaaaa

SEQ ID NO: 21830 - DNA, 1221 bp, Homo sapiens
aagacacatcaggtgagaattaaaaaacaataaaaaggacacagatgagagaatctgtagataagcacattgaaacaaatataactgtataccttgtattaaagaagctaggccagtgtggtggctcatgcttgtaatcccagcactttgccaggccaatgtgggtcacatgaggctgatctcaaactcccaacctcaggtgatcctcccaaagtgctgggattacaggctcaagccaccaagcctggccaaaaaaaatttctaattgcaattctgaacaagttatgggttgtgaaatcaatatagtggactgcttgctactacaggctttatttaaatactaggaaggttggattacacataatgaaagattttttaaaaactgatcacaaagaattgtatatttctcactgcatcttgtggtcagataagtttgagaaactgctctacataggcaaattataggttcaatctatccatctacctctttttctcttctcttttttccatgctatgcaaacaaaaccatggcgagaggaaggaaaattccatcaatgggtggtgttaagccttttctatgaggtagctgtacatttgggacacttctatgttggcgacttgacattctaatagatagatggtccttttcatctctagccacatgtgaaaattacttgggagctttttaagactactagtggcttccacccacctggaagcatttaaatcagaatctctaggtgtagagtccaggcacttgtgttcccaccctatttcccaccattctctttgtttctctttcaccataggcttctttcccatgagaaagtaaagattttagtctctctttccacagtctgaagtaaatcactatctttctcaactggacttccaaggcaaagatttctttccatttatctatctggagttttacaaagttggcctctggattcccttttcccaaagctaattcaccacaaaggcacccctcaagtcaaggagctggactttcatacacctgcacctgtcaatcatgggtaaataatttgcaggcaaggttgctgggtgctgtgggattgacataaactcccaggtattgccagctctgagcctcaggcaagcttgtgactaaatgactccagtagtctgaggacagtccttactcagaagggtctttggaagcaaaagcagacataggcatgagagggtaaaaaaaaaaaa

SEQ ID NO: 21831 - DNA, 376 bp, Homo sapiens
gaaaattccatcaatgggtggtgttaagccttttctatgaggtagctgtacatttgggacacttctatgttggcgacttgacattctaatagatagatggtccttttcatctctagccacatgtgaaaattacttgggagctttttaagactactagtggcttccacccacctggaagcatttaaatcagaatctctaggtgtagagtccaggcacttgtgttaaaacctcaccaggctttataatatgacagaatggtttaaagctactgagtagacccaccctatttcccaccattctctttgtttctctttcaccataggcttctttcccatgagaaagtaaagattttagtctctctttccacagtctgaag

SEQ ID NO: 21832 - DNA, 339 bp, Homo sapiens
ccacagtctgaagtaaatcactatctttctcaactggacttccaaggcaaagatttctttccatttatctatctggagttttacaaagttggcctctggattcccttttcccaaagctaattcaccacaaaggcacccctcaagtcaaggagctggactttcatacacctgcacctgtcaatcatgggtaaataatttgcaggcaaggttgctgggtgctgtgggattgacataaactcccaggtattgccagctctgagcctcaggcaagcttgtgactaaatgactccagtagtctgaggacagtccttactcagaagggtctttggaagcaaaagc

SEQ ID NO: 21833 - DNA, 1288 bp, Homo sapiens
agactcggtgtcatcaccaatccatcgccagaaggggaggaaactggaatccagcagcggcgagcagcagctgggcggtcacatctggaaatggaaagccgacctccccctcctcctccacctcctcctcctcctcctccttctcctcctctcacccaggatcacttccgaaaccagttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagatactgtacaggacaacctgcttttcatattctctgtgaatttcaaagacgactgggattttcttcctcctctaccaccctgaacagcaagaccaatacatcctgtatttcctcctcttcagcctacttgtgaagacaaggatgaagacctccatgatgagccatctccacttaatgactgtctcacattggccggcaacttgttccagtttgtgtcttccagattacaataattccatgtaaagatgatgctggcacaaggctttcaacccatcccctcttctgacccagaagataaagacatcctacctttgagccttttagaacaggtatccagggattttacctctccagtgctaggcagggtctatgcccataacatcagcaggaagcagttacagaagatgaacctccgcccttctgcaagccccttaagattaaggaggagtatataatctctgatggggaaatgaggtaggagaccagaaggacttattttccattcccaaccccattgaacagagcaggatctggtcaaaacagggtgcagtggagaagcctgctgaaaccagcagatgatgatgaaagtgacctctagttgccctcactgcttatgagcataaagacactaccactgggaccatggccagtttacaaatgtcatggcaacacaccttggcaatggcctggaagttactttatatggttctggaaactccctgcccctttcccagaaagttctgaataacctacctcttaattggcatgcaattaaaagtggctctaaatacaactagctagtagcccacaggcacaaactctgggcacactgcctataggttagccctgctctgcaagaagtagcaccagttcaataaaagttgctttctctcaaaaaaaa

SEQ ID NO: 21834 - DNA, 1935 bp, Homo sapiens
agactcggtgtcatcaccaatccatcgccagaaggggaggaaactggaatccagcagcggcgagcagcagctgggcggtcacatctggaaatggaaagccgacctccccctcctcctccacctcctcctcctcctcctccttctcctcctctcacccaggatcacttccgaaaccagttggccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagttctgtttcatcaaatggaaatgggacatggacagtttctcctatcccatgcagaccatgctcctgaattaaaactgcagaatgtgttaaagcatcattcaacatcgtgagcacatttgagatactgtacaggacaacctgcttttcatattctctgtgaatttcaaagacgactgggattttcttcctcctctaccaccctgaacagcaagaccaatacatcctgtatttcctcctcttcagcctacttgtgaagacaaggatgaagacctccatgatgagccatctccacttaatgactgtctcacattggccggcaacttgttccaggctggagtgcaatggtgcaatcttggctcaccacaacctccacccccagggttcaagcaattctgcctcagcctcccaagtagctgtgattacaggcaggcaccaccacacccaggtaatttttttttttttgtatttttagtagagatggggttcctccatgttggtcaggctgatctcaaactcccaacctcaggtgatcctcccaaagtgctgggattacaggctcaagccaccaagcctggccaaaaaaaatttctaattgcaattctgaacaagttatgggttgtgaaatcaatatagtggactgcttgctactacaggctttatttaaatactaggaaggttggattacacataatgaaagattttttaaaaactgatcacaaagaattgtatatttctcactgcatcttgtggtcagataagtttgagaaactgctctacataggcaaattataggttcaatctatccatctacctctttttctcttctcttttttccatgctatgcaaacaaaaccatggcgagaggaaggaaaattccatcaatgggtggtgttaagccttttctatgaggtagctgtacatttgggacacttctatgttggcgacttgacattctaatagatagatggtccttttcatctctagccacatgtgaaaattacttgggagctttttaagactactagtggcttccacccacctggaagcatttaaatcagaatctctaggtgtagagtccaggcacttgtgttcccaccctatttcccaccattctctttgtttctctttcaccataggcttctttcccatgagaaagtaaagattttagtctctctttccacagtctgaagtaaatcactatctttctcaactggacttccaaggcaaagatttctttccatttatctatctggagttttacaaagttggcctctggattcccttttcccaaagctaattcaccacaaaggcacccctcaagtcaaggagctggactttcatacacctgcacctgtcaatcatgggtaaataatttgcaggcaaggttgctgggtgctgtgggattgacataaactcccaggtattgccagctctgagcctcaggcaagcttgtgactaaatgactccagtagtctgaggacagtccttactcagaagggtctttggaagcaaaagcagacataggcatgagagggtaaaaaaaaaaaa

SEQ ID NO: 21835 - DNA, 323 bp, Homo sapiens
tttgagacggagtctcgctctgtcgcccagactggagtgcagtggcgcaatctaggctcactgcaagctccgcctcccgggttcacgccattctcctgtctcagcctcctgagcagctgggactacaggtgcctgccaccgcgcccggctaatttttttttttgtatttttagtagagacggggtttcaccaggatctcgatcttctgacctcgtgatccgcccacctcggcctcccaaagtgctgggattacaggcccgagccactgcgcccagccaaatctctctttttattgataaactaatgcagagtaaggaaattct

SEQ ID NO: 21836 - DNA, 453 bp, Homo sapiens
cagtggtgcccttacgtggacaaagaaattcagcctagattatttggccctggacttcaattcagcatcaccagcccccatgcagcaggccagagcctttgtgttccaggtcatctccagtccagggccgaggcaagagaagcagcccccatctgaagtgtgctggcctcctggcagaggaaaaagagagattgcagaatcacagaatacctctttctccttaggattggaacatgtcacttcctttttgttattattgttttgttttcttgagtcaagatctcactctgtcactcaggctggagtgcagtggcatggtcatagctcactgcagcctcgatctcctgggctaaagttatcctcccatctcagcctcccaagtagctggtactacagttgcacatcatcacccacggctgttttttattttttaataaaaaatgatcttgatct

SEQ ID NO: 21837 - DNA, 492 bp, Homo sapiens
gagggaaagcaaattccaggctgattgttactctgtctcatgggaaccagccaactcgctgtttgaagccaccatgtccaccggggagaaggagagcacccattttgtgaccaggcttttctccaactccagcctgtcccatgaaggcttaacgttcctacactttgggttatggaattcagcatctctgggaactgctggggaccagctcctccaggggtccaagcagggcggacccgctgcgggtctcactgcagcaggtgcatcagagatcatgcctcagcctggctctcatgtcccacaaattcctggaagattactgctgtcagaaaatgaggcaatgacagggatggttccagtgctttaggactgtgggaacaacacaagctgctgcaggggccatgctagccctagtggaatcctgggaaggcagatgggtcggaacagatgtgagaagagtcatgagcatggcccgatgcatgagcagagcag

SEQ ID NO: 21838 - DNA, 325 bp, Homo sapiens
ctgaaataggcccagccaactgcttctcctctccaactacaatcttagtggctagctagttctgacttgattgtctagctcagagaaggaaagtgactagctcatggtcacagttcaagttggcaggagagccaggtctagaaccaggtatcctgactcctaggccagtgctctggtgcttcacatgaacctaagaaaataccaagggtatggctggggtatggtggctcatgcctataatcccagcactttgggaggccaaggcagatggatcacctgaggtcaggagtttgtgaccagccgggccaacatgacaaaatcttgc

SEQ ID NO: 21839 - DNA, 535 bp, Homo sapiens
gaacactcctccacgcaggttacctgaagccagtgtattacttacagataggacaacagaagcctatgattcgtaaaagcctcaagaaagctagtttggcagatggggtttcatctgcatgtgccacatttgcactgcagtcgagggtcccaagaaagcactccaccctaggttttataccccagcataacatgattcactgtgctaatgtgttgaaggacatgctgtttctatgagggattagaacagaacctaggctgttcaggctagtttctccctatcttaagatgttgcattctcagcatattctatatttattcttgagaactatgagtaaaaaagaggggtaactgtgtcagtccaaagatacctgaagaattgtcctgtgctaacagcagaaaagtttccagttgatttaaaatcaagtgatttgcaatgtagttacaaacaaaattattaagtgcctattttgtatttgaccccatggtaatactgattatgataataataaaatatattaagcaaaaaaaaaaaa

SEQ ID NO: 21840 - DNA, 355 bp, Homo sapiens
cttgaacctgggaggcggaggtggcagtgagccgagatcgtgccactgcactgcagcctggtgacagagcgagactccgtctcaaaataaataaataaataaaaattaaaattagaaatttcctggtggagaggaaagcagaggtatttttaaagctctcaggtgatatatttctgttttaaggtaggactaaaaatcatgggactacgtcagaagttctaattataaatctataggttagttttctccaggcatgggtatagtgcttaaatgccttttaaatttgttaccaacatagaaaaaaaaaggtttccggcttctcttgaaaaatggaaatattaggcaacagttgggc

SEQ ID NO: 21841 - DNA, 1045 bp, Homo sapiens
tacaggtgtgagccactgtgcccagccgatactctaaatttctaataagctcttaggtaatgctgatgctgctggtccaaaggtgacactttgactactgaggttcaaagatgcctcagaagaagaagaaatttaattacaaacatacatgaattgttgaatagcagctggtactaatctagaaaaattattccaatctgttgagtttaatagtgtttctttgttaattgcctttcaaagtgattacttctcccctacatcgtaactatctacatgttatgggacagtttatgggcttatttgtatccataattatgttagtgaaatcaaatagtaaagaaagctgagttagaacctgttccacaagtataactttgttgtttaaacttcttctgatattcagctctaattcctttttgaaagaaacttttctacagattttgtgttagattactggtagtctcaaatgagttctctaaccatccaattctgcatggcttccttgcattgtctttgggttgattaggattgccaggaagtaaaatagccactatagctacttcctttttcaagtcattcaagttaagcttaatgtagaaaaacttcgtgagatttcattaaaattcttccctactctccaattggagtataataaatccaatcaagataggctctggattttgctgttagtactccaatgaaggcagaaatggggacatagcaaactacagcaaggcttattttataccagtacagagccttgcttataacagtggaggtatgtagctatttagtcttgggccatctattactctcagtctgagacccagttatacaacccagttgtataactcaatggattaatatttccaaattaaataaaactgaattgggtacagtattgtgctcctgtagtcctggctacttgggaggctaaggcaggaggattgcttgagcccaggagtttgaggctgcagtgtgctacatttgtgcttgtgaatagacactgcactctagcctgggcaacatagcaagacctagtctc

SEQ ID NO: 21842 - DNA, 648 bp, Homo sapiens
aaaaattattctacatctggccatatatatgatgaaggcttgagctaataacttagcttctctgtgctagtttcctcctataatctagtaaacaaccttcccagtctaattttctaggattatttgctgactcaaatttttccagtcttgtagccaatggcatcccacttgaggttcttatcctacttgaaacttatagcttacaaacttcacagcctttgggtgaaactagagtgtgttctacctaacatgaaacttaatagtggagacggtgcactgggaattgagaataagaatctgttagagaggtgaagtgagtcaaagtctcttccagctgagccaacctcggaaagctttatttatgggtcaatttatgggtcaatgaagtcacatgacatggactgccttcctacaggacactcgtgcatggaagcccaatttcctcaaaacctagattttccttagaagttgtctcaaaaaaaaaaaaaaaagaaagaaaaagaaaaaagaaagctttgcctaagtggtttcctgtccttaaggtttccatggagagaacattttcaagattaaaggagtctagctgtcatttttaacccgaggggtcttcagatttatgtttcaaagcagggtgggaatttggtcctt

SEQ ID NO: 21843 - DNA, 739 bp, Homo sapiens
aactccggaccttaggtgatctgcctgcctcagcctcccaaagtgctgggattacaggcgtgagccaccatgcccaatgggtgtgggatttagtatattaatgagtgtataatgaggtccttggtgaaacctacatcaaatccagcaccgtgttgggtccagtctgtcttagccagcttggtccacaccctggttttttagggtcttattggccccttacttctgcagcaaaagtttccttttgctagtcatgtgaaactgccacctggaattttctattctctagtgaccaccctgtattattcctgtctcactgggaccctaagaaattgggaattccaactacacatccaaaatagtttgactaaaactgttgaaaaaagaaaaaaataatggcataaagtattgcttgactaaattccagccaggtgcattggccactttaggtcgggtgtggtggctcatgcttgtaatcccagcattttgggaggctgaggcgggaggatcacttgaggtcaggagttccaaaccagtctggccaaaatggtaaaaccccctctctactaaaaatacaaaaattagccggacctggtggcggaagcctgtaatcccagctactctggaggctgaggcacgaaaattgcttgaacccaggaggtggaggttgcattgaaccaagatcataccactgcactctagcctgtgtgacagagaaagattccgtctcaagaaacaaaaa

SEQ ID NO: 21844 - DNA, 503 bp, Homo sapiens
gcgattctcctgcctcagcctcccgaatagctgggattacaggcgccttccaccatgcccagctaatttttgtatttttagtagagactgggtttcaccatgttggccaggctggtctcgaacacctgacctcaggcagtctccctgcctcagcctcgcaaagtgctgggattacaggcgtgaaccactgcgcctggccacatttaggatttttaaatcgctgtgtatgtctgagattggcctgtgatttttttcctttctcataccgtatgtacccagttttaatctcaagtttatagtaccctcaaacaatgaattagtgaattttcccactcttcctttcatccaaaagcttctgtaataaagagattatctgtttcctaaagaattgtttgctggggttttttcccgctctccactggccccagacatgatatctctctctgtcttcaggctgtagtgcagtggcaagatcatagctcactgcaacctcaaactcctgg

SEQ ID NO: 21845 - DNA, 395 bp, Homo sapiens
ggtatcttcaatggaatccttaatgagagtttattgaagcagttatgtaggatgtggggatggaggactcatctgctaggatgatgagaaggtgattttagagggagcggattgataggacttgtgaccttgaaattccaattcaattccaagagactccttgcctgattatgcttacttaatagaattctcccatctattaaggtttcttagactccttatctttctaattccttttctctcatgtaaactaatgggatgctctgaataagtgaaaagttaatgtagggaaattttacagcacaatcttgaaggcagccacagtaatgcagtattgaaaagcacacttaatgatgggtatgtggagttcatgaacaacaatagttcatttgtaa

SEQ ID NO: 21846 - DNA, 278 bp, Homo sapiens
aagaggggctgccgcctaagcaagggccctggcctgcgaggcaggaagaacgggctctagcttcacaaatggtatctcagaagatatgtcaatccatttttaaaataataatgcagttgtaataagagtgtcattgtgtcaaagaaacagagccactaggtgacatatagagatttatgataaggaattggctcacacaactatggagtctggcaaactccaacaccagcagtgggaatgggcaagagggccaatggtatggttccagtccaaaggcc

SEQ ID NO: 21847 - DNA, 288 bp, Homo sapiens
gcttaatccataatagcctgttactgaacacaactcatacattcatcaacaaatgaatgaataaacaaattgtattatattcatacaatggaatactactcagcaataaaaatgaatgtactactgatacaaatagcatggatgaaactcaaaatcattattctaagagccagatactatagtctgtattttatgattcactttcaatgaaattctacaatagacagaactatctatcaacagaaagcagatcagtggttttctgcagccagaggtatgaaaggtttg

SEQ ID NO: 21848 - DNA, 400 bp, Homo sapiens
ccgttactaccacttggcactccctaaaagcttgagattcagagaaaggaagacaaagcccctgtacttgaggagggagagaataaagagagccggcgggggagggggtggcaggagagagagagagagagaggcgtgtgagtgagttcttgcaacacagtgtggtcagtgtgatcacagagctgtgatggagtgcggatgaggtctgatgacttactggtcaagagcatgggttcaggcctcagttcctccccaatcacatgtggggtcttaggcatctttctttttaatcttcagtttctttgtctgtgaaatgaagataatggcacagagcctacctcccagagttctatgtggattaaatgagacaggcaaacaacaacaaaaaccacaaacaaac

SEQ ID NO: 21849 - DNA, 1722 bp, Homo sapiens
ataatgttttagtatatttaatattcaggacatatacaaaaaatgtgtttatctgaaattcaaatttaactgaacatcttttatctggtaaccctacttctacatgttttctctacccagcttctattttaatgctttgcgtatagtaataataaaatgaacaagaagtagttgggaaggtgtgatcgttgagttccaaaatgcagttatttgtagcattttgaacaataaaaaggttacactctgcatcaatctttccatgaatctgaagcccttaagagataagaattacagaacagtgcacattcagtgtataagaacaagacagccaagcatggtggcttatgcttgtaatcccagcactttgggaggccaaggtgggaggatagcttgaggccaagagttggagaccagcctagacaacatgataagacctcatctttacaaaaaataatttagaaagaaaaagacataatctaagtatttttttttaaatctgtttttccccattgtggaagataaaatttgaacaattacgcgagatttgtttacctaggcatgtgtatcaagtagattaaaattcataaaagtcattaagagtgattgcatcagccatggtgctttgtggaatgaaggtccataacagcatgatggcttccagtatatcatcgagtttagaaaaaccaattctatagctgcccatcctccaggtttgcaaatatatgaatcccaaaattgaagtaattgctaaagcaagaatatgtttttttaagattgtagtctttgtaatgaatttggaaatctgtggtatcatatactaaggagtggcatcaagtgacaaagcaagaccatagtatgtacatgacaccaaacacaaccaaatcaagttatatttgtgaagttgtgattcccaagctctggagaaatctaaaatttggatgcatgtgttggtggagcaaatatctcagaagttactgaaatattgcaaggttcttaagttagcatgaaagcaaacttttttctctctttcctgggagatgtgcagagtatgttgtatgaggaggaagacaggacttagggaagaggctaaatattttggagcaagtctgactcagccatttgtatctcctggttggaaaacggactgtcatatcactctacattcatcatcacattagagaatagattattttcccctttagagatgtcctgggaacgtgtttgcacaagtgtccatgtgggtactgaggtgaagtttggttgagctagtggaaacctagtggggaaaagtcttaaaaatccatatacataagaaaaatcatctgtccaagtatctttcattttagagaatcgagtcacttgatacttctgattgtttcctccactttaagttaagcctgggcaacatgttgagatcctgatctggtttggctgtgtccccaaccaaatctcacttgaattgtaattcccacaattcccacgtgtcatgggtggtgactgaattatgggggtgggtctttccggtgctgttcttatgatagtgaatgagtcttacgagatctgatggttttaaaaaccatcagtgcagggagttgccctgcacaagctctctgcctgctgccctccacataagatgtgtcttgctcctcttgccttctgccatgattgtgaggcttcctcagccatgtggaactgtaagtccaattaaacctgtttcttgca

SEQ ID NO: 21850 - DNA, 307 bp, Homo sapiens
gatcagatcattggactctgatgaccagccctagcactcgtttggtgtgcgttggacatgcacatgaactgatcaagcttgatttcttcctctgtaaaacaggaattctcaaagcttcatattgggattaaatgagattaaatgaaataatggatggtacatgtcagtgttggtcatagggaagtaaaagattgaatacaccaagggacaatggtcagatcatctataaaaatagaactgtgacccaggatctgcatcaaccagcccagtaaactaacctgttatctagccatgccagacttgtagg

SEQ ID NO: 21851 - DNA, 213 bp, Homo sapiens
acggaagtagaaactataatgatagataccaaagactaggaaaggtgatgggtctcagggagaggggttaagagtgaggttggtgaatgggtacaaacacacagttagataaaaggaacaaattttaatgtttgatagcagagtagggtgactataattcacaacaatgtattgtttttcagaacagctaggaaagaggacctgcaatgtacc

SEQ ID NO: 21852 - DNA, 824 bp, Homo sapiens
gtggagagatagctgggctcacttcagaagacccaaattttgattcaagactgctttgttctctcaccagaggcaaacatatcaccaggttgcctttgggaggagactgctaacaaccattgagcagacataacctggagatttgttttgcaatgtgttgtataacaatgttgatttaattgcctcaggcgatttcacatgaaaatccaggtagaaaagtggaaaatatagcaacagtgggattggaggtgaatagctgcctccacctgtggatgaggcatgtcctctctttttatcaaactctcatcacctcttttcttatatcctgtctgcttcatttatttatatcatctgcttgcctctgttggtatggcagttagcaacactaatcatctggtttggggaggacggtgctgcacttattttcaccaacaaagggccaggggacgttttgcactcattttttgatagcaggaacacttacaggatcatgaacaccacattggaatcagaggttcctcagtgctactcaaaacttctctgctgcaattccaactctacctccctgggccctcgttagaatcctttgatcatcctcctccagggattgagatcacatgataaacaatcttggattgggtcaggttaagctatatgcaggtatgataaattcataattttcaaactgcggtatgtgtacctaaggcttttcacggattgcatactcaggacaattttcaggaaattaatttccagatcctctatatacactatactctttccttaaattgatctgctgagaatgagtctttgttcatactgtt

SEQ ID NO: 21853 - DNA, 514 bp, Homo sapiens
atagttttcctggtgtcttggagagaccctacctccacagctcctgcaggagcaaaaccatgttttctgccatgtgagctctcctacactggccacagctgattgtacccaaggttcagtacccgaccccaaagagactcattttccaggccagagggcggcctaaggaatgaaagtgtaccctagcagtggtattcttgtttgatggtacctggccccaccaatcacggccctcttttagggagtttgaacaccagaaagtaaatgatgaataggaagcacagccagaatagacacagtcaccgtaatggtgactctgagaacagtgacagcagttacttctgcagtcaagacaatttgaggtcttgttgattcaccattctgctcttagcttactggagaaatacttgactcctgaacaatgagtctggactttgtagttcctgggttgctttttttttttttcctttcttatgtattgacataaataaactcacattaactgaaaaaaact

SEQ ID NO: 21854 - DNA, 213 bp, Homo sapiens
aaaacatcaagctaactcaatagagaggcattctacaaaatacctgattgtatacatctcaaaaccacgaaggtcttcaaaaacaaagtctgagaaactgtcatagccaagaggaagctaaagggacatgacaactaaatgtagtgtgatatcctggatgtgatcctggaacaggaaaagaacattaggtaaaagctaaggaaatatgagtaa

SEQ ID NO: 21855 - DNA, 794 bp, Homo sapiens
ctcatccagggcggacagagaggatcggagacagcgatgggcgctgggggctaggtgagagctgtgcctgcaagagagcttcttgggcatctcaaaggagacactccacaaaaatatcgcttcaatgcactcctttttggaggcatatcaaaagcagccctcttttatttccatgccttgcataatagcagatttccagtcccaaagtgtagaggagccttgctctcggcgcagaggccctttgtaaaactacagaaggctttgtcttccctcccaaccgggtctgtttcatgcataggtcagagcattgatgtgctactagccaggaaaaattaaccaggtgaacactctcctcattaaacagcgacagagtttaattgtgaatttgctctcttccccatctccattcctggccacgtatttgactggggcatgtgcctgggacaaactgagaaatggcagggcctatccagcttccccctctggggccaggcctcctccatttgaggcaggtaggcacctggcagggaagggacaattcagagtacacaatgcacacagaggatctgagaccccctttggggccagcttcagaggctagctctgtcatgcgccagctgccatcaggcacaccccaccttcttggcctcccctcaccagccaccccaatctttgcatgcacagtcctcagcctttagtgaacctggttggtccctgtggcctccagcatctgtactattctattttctcacctataccgctcctcggttggggtctggcctgtctcctgccaa

SEQ ID NO: 21856 - DNA, 369 bp, Homo sapiens
acacaaaagaggacatactggatgcttccatttacacagttcaaaaaggggcatatctaatatacagtgttagaagtcaggatggtgggtttctttgaggaaggaggaggtggtggcttgaatgggcacaaggaagttgtaggggcactgtaatggtccagtcttgattttgttagtaattacaaattaattaggtatgatcaattttttgaaaatttcctcaagatccactttcctgtatatatatttcaatggtaaatttgcgtaacaaaaccttagcttaatcagagaaccacagattttaaaagaatgttctgaaccatcaacgatgtatccaaatagttttctacaaacttgcagcttaggtga

SEQ ID NO: 21857 - DNA, 774 bp, Homo sapiens
agagagccacaggaatgaaatgcagagaacattgtggagatatattttctgttatccccattcgaaatagatcaggctgcactgataacagctgcaaaaacaattggggaccttattcataaaatcaaaggtaaactgccagatggcaaccaaccagaggacctgaggatgaagaggattgcaaaatgctggtgacatagagaacaaaccctttggagaataaacatgtctgtatctttgttaaaatgtagaaatcagaatttttcccaaacttgcaagtaatagagaataaaataaaaacaacaagtgtttgttaactagaaagtttgcctatggaaaaaaacaattttcttagttgaaaatgtgacgggctgttcaggcttctctgtcattcttcttgtctctcttcataatctctatgtaatgcagaaacagccagtaaaagaagagaatctgtgcgtctttaattacttcctgtaagtttcacaagtactaccacagtctcattggctatgctacatctaaataagccactctttcaaagacagcataattatttgcatacacttgcttccctagctatatatcatgcctatcaaaactaagtgcttccaacctaccttaacagtgtcttagcatctatctcacttgttactaaattctgtgttggtaaatattcaaaccatttatgataatatatactcataatctgaactaaaacccagaacagaatttattaaaattgaggataaaaataaactcaatctttatgac

SEQ ID NO: 21858 - DNA, 257 bp, Homo sapiens
taaatttctacatttagattttcaaaaatatatcctagcaaaatgctgccaactttcttctgatgtgaaggactgtcctttattctaattatagatctctcttggtgtaaggtaaaaatattacttttttgacattaggttgatagtaagatagtagagtttattttgcccagtacatattaaaaactgtcaaccttaggttgggcccgtccttttaattttttaatattaagagtccatattaagtggtccaaaag

SEQ ID NO: 21859 - DNA, 452 bp, Homo sapiens
ctgccttggggcataggaggggaggaactcagtctggccacactggctcaggtgagggcgccccaggggaggccgagaggggctgttctcttgtctgctttgctatcagggactgcctcgagatgtctttggagaaagtgttcctggcttgctgggaaggatccgtgttcagctcccgctgcccagcagcttccatgggaaccttgccctcctggggtctggatccatcgcgacgtgaaggtgatcatcgcccacccccgggacactgtgggggtcaagagaggccccgtggtgagggaggatcatcatcctgggggtcgggggggtttcctcctcagggaggaagatttccagccccggtgctctgcctccggcagactctgtcttgcccacccgctttgtctttgtcgcatgatggaaataaatggaaatggtttccacacacgaatgca

SEQ ID NO: 21860 - DNA, 367 bp, Homo sapiens
gtgcgccactaccttccctccagttttcaccaggtcttgggttcatcctgactccctccttcttctctccccgtccctgccacacctcactgctcacaagaaagacatcactgtgtccgttctccttttttcttttcttttctttttttttttttttttgagacagggtttcgctctgtcttccaggctggagtacagtggtgcgatcttggctcactgcctcccaggttcaaaaaattctcatgcctcagccttccaagtagctgggactacaggcacgcgctaccacacccagttacatttttttgtgtatttttagtagagatggcttttgccatgttggccatggctggtctcaaactcctgg

SEQ ID NO: 21861 - DNA, 1178 bp, Homo sapiens
gaaattaaaatatttattatgatttttcctcatttatttaaaaagacggacataaaaattatacaacaaaaaacccaagtcacatttcaggaggtaaaaactaaaaagtctgatatgaaaatatggtggttagcatttgtgaaagattagatattgaagagaaatatattattgaatgggaatatacagcaaaagaaactatgccaaataaaatgcagatcagagaatttttaaaataaaaagagcattagcgggcaacagaaaatcttcaagtggccgacagatgtgtatttctgtccattaaaaagaggaaggagagatcatggcggacgggaggcaagactagcctgcagctctggacagagcagcgagtgggagctcgcattgtaaactttagctccagatggacggcaaaaacaaaccagcaatccccagaggacccacagaccctctgaaggaagtgggctgctcctgcaggacccgggagacccccaaaactgtgagtgtccagctgccgaagtgggaaagggaaaccctcctctccggaacagacaccccctgagaagtctatttgtgggagaagtttccgactttacctggagctgagtcagtctggagagctgactgaaatacagggatagaggaggcagcagcaaggccctgggagctgaatgggtccccgggcagcccattcctgcctggcaccacagggatccaacgggagaggaacagagggtaaaactacacggagagaaggaaatctctagctgaactttgtaacaattcgaacagcgtgagaagtctcctggccagaactcgggggaggacacaaatctcctgcacagtttaatatccaagagtcacacgtggagaggaagcattcacaatgagacattgcaaccatttatctgtcaggtcctagaagtgttggcagagctgcaggattgactaggtacacggctggggggggaaaaaaagacccgatggtccgatcaggaaacagagaaaattcagggaccctaaaattttcaagaaatcacacacccaagcaggtcgggccagagaaccctttgatgagaggccgtcacttgacagatgcgcggagcacgtcacccagagaatgggaggtccagctcgatgtacgacccgagagaaggagaaacggcaaggaaagaccc

SEQ ID NO: 21862 - DNA, 731 bp, Homo sapiens
tcacttggtaaaactgagatttatccttgctgttggatccagttcattccttttcactgttagttactattctattatatgaacacacaatttgtttatccatttatttgcaggtggatatttgggttgtttccagtttttgtcttattacaaacaaagctgctataaacatttgagtacgaatctttgtatagaaatatttcctgttttcttttggcaaataaaagcagaatggctgaatcattatgacagatacacgtttaacttttaaagaaaccgctgaacttttttcaaagtgattgtaccattttacaatcccaacagtgtttgaaggttctagttcctccacattctcaccaatacttgctatggttaatgttaagtctatttaattttagccatcctaataagtatgtcgtggtacatctcactgtggttttaacttgcattttcctaataactaatgatcttaacatcttttcacaaatgcagctttgtttttaatagtaacatgtgagagataaaccaaaagttcaccaacagagggctaaaaaaacatccaatgaaatggaataccatatggattaaaacacaagaaagctctaagaactgacatgaaaaagtccaaaagtagctgggcgcagtggctcacgcctgtaatcccagcactttaggaggaaatttttaaagtctttgctaatttaaattctattttttagaaaccctatatg

SEQ ID NO: 21863 - DNA, 441 bp, Homo sapiens
cttgttggtcatttaggcacaaactccaaatgatttcccatgcaggtcagttcaaggaggagtgagagggtcgaaaatcaatctatgtggatgtgaatctaaagccaactggtggatgtgagttttcacttaggtggtcttgaggtggccctaaaaatcctggacactgtaccagtgtaaaataggcctgacacctgaatcattttcccagactgagaatattggccagaagcccactgtctagggatgtgtgtaggtaacagctgttctctttcatataatacagcaggatgggcactgggtgtttcagctctaccattcactcagtgagaaaccttatgtaaattaccttgtatctccggctctcttacctgttttccaaacccattagtggttcagaaaagcatggtcaccatcatcagattttaaaatcagagtgca

SEQ ID NO: 21864 - DNA, 427 bp, Homo sapiens
gatcgtgccactgcacttcagcctgggcaacagagcaagacttctcaaaaaaaaaaaaaaaaaaaagtatatagagcacctggtgcatagtggatgctcaagagatgttattcacacttaatgatgtatatactctgctggtatgtaaacagttactgtctttctgaaggacgatttcttaattcttaccgagagctttaaaaatgagtgttttctgtatgactcagcaatcccataactaaaaatttattctaaggaaataattaaagatgtgtgcacatctggtcacacgtggcacctcactcctgtaatcctagcacttgggaggccgaggcaggaagatcccttcagcccaggtgttcgagaccagcctgagcagtatagtgagactctgtctctacaaaaaataaaattagtaagagaaaag

SEQ ID NO: 21865 - DNA, 717 bp, Homo sapiens
tctatcctgctagtggaaaggttactgtttgaaaaatgtagttccaacacagccactagtttgtgctactttagacaagtatttaaatctttgcaatagagatattataatagagcattccttgccttggcacaaggctgttgttaaattggaagactaaggatatgaaagaattttgtaatgtataaagaaatcttggccaagcacggtggctcatgcctgtaatcccaacactttgggaggccaaagtgggaggatcacttaaggccaggagtttgagaccagcctgggcaacatagtgagaccttgtatctacagaaaatttaaaaattggctgcatgtgctggcatgtacctgtagtcccagctactccagtctgggtgacagagtaagaccctgtctttattaagaaagaaagaaatcatatgtgcattataaagattttgccactcttaagattgagtgcaaggatctatggtaacacttcccagttgatgaagaaattgggcattagataatgaaggttttgcagcagtaattgagtttgagctattttcatgacagtgtattggaaaggtgatagaggagttgtctcctaaaatgagggaaaacatcaatacaaaatgatggtaagaaagaaatgaaaatatttgtaatgatgctttaaagctttagggtacttttaaaataccctaaatatatcaccttactaagcca

SEQ ID NO: 21866 - DNA, 421 bp, Homo sapiens
ctgatcgtgtgagtcaatactctttcataaactctccttcatgtatacacttatcctattagtcctgtccctctagagaagcctaatacaatgaggaataatttaatttttcagttttttagcacttaatttatatttttggtgcaaatatatccacatttgaacactttgaagacaattacatttactttttaattctttaaataattgagggtgaatacaagtcaaaattgtgataaaaatagattgagtagaaatagcaatcatttggttatgcatgcctgtagtttcagctactcaggaggctgaggcaagaggatcccttcagcccaggagttcaaggctgtagtgcactatgatcatgcctgtgaatagtcactgcactccagcctagacaatctagcgagacaccaactcttaa

SEQ ID NO: 21867 - DNA, 700 bp, Homo sapiens
ggattagctctagacggcactacagaggcatttgaactttctttctttgcctctctatgtctctctgtcttttcctgtcttctgatttatctgtctttctttctctagtaaatggcactcaatataaaagtggtggagtcaatcttaaacttatttttattatgattgtattgatacatgcacgaagtccctctgccctactccctattcaaggatattactcactgcacatcataaatctccatcatctgtcttaaagttttatgagtagatttcatctacattatattcaagttcatttattactgagctgtattactgtggagctctaacagtatttgtttcctgatttcaaactcaatgctacagagcactttgaatacatcacaccttataggaaagatagtaaatgtattaatcccattgaaaaattagttttgtacaatgtgctaaatagtattgcattggattacttttatatttaacacactccatcaaaacatcccataacataattttacaatctgcatgtgaatttaactgtgaaattcagtattgtgatattttgaataagtgaattctttctctgcaaatactatgttgataaaattacttgtatgttcccctgaaatggtttgtttcctgtttcttcattattaaaacataaatcaatcatatgtttacagataaaaaaaaatgg

SEQ ID NO: 21868 - DNA, 324 bp, Homo sapiens
cccctgccccccatgaggagggagtcgggctctggacctgactcatgttcataggagggtgtgaacccagtgcaaggctgaggttgagcccaggcttagggagtggggaggctgctgaggacggaccatacctgctcccactgtggagtctgcaggacaccaggtgatataagtcatgattaaattgggatatactcttcaatagatttgaaatgacctgtcatggaaataatgcatatattaggaagaaaaaaaatcagggatagatagatagatagatagatagatagatagatggatagatagagagaaggaatcaagacc

SEQ ID NO: 21869 - DNA, 1862 bp, Homo sapiens
  misc_feature (557)..(557): n is a, c, g, or t
  misc_feature (667)..(667): n is a, c, g, or t
  misc_feature (681)..(681): n is a, c, g, or t
  misc_feature (763)..(763): n is a, c, g, or t
  misc_feature (800)..(800): n is a, c, g, or t
tttttgttttgttttaacttccccttgtttcaagacaatgctaaggaactttaaaattgtagcagttcatatttgctgggctcttactgtgtagtggcagggttgtaattgcgttacctatattaactcagtcaatccttacaacagccctatatgactggcataattatacccttgttttgtgcatgaggaaatacagggaattgacatactggatggcagggctgggactcaaggacagtctgactctggagcacagctcttttgtttttctttttttcttttttctttgtgtttgtgtgtgtgtgtgtgtgtgtgtgtgtgtgtgtgtgtgtgtgtgtgtaggagagagagacagagtctcgctgttgcctaggctggaggtgcagtagctcaatcttggctcactgcaacctccacctcccaggttcaagggattctcctgcctcaccctccccagtagttgggattacaggcgtgtgccaccacccccagctgactttttgtgtgtgtatgtgtatgtttttttttttttttttttgagacggagtctcgcnttgttgcccaggctggagtgcagtggcgcgatctctgctcactgcaagctctgcctcatgggttcatgccattctcctgcctcagcctcccaagtagctgggactacagncgccaccaccacgnctggctaattttttgtatttttagtagagatgaggtttcatcgtgttagcaggattgtctcgatctcctgacttgtgatccncccacctcggcctcccaaagtgctgggattataggcntgaaccactgcgcccggccgactttttttttttttttttttttctcaagacagagtctcactgtgttgcccaggctggagtgcaatggtgagatctcggctcactgcaacctccacctcctgggttcaagcgattctccttccttagccccctgagtagctgggactacaggcgtgcgccaccacacccagctaatttttgtatttttagtagagacagggattcaccatattggctaggctgatctcgaactcctgacctcaggtgatccgcttgccttggcttcccagagtgctgggattacaggcatgagccactgcggccggccgaggagcacagctcttaactgccacactgtgctgccacctgccttttaatgtgcagtagagtcgtggcttgttaattccatcacttaaaactcatccttagtggcaggggcaggggcttgaacacacttctctcaggagagcaagccggtgagtagaagttcctgggacagtggctgacacatgctaggtggtcagtgagtagttagttgttcgtgaaataaatggggctgggcacggtggctcacacctgtaatcccagcactttggaaggccaagatgagcagatcacttgagcccaggagttcaaaaccagcctgggcaacatggcaaaacctcgtctctaaaaaaaatacaaaaattagccagatgtggtggtgtgtgcatgtagtcccagttacttgtggggctgaggtgggaggatcacttcagcccaggtggttgaggctgcagtgagctgtgatcatgccactgtactacagcctgggggacagagcaagaccctctctcaataaataaataattaacacacaattcatggaagagtcatgcactgggattagcccagctctacagctgatggtcttaggcaagtgcatctctcttggagtaaatcattctaacccataaaatgggtgtaacagtttgtcttgcctgcttcttttggtaattggaaggattgaatgagacaaggtcctgtgtaaacagaataaaaatttttgtaaagtcttaaaaa

SEQ ID NO: 21870 - DNA, 575 bp, Homo sapiens
ttctcccctcccccgccagcctttttgcaaaggctgagcccagtccagccaggacggccgagggatctctgctccgggacgcgatttgctggcattgtcttcgggcccttccccagcggccccgcctccccgggtgaatccccggcggccagcgcagcgcaggcagcgatcctggcggctgccggggccggcagcttcctggaaagttacttcttgttggagccggcaataggcaaagtgtgttctgtgaaatccgcagagccgagattgactacgttccgggaatgagagggctgtgtcattcccctcattgcctgctgcattgacggcgtaacaggaaaaaaaaaaaaaaaaaaaaaaaggcatacacacaatgttagctaccgaggtgcaccaaaagttttatttgaatgtaactaaattaagggccgccacggtcataccacaaagcctccgtcgcgccttgcggggggcttcgaggtggatcgcccaggggcgggcagtccctggaagacaggtacggagtggtcggggtggggtagcgaagtctgcctaggcttgccccggcgcgcagg

SEQ ID NO: 21871 - DNA, 386 bp, Homo sapiens
ttctcccctcccccgccagcctttttgcaaaggctgagcccagtccagccaggacggccgagggatctctgctccgggacgcgatttgctggcattgtcttcgggcccttctggaaggctgtctcgcgctgagcgtatggggaacgtcccttctgcaactcctcttcagatcttgatgataaaacacatccctctgttttattgcatttcctagaagcttgcaggcttgcaagagcactgttggcaggaaacgtgatagaaatgaaagtcaggacacaatgtccccgaacacctcggttatccaaagcggctgtcgaggccatcgcgttatcaaattcgcttttatttactgtcgtctcctgcaccctcccgttccccagccaaga

SEQ ID NO: 21872 - DNA, 1732 bp, Homo sapiens
actacggcacgaggccttattaaaattccttgtccttgtccctaaacagtgctttacactttcagatttccctttggatttttcagcgggttattggagttattagattaccaataatccaacagcctctgtagcctctctggctggagaggaggggggaagggcggaaggcattctccaaatcgggaggctctggccaaactaggtcaatgggaaggaggggaggggcgagaaaggggttgacggtttcaaaccttgatggagggctctctctagcgttaggcagcggtaaaaacaccattcggtttgagctcccggaaccacgggactcctaatttccaataaatgcacttacttcattttaacttcccagattctcatccctaccccttattaaatcccaaccgtctctttcacctttatcccaccgggcgaaggggtgagaaagcctcaatgtaggattttgaggccaaaggctcgttctttgcagaccgactctgacccttccgcttgccgcagaagggatgagcggcgcagtgtgacgccactggctagttttaggaccagactgcggcctttgtggctgagtctttcgctgtcccctagcccccgaaagcgcaccccggagcctgctaccgagaccaattaggacatggcacccgggggttataattcccgggagggccacaggaaggcgaggcaactttggagagtgccagtgcgcgcgcaggggtcggggccccggcctttgccgagtccaagctgtgtctctacggtttcggggaaatcggattcggaaatccttacggcttggcagctcctgttctaaagactttgggcggaaaccaagtggagctgggttcccgttcttgccaacgtaggcggaaggggctttctgtttagtttttctccaaccttgcctggggcgcctatgatggagaccctcagcccctagggactccatcttttgaccttgaagtctcgctcaaacattcccctaaaagaacgggggtgagggagaatggaaggcaaaaagagggaaaaaagcaaataaacttcggaatcggacaacttaaagtctcgatatgagcctcggattgcattcgaactcctgggttctagacccagctctgctactaacttgtctgaccttccccatttataaactgttgtgggtgagaggtgggactaggtgaactctgagagccctgcactcggcgcggacgagggatttaggggaaagtgtgctgtattccccgcgagccttccccagcggccccgcctccccgggtgaatccccggcggccagcgcagcgcaggcagcgatcctggcggctgccggggccggcagcttcctggaaagttacttcttgttggagccggcaataggcaaagtgtgttctgtgaaatccgcagagccgagattgactacgttccgggaatgagagggctgtgtcattcccctcattgcctgctgcattgacggcgtaacaggaaaaaaaaaaaaaaaaaaaaaaaggcatacacacaatgttagctaccgaggtgcaccaaaagttttatttgaatgtaactaaattaagggccgccacggtcataccacaaagcctccgtcgcgccttgcggggggcttcgaggtggatcgcccaggggcgggcagtccctggaagacaggtacggagtggtcggggtggggtagcgaagtctgcctaggcttgccccggcgcgcagg

SEQ ID NO: 21873 - DNA, 1742 bp, Homo sapiens
cactcttcgccctcttggctggggaacgggagggtgcaggagacgacagtaaataaaagcgaattccactttcagatttccctttggatttttcagcgggttattggagttattagattaccaataatccaacagcctctgtagcctctctggctggagaggaggggggaagggcggaaggcattctccaaatcgggaggctctggccaaactaggtcaatgggaaggaggggaggggcgagaaaggggttgacggtttcaaaccttgatggagggctctctctagcgttaggcagcggtaaaaacaccattcggtttgagctcccggaaccacgggactcctaatttccaataaatgcacttacttcattttaacttcccagattctcatccctaccccttattaaatcccaaccgtctctttcacctttatcccaccgggcgaaggggtgagaaagcctcaatgtaggattttgaggccaaaggctcgttctttgcagaccgactctgacccttccgcttgccgcagaagggatgagcggcgcagtgtgacgccactggctagttttaggaccagactgcggcctttgtggctgagtctttcgctgtcccctagcccccgaaagcgcaccccggagcctgctaccgagaccaattaggacatggcacccgggggttataattcccgggagggccacaggaaggcgaggcaactttggagagtgccagtgcgcgcgcaggggtcggggccccggcctttgccgagtccaagctgtgtctctacggtttcggggaaatcggattcggaaatccttacggcttggcagctcctgttctaaagactttgggcggaaaccaagtggagctgggttcccgttcttgccaacgtaggcggaaggggctttctgtttagtttttctccaaccttgcctggggcgcctatgatggagaccctcagcccctagggactccatcttttgaccttgaagtctcgctcaaacattcccctaaaagaacgggggtgagggagaatggaaggcaaaaagagggaaaaaagcaaataaacttcggaatcggacaacttaaagtctcgatatgagcctcggattgcattcgaactcctgggttctagacccagctctgctactaacttgtctgaccttccccatttataaactgttgtgggtgagaggtgggactaggtgaactctgagagccctgcactcggcgcggacgagggatttaggggaaagtgtgctgtattccccgcgagccttccccagcggccccgcctccccgggtgaatccccggcggccagcgcagcgcaggcagcgatcctggcggctgccggggccggcagcttcctggaaagttacttcttgttggagccggcaataggcaaagtgtgttctgtgaaatccgcagagccgagattgactacgttccgggaatgagagggctgtgtcattcccctcattgcctgctgcattgacggcgtaacaggaaaaaaaaaaaaaaaaaaaaaaaggcatacacacaatgttagctaccgaggtgcaccaaaagttttatttgaatgtaactaaattaagggccgccacggtcataccacaaagcctccgtcgcgccttgcggggggcttcgaggtggatcgcccaggggcgggcagtccctggaagacaggtacggagtggtcggggtggggtagcgaagtctgcctaggcttgccccggcgcgcagg

SEQ ID NO: 21874 - DNA, 1678 bp, Homo sapiens
actacggcacgaggccttattaaaattccttgtccttgtccctaaacagtgctttacactttcagatttccctttggatttttcagcgggttattggagttattagattaccaataatccaacagcctctgtagcctctctggctggagaggaggggggaagggcggaaggcattctccaaatcgggaggctctggccaaactaggtcaatgggaaggaggggaggggcgagaaaggggttgacggtttcaaaccttgatggagggctctctctagcgttaggcagcggtaatgcacttacttcattttaacttcccagattctcatccctaccccttattaaatcccaaccgtctctttcacctttatcccaccgggcgaaggggtgagaaagcctcaatgtaggattttgaggccaaaggctcgttctttgcagaccgactctgacccttccgcttgccgcagaagggatgagcggcgcagtgtgacgccactggctagttttaggaccagactgcggcctttgtggctgagtctttcgctgtcccctagcccccgaaagcgcaccccggagcctgctaccgagaccaattaggacatggcacccgggggttataattcccgggagggccacaggaaggcgaggcaactttggagagtgccagtgcgcgcgcaggggtcggggccccggcctttgccgagtccaagctgtgtctctacggtttcggggaaatcggattcggaaatccttacggcttggcagctcctgttctaaagactttgggcggaaaccaagtggagctgggttcccgttcttgccaacgtaggcggaaggggctttctgtttagtttttctccaaccttgcctggggcgcctatgatggagaccctcagcccctagggactccatcttttgaccttgaagtctcgctcaaacattcccctaaaagaacgggggtgagggagaatggaaggcaaaaagagggaaaaaagcaaataaacttcggaatcggacaacttaaagtctcgatatgagcctcggattgcattcgaactcctgggttctagacccagctctgctactaacttgtctgaccttccccatttataaactgttgtgggtgagaggtgggactaggtgaactctgagagccctgcactcggcgcggacgagggatttaggggaaagtgtgctgtattccccgcgagccttccccagcggccccgcctccccgggtgaatccccggcggccagcgcagcgcaggcagcgatcctggcggctgccggggccggcagcttcctggaaagttacttcttgttggagccggcaataggcaaagtgtgttctgtgaaatccgcagagccgagattgactacgttccgggaatgagagggctgtgtcattcccctcattgcctgctgcattgacggcgtaacaggaaaaaaaaaaaaaaaaaaaaaaaggcatacacacaatgttagctaccgaggtgcaccaaaagttttatttgaatgtaactaaattaagggccgccacggtcataccacaaagcctccgtcgcgccttgcggggggcttcgaggtggatcgcccaggggcgggcagtccctggaagacaggtacggagtggtcggggtggggtagcgaagtctgcctaggcttgccccggcgcgcagg

SEQ ID NO: 21875 - DNA, 934 bp, Homo sapiens
gtgcgcggaaaacctagtgggcgcggaaaacctagtgggcgcggaaaccaagtggagctgggttcccgttcttgccaacgtaggcggaaggggctttctgtttagtttttctccaaccttgcctggggcgcctatgatggagaccctcagcccctagggactccatcttttgaccttgaagtctcgctcaaacattcccctaaaagaacgggggtgagggagaatggaaggcaaaaagagggaaaaaagcaaataaacttcggaatcggacaacttaaagtctcgatatgagcctcggattgcattcgaactcctgggttctagacccagctctgctactaacttgtctgaccttccccatttataaactgttgtgggtgagaggtgggactaggtgaactctgagagccctgcactcggcgcggacgagggatttaggggaaagtgtgctgtattccccgcgagccttccccagcggccccgcctccccgggtgaatccccggcggccagcgcagcgcaggcagcgatcctggcggctgccggggccggcagcttcctggaaagttacttcttgttggagccggcaataggcaaagtgtgttctgtgaaatccgcagagccgagattgactacgttccgggaatgagagggctgtgtcattcccctcattgcctgctgcattgacggcgtaacaggaaaaaaaaaaaaaaaaaaaaaaaggcatacacacaatgttagctaccgaggtgcaccaaaagttttatttgaatgtaactaaattaagggccgccacggtcataccacaaagcctccgtcgcgccttgcggggggcttcgaggtggatcgcccaggggcgggcagtccctggaagacaggtacggagtggtcggggtggggtagcgaagtctgcctaggcttgccccggcgcgcagg

SEQ ID NO: 21876 - DNA, 224 bp, Homo sapiens
gtgtatctatatgtaattaaaattaggtcattagggtgggctttaatccaatatgactggtgtccttacaaaaatagaaatttgaacacagccacatacaggaggaatatgatgtgaagacaaagggagaagacagccatctataagctaaggacatggacctggaacacatccttccctcccagccctcagacagaaccaactctgtagatcaaccaacacct

SEQ ID NO: 21877 - DNA, 403 bp, Homo sapiens
ctgtctcccaccaggagagttttggccacgtttacaacctagttctgcccatgaaggcaccagctgtcaccagctcaaccacgcagtagattaggcactgcatataaggcattggcgactcactgacaaacaagttgcacttcctgaagagagtgtgcaactatggtccactgaaagagacatccagaaagtggctgtcaatgacagaagtgagaaataagactgcaggacttacttagaagccacatttttcttctggtccataaactgtgaatctttgtatggtttgcaaaaccaacgaccccagaggtcaagcagggaaaacaaaactcatcatctgtaaacctgatccagttttgctttattctgatttttgccattaaactttaaacagagaaaactt

SEQ ID NO: 21878 - DNA, 252 bp, Homo sapiens
cttcacattcagaacttccctcactctcttctgtcaacaaccatagcttctagatctttctttgtcacctctattcaacctcattcaactcaacctcttttatttgatgctatatgttcttacttgactgaggtccttagctttactaacttgaggcatctagcacacctcaatgctactttctatttgtttctcacaaccatggttatctgggaagtccctgtggctccaggatctcctgtctggaccaga

SEQ ID NO: 21879 - DNA, 377 bp, Homo sapiens
attccaaacagtaggattttaatctgggttgccacagaagtctgtctatgggaaaagaatatgctggagatgccaccttgagtggttcagactccattgctataattgtaggagtagttgtaatagtagagatagcatttatttagtacttatatgtgataggtactatgctaagtgcatcctttgaacaacatacagttggttcctgtttaaatgatatttgtatcaagttctttcttctaaatgtcactggcatgaacaacagggtatatagagctaggtatctactgtttcactgactaatcctgaatggccctttttactcctctacctaaccagcccatgattcattttcttcttgctagaaatagaagcaa

SEQ ID NO: 21880 - DNA, 1308 bp, Homo sapiens
gctttatggaggtataatctatataccataaaatccacttattttaatatatgattttagtaaatttaaagacttgtgcagcccttaccacatcatacaaaccagaatgtttccatcacccaaaaagaaacttcatgtctatttagtcactccctgtttctactcccagctctaggtggccattaatctgagtatctctagatttgtcttttctagacctaaacatcaggtttttgtttttctgcagccagagttgagaaccataattctaaatgcattatgagaaataatggtttttaaagattatatataatattttacgtattttcatatttatgactcccatccttacagtgaatgcgtctatcaccagtaagacaaagatcattaatttgataatggaacttaacagaccattctttccttttatacattttagtatcatattcaaaatggcctcccattctgtccccaagttattttaaaacatctccagtcttgcttttttcccctttagctcataaatgaatagtgctggaagatatctcaggagcattctccctgagatgatgtcttcagtaatgatcgcacgtattggtgttgattccatccttgaagttactttcctttatctttcacagtggtgtttcttcactagaggttttgctgtctgattaacttctctgccaaataaatggacttttgcttcataggtacacaaacatttctaaaactttttttggaaaatatatttctttcttaaaaaaacaaatagtgcatgcacatttttaaaaaaataaataaaaaataatctaccccaaaatgaccagttaagatttactttcagacaactctgtgcatatttacatatgcttatatacaactatgtacacctttgcatagatgagatcacactctatgtactgctttgtaacttgcttctttcacttaatcctgagaacatttgtacatgaccatagatatagatttgtattgtttttaatggctgtatagttttgcattatactgaatcttgatgtttaagagctatgtatattgaggacattatttctttgtcttgtgttgcaaattttttaccatgttattattagtcttttaaccttatttatagtttttttgttataaaagttaagttttatgatgtaaacttaatctctttgattttataattcctggttttcccgacgtgcgtagaatgaccttccccacaaggtaataaaaatacctccatgattttgcttaaaacttttatgctttatattaaatctttgttacatcttgaattga

SEQ ID NO: 21881 - DNA, 440 bp, Homo sapiens
ggggccgggagagcaaggcaacccctacttgcagaaggatgatggtcagcttgtggacagacccccagtgccccacgcagcagcccctccatggtgaccactcaaaggcgagtcagggctggagagcagccaacaggtcccacagtctgtcccgggcactgcaggaggctgcccctagggaaacatggctgggagtaagagtgaaggaggggcaggtggagtaggaggccagatgtggtggctcacacctataatcccagcactttgagatgccgaggtgggagagctgctagcagccaggagttcaaaaccagcctggacaacatagtaagcccctgtggctacaaaaaattttaaaattactttgggagggccaggcgcggtggctcacgcctgtaatcccggcactttgggaggctgaggcaggcggatcacaacgt

SEQ ID NO: 21882 - DNA, 642 bp, Homo sapiens
tgagacacagttttgctctttgcccaggctggagtgcaatgcaatggcatgatcttggctcaccgcaacctccgcctcctggtttcaagtgattctcctgccccagcctcccgggtagctgggattacaggcgcccgccaccacacccagctaatttttgtattttcagtagaatcagggtttcaccatgttggccaggctggtctggaactcctgacctcaggtgatctgcccaactcggtctcctaaagtgctgggattacaggcatgggccaccacgctcggcccagacagctcattttaaagccaatctgaccatatcacatccccacatctaacctcagaaagcttcgcattttccttagggccaacacggaactccttcccaagccccgcaggacctgcctcctccctggtcccagggccgctctcttgcctcatctgcagttgactaagctgcagccagtccagccttctcatcgacccggataactcagcctcaggatctctgctcctgtggttccctgcccccagctagcccagcccttcagtctcaagccttgctcagatctgcctcccccaagggaggctccagcagccccgcccggcacatgtggcatcacggccactcacccggggtca

SEQ ID NO: 21883 - DNA, 948 bp, Homo sapiens
tcgagccctgcagcccggcgaaatggctcccggcggggccgtttgcgcatgcccagtcatgacggttgtcggcgcgggccctagcgtggcggcgctgcagtctgggcagtgggttggttcctcctcggtcctctgtcgagtggcgacagggcctagccacctggcgggggtgaccttcggacgtgcgacccgctcggagaagggagggaactgtggcccgcaacaaagcagtgacaggcccgacatcccctgcagcgcgatctttccctcagctgcctgccggaggaagggcctttctgtttcacagggctaaagatggggcgcggttcctccacggggcggctgccgggtgaacggaacggggatggaggcgctgccagaagagcccgagctcgagcccgccctgccctcggcctccccgccgcgccgctccgcaggagccccgctcctctcctgctcgctccggagaaccccagtccggcctgacctcggccctcgcggtcaggcgctccaaccagagcgactccagctcgaacagcgctgggtaaactgaggctgaaccccgctggctgcatccccaggagtcgggcgtttacggtcacgggaacaggttaataaacttttacgcagcagacccggaacttaggtcccgatgtccgggtatcttaagaacaagaagcattcttagttgaagtttcgctttaaagataatgatacagatgcttgcggaggacaggcgttatgcaaagattggcaatcctttgacgagcccaggtagtacagcacgtctcccccgtgatgttttttggcttttatcttacatataaacaagcgtacccaggtggacgccttcctcctcgtgcttttgggaacaccctgctctatggagtagccattcttttattccttcactgccttaataaacttgctttcactttaaactgtgga

SEQ ID NO: 21884 - DNA, 357 bp, Homo sapiens
gaagacagatgggtgaagtgcagatgtacatcgtacctgtgccatagaatattcttgctaaaagtggtgaagggctgggagagtggtggctcacacctgtaatcccagctaatcaagaggccaaggcaggaggatcacttgagcccaggagttcaagaccaactagggcaatatagtgagaccctgactctacaaaaactaaaataaaattatttgggcatggtggcatgtacctgtagttccagctacgtgggaggctagggtgggagcatctcttgagcccaggagttggaggttgcagtgagctatgattgtaccactacactccagcctgggtgatggagtgagaccctatct

SEQ ID NO: 21885 - DNA, 739 bp, Homo sapiens
tttttttttgagatggagtttcgctcttgttgcccaggttggagtgcaatggtgcgatctcagctcacgcaacctccgcctcctgggttcaagcgattcccctgcctcagcctcccaagtagctgggattacaggaatgcgctaccacgcccggctaattttgtatttttagtagagacagggtttccccatgtgggtcagtctggtccccaactcctgacctcgtgagccgcccgcctctgccggccgaagtgcggggtctacagacatgagctaccgcgcccgggaaagccaagcgttttcctacaagaagccccagtagagcgagctaggcttcaacatgcgcgttctggagagaaaacattgactccacaacagtggtcctttttgttttaaattaacatccccgactttttttatccttaccatttttataaaatgccgcgcgcttgcctcttggcaggcgtagggtttccctggggctgctgtggagaggccgcactggctggaaacagccgggctgtgcggctgccagaggcagcgtgtgcgcagcgcttcctgcagccacgtagcatcttctgccgcatcgcgcactcagctcgggcgggcgtcgggagtgagggcccggggcgcagggtcagcggccggggcaacaccctccctggttgcccaaggaacagaaggggctgggccacgcggggggttcttgactcctgagggcagctgggtgtcctgcagg

SEQ ID NO: 21886 - DNA, 357 bp, Homo sapiens
gagcattgccttctgcaggccctgccctttgtggtccctgaggatggtggcagactgctcctgctcttggggactttttcctcttaaatgctctgacacaaagcaatgctacaaaggtactaataccaaatatgacattgatgactgcatttaagtatgagtcattactttgtcatggctgtgatagaacttggaagatctgagaaaaaattggaaggcagcatctatataaataggcatgagcaattctgagggggcctggcatctgctatctactattttcagtgttctctgcccacatcagagttacgaggattgctgctattcacaattccgtttaaagactcataggaaaaa

SEQ ID NO: 21887 - DNA, 465 bp, Homo sapiens
  misc_feature (409)..(409): n is a, c, g, or t
  misc_feature (420)..(420): n is a, c, g, or t
gtgaaatccagtaatggattgacctcatctaacaaaggcaaaagtggaagtgtttttgcagtttggaaaccatgaattttattttctctagataagctgcagattagctggtagctagcaaagaggccagtaaggatattctgatctcaggcacctagatgggtcaacaaagaaagcaatttcagttatctaaggactctttagaagacagaattttgctgttggcatgcgtgacaggctatctctgtacatctggcggtgtactttgttttctctgccgtctttgttattccaggtctgcaccatttccttctcagaatatctaatatgtgtccattagatgaaccataatggtgtgttagggttttgtatatccttgctttttttttttttaatgttactgatccgnctcaaaaaagnaataaataaatagtctattgcctaagaataatatcctattcctca

SEQ ID NO: 21888 - DNA, 810 bp, Homo sapiens
taaagataaagtccaaattctagaacatggcccacagcatttggtgcctcaccacctcttcagcctctcagttgctgttcacccatttctctattcctctccttctcacaccttgtgctgcagccacatagataacctgcagtttttgtaacgtgcaatgatgtctcaaattccaaggcattgctggtaccacacagcctgcctggtaaaatcctagacttctttcaagataaattcaaagacacctccatgaggtctttctacctctccaagtagagttgaccgctgtctcctttgtgtccccacttccaccaccatcctaaaatacttattatacttagattaataattgtcgctcttactgcactggaattaccctgaaaggaaaggccatgtattatttatcattgtcttcctagtacatagcccacagcctatacctcccaccccaaaaaaaaccttttgtaaataattgaacaaattaagaaacacccaaggcccccagtaaacatcaaggcctaaggaatgcatatctggattctaaataatcataaggttttacaacaccatgttaagcaccagggacttcagagagcttttagtctaaatcttattagagaggccagcaaagacctccaaaggaagtggcattgaactgagacttgaaaagccagtagttaggcaaagatagggagggaaatatttcagacaaagggaggagatggcacaagatttaggacacggaaaagggtatggtgcagtcatagagaaaacagatgtgcagaatggctggagccccaagagggaagg

SEQ ID NO: 21889 - DNA, 227 bp, Homo sapiens
gtgaatatgagcatccttgtcttgttccagatcttagaggaaaggcttcagttttttcccattcagtacaatgttagctgtgggtttgtcacatatggcctttatttttgcggggaggggtatgatccttctataccattaacattctattaatgtgatgtgtcaagtttattgacttgcatattttgagctattcttgcatcactgggaagaatctcacttgatcg

SEQ ID NO: 21890 - DNA, 371 bp, Homo sapiens
tcaaaggagaattagatatttaaaatgagtgaattgtatggtacatgaattagatctcaataaaactattttaaaaaaagaaactaaagcttagagaagtataatatcttgttcaatatgacactacctggtaaagcttttgtccaaatttttctgagaccaaagctattctttcttccactgacgcatgctatctctactaattatatagccacggtatcctttttctttaaaaatgtaggaaaaaatggctgggtgcggtggctcacgcctgtaatcccagcactttgggaggccaaggcggacggatctcttgaggtcaggagtttgagaccagcctggccaacatggtgataccccacctctactaa

SEQ ID NO: 21891 - DNA, 266 bp, Homo sapiens
gctaaaaacatttgtgcgtgaaaagacaccatcaaggaagtggaaagacaacccaagaaatgacagcaaacatttgtgaatcatctatttgataagggactagtatctaaacatgtaaagaactctaacttatcaacaagaagacaaaccacctacctttaatgatgggcaaaggattagaatagagcttgctccaaagaagatgtacatatgaccgataagctcatgaaaagatgtccccatcattagtcatcagggaaatgcaa

SEQ ID NO: 21892 - DNA, 500 bp, Homo sapiens
gcaagtctcacactcctggactcaagcaatcctcccactccagcttcctaaagtgttgggatgacaggtatgagccaccacacctgaccaataatgtatttgttattctgaagaatatttacctattctgacaatagaatattctttacaaattcattgaaaataacttttcaagagtggcgtgaagtaatacagtaagtttatgaacaatgaagcatgtgaagaacgtgtggagaatcaaggctgttggagcaacagttatgttgccttaaagagcaatgagattataactagagaggaaggtatgatagcatgtaaccctgatacaaaagtcaaaactgcaaaggttcagagtgtggtatatagatgtctatactttagaagaaatgatctaacaacatttctggaataccatgcacctggggaagttcaactgttttatttcataacttagcaatatttaatgttagtaaaattaaaaagtacaaagccagtaaaag

SEQ ID NO: 21893 - DNA, 367 bp, Homo sapiens
gctgagatcgcacctcaaaaagaaaccctgcctcaaaacaaaacaaaacaacaaaaaaaaaccaaccaaaccacaacaaaaaaacacctcaggggctgggcacaagtctcacgcctgaaatcccggcactctgggaggccgaggtgggcggatcacctgaggttaggagttcaagaccagcctggccaacgtagtgaaacccgtctctactaaaaatatagaaattagatgggtgtggtggtgtgctcctgtagtctgaggctgctgcaggagaatcgcttggacacgggaggcggaggttgcagtgagccgagattgcgccactgcactccagcctgggtgacagagcaagactccagccaaaaaa

SEQ ID NO: 21894 - DNA, 298 bp, Homo sapiens
aatgacatattttatagtattttccattcaagcattgcaattattactttatatgtactctcatttaatcactgatgtggtctcgctgtgtccccacccaaatctcatcattgtggctcccataatgcctatgtgtcatgggagggacctggtgggaggtaattgaatcataggggcgggtttatcctgtgctgctcttgtgacagtgaagaagtctcacaagatctgatgcttttataaagggcagttcccctgcacatgctctcttgcctgctgcctttgctcctcctttgctttc

SEQ ID NO: 21895 - DNA, 391 bp, Homo sapiens
tagtctaacaaattttattatgtattaagatgttgaaaacaaggcattctggcttaaagaataaagagataaaaagctttcctttattattaatcttgttcataagagacctgtgttgtaggccgggtgcagtgactcatacctgtaatcccagtactttgggaagctgaggtgggcagatcacttgaggtcaggagttcaagaccagcctggccaacatggtgaaacctggtctctactaaaaatacaaaaattagctaggtgtggtggtgtgttgtctgtaatcccagttactcaggaggctgaggcaggaaaattgcttgaacccaggaggcaggggttgcagtgagctgagatcgcaccactgcactccagcctgggtgatggagca

SEQ ID NO: 21896 - DNA, 515 bp, Homo sapiens
tagaggcagaatcttgccgtattgcccaggctggtcttgaactcctgacctcaagcgatcctctcacctcagcctcccaaagtgctgagattacaaacatgagcctccgtacctggccaatccatatatttaatatctcactttgactgttaatgttaatagctgataacattcttgaaggtagacatttgctccctgataatgaagaaatgctttgtttctgagtagaggtgatgtttttgtatttagttttctccacatatatctgtcccacttgcaatggatagtatttatctgcaaaacaactgttaactggaatgaattatcaaagaagatttatagaaaaaatttggtttgttggtggttgggaaaaaaaaaatcaactggccagcatggtggcttccacctgtaatcccagcacttcagggatcaaggtgggtggatcacttgatcccaggagttcgagacaagcctgggcaacatggcaaaaacccatctctacaggaaaaaaaaaa

SEQ ID NO: 21897 - DNA, 442 bp, Homo sapiens
ctctagagcctactactactaaattcgcggccgcgtcgactggccaatccatatatttaatatctcactttgactgttaatgttaatagctgataacattcttgaaggtagacatttgctccctgataatgaagaaatgctttgtttctgagtagaggtgatgtttttgtatttagttttctccacatatatctgtcccacttgcaatggatagtatttatctgcaaaacaactgttaactggaatgaattatcaaagaagatttatagaaaaaatttggtttgttggtggttgggaaaaaaaaaatcaactggccagcatggtggcttccacctgtaatcccagcacttcagggatcaaggtgggtggatcacttgatcccaggagttcgagacaagcctgggcaacatggcaaaaacccatctctacaggaaaaaaaaaa

SEQ ID NO: 21898 - DNA, 2481 bp, Homo sapiens
gattgtgccacttcattccagcctgggcgacagagcgaaactctgtcaaaggaaaggaaagaaaagaaaaaaaaaaagagagagagaaaagaagaggggaggggagggaaagggaagggaggggaggggaggagaggagagcagattgggggggctcatgttctgagagaaaggaataatagcatttgtctagtacattccagtttacaaagtgcctgatatacatgatctcctttaatcttcacccaatcctgtaaagtaggtgttagatccccattttgcaagtaaataagtggaggcttagagcagttaaccgctggcaggtaggtagctggttccatagcacatcattttcctgcggcatcacggcatggtgccgaagaagacagctgtggatgtcgttgactcagatgtgcccccgttggggtgggagaacccagggatgggggtcagcaagccaggaactccgcagggtttgtttttaaaactctgctggacagaagtggaggaggaaagaatctaaccatatgacttttataaaaatcctttcacttttcccctccccatttgaaaactctttttaagagtgaatgtagctgaaacacaactgtgtccagccattttcctgtctccacattcttccagatgtgtgacagaggagggactctgctcaattccagttgtgggtccccttggagtttacatcacttgtttttcaattcttggttttctgttcccttctaccaaaacccagcataggactcagtgtacacttactttaaaacaaaaactcacatttcttagctgcaggtgatggcctcagtcattttaatacagcctggaatgagtttgcttattacccagtcactttcgtagtgaatgttcaaaccccaaagcaaatgtttgcatctccttgtccataaaggagaaagccaggttataggagaaagagagagaaaggcgcatgtctgtttgcacagagagaggcaattttgtctacctttcgagaatcagttataaacagaagggcctcttaggattttgagctctcctgacaatgaaggaaaagctctcttgagtatacaagttccacactcattacctttcagtggtgacccatcacccactacaatttgttgaaggaagggagtgtcagagatatgctttaaagttgtactttaggctgaaattctctctgtatttggacctgcagatgttgtgtacagaaccgatgcatggcagggtcaggaagctaggagagtgaaggcgcttgtggagacagctctgtagcaaatgaaacacggaagcctccgggaatgtgtttgtgtcaccagcagcaggcatttccctgtcctccccacccccagtctccacatccccagcagcctcttccagaagcatgtcagggagacggacaggtgctctccttctcgtgcaccacatccaagtccacccaccgtggacgcagtgtgactaaatgctggccttgaagagaaaccctcagccagcttgtctgttgtccaggtccctcagtgtctctggtttccctgccctgcataatttaagcattagtgccaaatacatctgtcatattcctctccctggagactgcgaaatgtccagactttttcagactagtggagggaaggaatgttacataactaagtggaggcctggaactgtcaggatttgacagggctggaccagagacccttccgcctctgcctagtgtgtctgtcaggcaggcagcagccatcaatccaagaatgagccatggcggcaagcactgtgtggagaaaggaacccagccgaggtctgagtttcagacagaaactggggagttgggacatcttctctgtgccaggcttcattgacaccatcgctccccacagcagctccttggggcagggggctcacctgtgcagccacccttactcacagtagcatcccattcttcacactgcaaccccccagcactgtggacccttccagggaggtgacaggagccagcagacacatgacattcccagaaagccccatcttatccagacaggcttccctccatacttctttccacagttttaccctcagaaaaatgttggctgcagtcttcccttccttcacctccaccctggggaagggtcagtaaccaatgccgagggtcggggaaggaggaggcacaggcaagacagggactcagcgcagtgctcccgccatcatcggggacaggtgccagggtcagctgcagctctccttccgggagcagggtgtggtggccctggatggtcccagggagcagagggaggcaggcagctgtcacagccacagcggctctgaatggcttgagcttttagtatgtgttcaagtgcaggatactacaaactggtaaagacttccaccatgtgaagaatgtatgtaaattaaagtttattgtaatgaaggtttttactttttgcaattaaaagtgttggttgataagaa

SEQ ID NO: 21899 - DNA, 2427 bp, Homo sapiens
gattgtgccacttcattccagcctgggcgacagagcgaaactctgtcaaaggaaaggaaagaaaagaaaaaaaaaaagagagagagaaaagaagaggggaggggagggaaagggaagggaggggaggggaggagaggagagcagattgggggggctcatgttctgagagaaaggaataatagcatttgtctagtacattccagtttacaaagtgcctgatatacatgatctcctttaatcttcacccaatcctgtaaagtaggtgttagatccccattttgcaagtaaataagtggaggcttagagcagttaaccgctggcaggtaggtagctggttccatagcacatcattttcctgcggcatcacggcatggtgccgaagaagacagctgtggatgtcgttgactcagatgtgcccccgttggggtgggagaacccagggatgggggtcagcaagccaggaactccgcagggtttgtttttaaaactctgctggacagaagtggaggaggaaagaatctaaccatatgacttttataaaaatcctttcacttttcccctccccatttgaaaactctttttaagagtgaatgtagctgaaacacaactgtgtccagccattttcctgtctccacattcttccagatgtgtgacagaggagggactctgctcaattccagttgtgggtccccttggagtttacatcacttgtttttcaattcttggttttctgttcccttctaccaaaacccagcataggactcagtgtacacttactttaaaacaaaaactcacatttcttagctgcaggtgatggcctcagtcattttaatacagcctggaatgagtttgcttattacccagtcactttcgtagtgaatgttcaaaccccaaagcaaatgtttgcatctccttgtccataaaggagaaagccaggttataggagaaagagagagaaaggcgcatgtctgtttgcacagagagaggcaattttgtctacctttcgagaatcagttataaacagaagggcctcttaggattttgagctctcctgacaatgaaggatcacccactacaatttgttgaaggaagggagtgtcagagatatgctttaaagttgtactttaggctgaaattctctctgtatttggacctgcagatgttgtgtacagaaccgatgcatggcagggtcaggaagctaggagagtgaaggcgcttgtggagacagctctgtagcaaatgaaacacggaagcctccgggaatgtgtttgtgtcaccagcagcaggcatttccctgtcctccccacccccagtctccacatccccagcagcctcttccagaagcatgtcagggagacggacaggtgctctccttctcgtgcaccacatccaagtccacccaccgtggacgcagtgtgactaaatgctggccttgaagagaaaccctcagccagcttgtctgttgtccaggtccctcagtgtctctggtttccctgccctgcataatttaagcattagtgccaaatacatctgtcatattcctctccctggagactgcgaaatgtccagactttttcagactagtggagggaaggaatgttacataactaagtggaggcctggaactgtcaggatttgacagggctggaccagagacccttccgcctctgcctagtgtgtctgtcaggcaggcagcagccatcaatccaagaatgagccatggcggcaagcactgtgtggagaaaggaacccagccgaggtctgagtttcagacagaaactggggagttgggacatcttctctgtgccaggcttcattgacaccatcgctccccacagcagctccttggggcagggggctcacctgtgcagccacccttactcacagtagcatcccattcttcacactgcaaccccccagcactgtggacccttccagggaggtgacaggagccagcagacacatgacattcccagaaagccccatcttatccagacaggcttccctccatacttctttccacagttttaccctcagaaaaatgttggctgcagtcttcccttccttcacctccaccctggggaagggtcagtaaccaatgccgagggtcggggaaggaggaggcacaggcaagacagggactcagcgcagtgctcccgccatcatcggggacaggtgccagggtcagctgcagctctccttccgggagcagggtgtggtggccctggatggtcccagggagcagagggaggcaggcagctgtcacagccacagcggctctgaatggcttgagcttttagtatgtgttcaagtgcaggatactacaaactggtaaagacttccaccatgtgaagaatgtatgtaaattaaagtttattgtaatgaaggtttttactttttgcaattaaaagtgttggttgataagaa

SEQ ID NO: 21900 - DNA, 1911 bp, Homo sapiens
cacatctggaagaatgtggagacaggaaaatggctggacacagttgtgtttcagctacattcactcttaaaaagagttttcaaatggggagggactctgctcaattccagttgtgggtccccttggagtttacatcacttgtttttcaattcttggttttctgttcccttctaccaaaacccagcataggactcagtgtacacttactttaaaacaaaaactcacatttcttagctgcaggtgatggcctcagtcattttaatacagcctggaatgagtttgcttattacccagtcactttcgtagtgaatgttcaaaccccaaagcaaatgtttgcatctccttgtccataaaggagaaagccaggttataggagaaagagagagaaaggcgcatgtctgtttgcacagagagaggcaattttgtctacctttcgagaatcagttataaacagaagggcctcttaggattttgagctctcctgacaatgaaggaaaagctctcttgagtatacaagttccacactcattacctttcagtggtgacccatcacccactacaatttgttgaaggaagggagtgtcagagatatgctttaaagttgtactttaggctgaaattctctctgtatttggacctgcagatgttgtgtacagaaccgatgcatggcagggtcaggaagctaggagagtgaaggcgcttgtggagacagctctgtagcaaatgaaacacggaagcctccgggaatgtgtttgtgtcaccagcagcaggcatttccctgtcctccccacccccagtctccacatccccagcagcctcttccagaagcatgtcagggagacggacaggtgctctccttctcgtgcaccacatccaagtccacccaccgtggacgcagtgtgactaaatgctggccttgaagagaaaccctcagccagcttgtctgttgtccaggtccctcagtgtctctggtttccctgccctgcataatttaagcattagtgccaaatacatctgtcatattcctctccctggagactgcgaaatgtccagactttttcagactagtggagggaaggaatgttacataactaagtggaggcctggaactgtcaggatttgacagggctggaccagagacccttccgcctctgcctagtgtgtctgtcaggcaggcagcagccatcaatccaagaatgagccatggcggcaagcactgtgtggagaaaggaacccagccgaggtctgagtttcagacagaaactggggagttgggacatcttctctgtgccaggcttcattgacaccatcgctccccacagcagctccttggggcagggggctcacctgtgcagccacccttactcacagtagcatcccattcttcacactgcaaccccccagcactgtggacccttccagggaggtgacaggagccagcagacacatgacattcccagaaagccccatcttatccagacaggcttccctccatacttctttccacagttttaccctcagaaaaatgttggctgcagtcttcccttccttcacctccaccctggggaagggtcagtaaccaatgccgagggtcggggaaggaggaggcacaggcaagacagggactcagcgcagtgctcccgccatcatcggggacaggtgccagggtcagctgcagctctccttccgggagcagggtgtggtggccctggatggtcccagggagcagagggaggcaggcagctgtcacagccacagcggctctgaatggcttgagcttttagtatgtgttcaagtgcaggatactacaaactggtaaagacttccaccatgtgaagaatgtatgtaaattaaagtttattgtaatgaaggtttttactttttgcaattaaaagtgttggttgataagaa

SEQ ID NO: 21901 - DNA, 1605 bp, Homo sapiens
ggcaggtaggcgggtgatcggaaggcaacccaagcaagttgatctcctgtcataagaaagcaggtatgagaaagagagagaaaggcgcatgtctgtttgcacagagagaggcaattttgtctacctttcgagaatcagttataaacagaagggcctcttaggattttgagctctcctgacaatgaaggaaaagctctcttgagtatacaagttccacactcattacctttcagtggtgacccatcacccactacaatttgttgaaggaagggagtgtcagagatatgctttaaagttgtactttaggctgaaattctctctgtatttggacctgcagatgttgtgtacagaaccgatgcatggcagggtcaggaagctaggagagtgaaggcgcttgtggagacagctctgtagcaaatgaaacacggaagcctccgggaatgtgtttgtgtcaccagcagcaggcatttccctgtcctccccacccccagtctccacatccccagcagcctcttccagaagcatgtcagggagacggacaggtgctctccttctcgtgcaccacatccaagtccacccaccgtggacgcagtgtgactaaatgctggccttgaagagaaaccctcagccagcttgtctgttgtccaggtccctcagtgtctctggtttccctgccctgcataatttaagcattagtgccaaatacatctgtcatattcctctccctggagactgcgaaatgtccagactttttcagactagtggagggaaggaatgttacataactaagtggaggcctggaactgtcaggatttgacagggctggaccagagacccttccgcctctgcctagtgtgtctgtcaggcaggcagcagccatcaatccaagaatgagccatggcggcaagcactgtgtggagaaaggaacccagccgaggtctgagtttcagacagaaactggggagttgggacatcttctctgtgccaggcttcattgacaccatcgctccccacagcagctccttggggcagggggctcacctgtgcagccacccttactcacagtagcatcccattcttcacactgcaaccccccagcactgtggacccttccagggaggtgacaggagccagcagacacatgacattcccagaaagccccatcttatccagacaggcttccctccatacttctttccacagttttaccctcagaaaaatgttggctgcagtcttcccttccttcacctccaccctggggaagggtcagtaaccaatgccgagggtcggggaaggaggaggcacaggcaagacagggactcagcgcagtgctcccgccatcatcggggacaggtgccagggtcagctgcagctctccttccgggagcagggtgtggtggccctggatggtcccagggagcagagggaggcaggcagctgtcacagccacagcggctctgaatggcttgagcttttagtatgtgttcaagtgcaggatactacaaactggtaaagacttccaccatgtgaagaatgtatgtaaattaaagtttattgtaatgaaggtttttactttttgcaattaaaagtgttggttgataagaa

SEQ ID NO: 21902 - DNA, 2314 bp, Homo sapiens
gattgtgccacttcattccagcctgggcgacagagcgaaactctgtcaaaggaaaggaaagaaaagaaaaaaaaaaagagagagagaaaagaagaggggaggggagggaaagggaagggaggggaggggaggagaggagagcagattgggggggctcatgttctgagagaaaggaataatagcatttgtctagtacattccagtttacaaagtgcctgatatacatgatctcctttaatcttcacccaatcctgtaaagtaggtgttagatccccattttgcaagtaaataagtggaggcttagagcagttaaccgctggcaggtaggtagctggttccatagcacatcattttcctgcggcatcacggcatggtgccgaagaagacagctgtggatgtcgttgactcagatgtgcccccgttggggtgggagaacccagggatgggggtcagcaagccaggaactccgcagggtttgtttttaaaactctgctggacagaagtggaggaggaaagaatctaaccatatgacttttataaaaatcctttcacttttcccctccccatttgaaaactctttttaagagtgaatgtagctgaaacacaactgtgtccagccattttcctgtctccacattcttccagatgtgtgacagaggagggactctgctcaattccagttgtgggtccccttggagtttacatcacttgtttttcaattcttggttttctgttcccttctaccaaaacccagcataggactcagtgtacacttactttaaaacaaaaactcacatttcttagctgcaggtgatggcctcagtcattttaatacagcctggaatgagtttgcttattacccagtcactttcgtagtgaatgttcaaaccccaaagcaaatgtttgcatctccttgtccataaaggagaaagccaggttataggagaaagagagagaaaggcgcatgtctgtttgcacagagagaggcaattttgtctacctttcgagaatcagttataaacagaagggcctcttaggattttgagctctcctgacaatgaaggaaaagctctcttgagtatacaagttccacactcattacctttcagtggtgacccatcacccactacaatttgttgaaggaagggagtgtcagagatatgctttaaagttgtactttaggctgaaattctctctgtatttggacctgcagatgttgtgtacagaaccgatgcatggcagggtcaggaagctaggagagtgaaggcgcttgtggagacagctctgtagcaaatgaaacacggaagcctccgggaatgtgtttgtgtcaccagcagcaggcatttccctgtcctccccacccccagtctccacatccccagcagcctcttccagaagcatgtcagggagacggacaggtgctctccttctcgtgcaccacatccaagtccacccaccgtggacgcagtgtgactaaatgctggccttgaagagaaaccctcagccagcttgtctgttgtccaggtccctcagtgtctctggtttccctgccctgcataatttaagcattagtgccaaatacatctgtcatattcctctccctggagactgcgaaatgtccagactttttcagactagtggagggaaggaatgttacataactaagtggaggcctggaactgtcaggatttgacagggctggaccagagacccttccgcctctgcctagtgtgtctgtcaggcaggcagcagccatcaatccaagaatgagccatggcggcaagcactgtgtggagaaaggaacccagccgaggtctgagtttcagacagaaactggggagttgggacatcttctctgtgccaggcttcattgacaccatcgctccccacagcagctccttggggcagggggctcacctgtgcagccacccttactcacagtagcatcccattcttcacactgcaaccccccagcactgtggacccttccagggaggtgacaggagccagcagacacatgacattcccagaaagccccatcttatccagacaggctcgcccagcgcatactcccagtcacaacgttacaatcagacgaacgttgccaacattgcacccttccagcaccactatcgaggatcacgttcaccaccaaacgcctaagtctcgacacgaagacagaacatcgtcaagacagggactaggcgcctacttcctagccatcatcaggggatcagctgaaaagggtcaggacaaactctcgattcagagatcagtgtgatccgcgtgatagtcacacgagaacagtaaagca

SEQ ID NO: 21903 - DNA, 2079 bp, Homo sapiens
gattgtgccacttcattccagcctgggcgacagagcgaaactctgtcaaaggaaaggaaagaaaagaaaaaaaaaaagagagagagaaaagaagaggggaggggagggaaagggaagggaggggaggggaggagaggagagcagattgggggggctcatgttctgagagaaaggaataatagcatttgtctagtacattccagtttacaaagtgcctgatatacatgatctcctttaatcttcacccaatcctgtaaagtaggtgttagatccccattttgcaagtaaataagtggaggcttagagcagttaaccgctggcaggtaggtagctggttccatagcacatcattttcctgcggcatcacggcatggtgccgaagaagacagctgtggatgtcgttgactcagatgtgcccccgttggggtgggagaacccagggatgggggtcagcaagccaggaactccgcagggtttgtttttaaaactctgctggacagaagtggaggaggaaagaatctaaccatatgacttttataaaaatcctttcacttttcccctccccatttgaaaactctttttaagagtgaatgtagctgaaacacaactgtgtccagccattttcctgtctccacattcttccagatgtgtgacagaggagggactctgctcaattccagttgtgggtccccttggagtttacatcacttgtttttcaattcttggttttctgttcccttctaccaaaacccagcataggactcagtgtacacttactttaaaacaaaaactcacatttcttagctgcaggtgatggcctcagtcattttaatacagcctggaatgagtttgcttattacccagtcactttcgtagtgaatgttcaaaccccaaagcaaatgtttgcatctccttgtccataaaggagaaagccaggttataggagaaagagagagaaaggcgcatgtctgtttgcacagagagaggcaattttgtctacctttcgagaatcagttataaacagaagggcctcttaggattttgagctctcctgacaatgaaggaaaagctctcttgagtatacaagttccacactcattacctttcagtggtgacccatcacccactacaatttgttgaaggaagggagtgtcagagatatgctttaaagttgtactttaggctgaaattctctctgtatttggacctgcagatgttgtgtacagaaccgatgcatggcagggtcaggaagctaggagagtgaaggcgcttgtggagacagctctgtagcaaatgaaacacggaagcctccgggaatgtgtttgtgtcaccagcagcaggcatttccctgtcctccccacccccagtctccacatccccagcagcctcttccagaagcatgtcagggagacggacaggtgctctccttctcgtgcaccacatccaagtccacccaccgtggacgcagtgtgactaaatgctggccttgaagagaaaccctcagccagcttgtctgttgtccaggtccctcagtgtctctggtttccctgccctgcataatttaagcattagtgccaaatacatctgtcatattcctctccctggagactgcgaaatgtccagactttttcagactagtggagggaaggaatgttacataactaagtggaggcctggaactgtcaggatttgacagggctggaccagagacccttccgcctctgcctagtgtgtctgtcaggcaggcagcagccatcaatccaagaatgagccatggcggcaagcactgtgtggagaaaggaacccagccgaggtctgagtttcagacagaaactggggagttgggacatcttctctgtgccagggtgtggtggccctggatggtcccagggagcagagggaggcaggcagctgtcacagccacagcggctctgaatggcttgagcttttagtatgtgttcaagtgcaggatactacaaactggtaaagacttccaccatgtgaagaatgtatgtaaattaaagtttattgtaatgaaggtttttactttttgcaattaaaagtgttggttgataagaa

SEQ ID NO: 21904 - DNA, 1921 bp, Homo sapiens
gattgtgccacttcattccagcctgggcgacagagcgaaactctgtcaaaggaaaggaaagaaaagaaaaaaaaaaagagagagagaaaagaagaggggaggggagggaaagggaagggaggggaggggaggagaggagagcagattgggggggctcatgttctgagagaaaggaataatagcatttgtctagtacattccagtttacaaagtgcctgatatacatgatctcctttaatcttcacccaatcctgtaaagtaggtgttagatccccattttgcaagtaaataagtggaggcttagagcagttaaccgctggcaggtaggtagctggttccatagcacatcattttcctgcggcatcacggcatggtgccgaagaagacagctgtggatgtcgttgactcagatgtgcccccgttggggtgggagaacccagggatgggggtcagcaagccaggaactccgcagggtttgtttttaaaactctgctggacagaagtggaggaggaaagaatctaaccatatgacttttataaaaatcctttcacttttcccctccccatttgaaaactctttttaagagtgaatgtagctgaaacacaactgtgtccagccattttcctgtctccacattcttccagatgtgtgacagaggagggactctgctcaattccagttgtgggtccccttggagtttacatcacttgtttttcaattcttggttttctgttcccttctaccaaaacccagcataggactcagtgtacacttactttaaaacaaaaactcacatttcttagctgcaggtgatggcctcagtcattttaatacagcctggaatgagtttgcttattacccagtcactttcgtagtgaatgttcaaaccccaaagcaaatgtttgcatctccttgtccataaaggagaaagccaggttataggagaaagagagagaaaggcgcatgtctgtttgcacagagagaggcaattttgtctacctttcgagaatcagttataaacagaagggcctcttaggattttgagctctcctgacaatgaaggaaaagctctcttgagtatacaagttccacactcattacctttcagtggtgacccatcacccactacaatttgttgaaggaagggagtgtcagagatatgctttaaagttgtactttaggctgaaattctctctgtatttggacctgcagatgttgtgtacagaaccgatgcatggcagggtcaggaagctaggagagtgaaggcgcttgtggagacagctctgtagcaaatgaaacacggaagcctccgggaatgtgtttgtgtcaccagcagcaggcatttccctgtcctccccacccccagtctccacatccccagcagcctcttccagaagcatgtcagggagacggacaggtgctctccttctcgtgcaccacatccaagtccacccaccgtggacgcagtgtgactaaatgctggccttgaagagaaaccctcagccagcttgtctgttgtccaggtccctcagtgtctctggtttccctgccctgcataatttaagcattagtgccaaatacatctgtcatattcctctccctggagactgcgaaatgtccagactttttcagactagtggagggaaggaatgttacataactaagtggaggcctggaactgtcaggatttgacagggctggaccagagacccttccgcctctgcctagtgtgtctgtcagggaggcaggcagctgtcacagccacagcggctctgaatggcttgagcttttagtatgtgttcaagtgcaggatactacaaactggtaaagacttccaccatgtgaagaatgtatgtaaattaaagtttattgtaatgaaggtttttactttttgcaattaaaagtgttggttgataagaa

SEQ ID NO: 21905 - DNA, 366 bp, Homo sapiens
acagttatacaacacttcatagctcaaaaataactctatacacattaccatatttgattttcacagcagcaagacaagacaagtaatattgcattcattttctataaagtacacggagatgttaagtgatttacctggtattacttcagtgaaaacaggaaagatgaaggtaggagaatatacttggaatccttttccggactgtttggaaaaacaaggtaataatactgtttttccacggaatattggcaaacaaaaatgtcttaagtgaataatactacatttaactatagggcacagaaatgagtatattaagaaatccaggtttcaaaaggtggatagaattagtttctcctcggtaaacat

SEQ ID NO: 21906 - DNA, 424 bp, Homo sapiens
atgcttttacatggtcaccctggttgcctgatgatagcaggccaggagtggagatggagaccagttggaggtggtggtggttttaccaggatagtagcagtggaagtggtgagaaagagttgaattctggggatacattttgaagttagagacaacagcattttctgttggagtagtagtggggtcagagagtagttaattatgatcacaagcattttggccggagcagctggaaggatggagtggacatttgttcagctggaaaagacttcaggggaaaccaactgagggaaaagatgaggagttctgtttcaggcttggtaagtttgagatgcctactacgcattaaagtggaaacattgagtaggtagctggatatatgactctggcatgtacagagggggccagagaatgtatcaatttt

SEQ ID NO: 21907 - DNA, 424 bp, Homo sapiens
gatgagcataggcaggaccatgcaggcatcgggtgttgctaaagagcaacacattcaaggagaccctggcaggctgggcccgaccctctacgcctccctctacaacggagacaggcagggagaccccggcaggctgggccccgaccctctacgcctccctctacaacggagacaggcagggagaccctggcaggctgggccccgaccctctacgcctccctctacaacggagacaggcagggagaccctggcaggctgggccccgaccctctacgcctccctctacaacggagacaggcaggaagcccggaggcgagggcctctaatagccaggccgggtcccagcaagtctctccacttctctgggcttctgaagatccaagcatgagacagatggatgattgtgaagttccctgtaaacagc

SEQ ID NO: 21908 - DNA, 525 bp, Homo sapiens
cagccaaaggcctcctcgctcagagaagtcatctgaaaaaagctagcccaggggcaggaaagggcctcaggctggcgccccagaaggtggcccatcagtcactctgggaagacagatagacatcgtcagtctctttttacaagtcaagacagtaaaatcaaagtaatagtttcctggcaggaagaaagagaattgctggagcgttggagagccatctcttaacctctggggtgactcaaaggaagagttgcctggtctgagaactttagaccaaagaatttaaatcatgtgaactgaaaatgcatgtgtatccatatatacatgtacatatatgtttatatacccaatatagaaaggttaccagagacaaagaaatagcaacaatagttgttttggggaagggaaaggaagggctgtggggtgaggaagcatactttcactgaatatcctctgtactgtgtgcatttttgccacatgcatgaactaaacctacaagaaaataaacaaataaaaaaaaagaacaca

SEQ ID NO: 21909 - DNA, 692 bp, Homo sapiens
cagtgtctcaaatttctgtatgaaagtgatggagaacaatctgtacacatgtacgtgtacacatttgcagtcattttgaatcagcacccatcacagtgcagtgctctggtctctgggtggcagtgtgactgggaagcttgaccggccagtcggcgttggcctgatggttccaactgcaggaggctgcagcatccaccagggcagggagactctggaccaggagcccagggctcactgctgagctaattccagaatttaacaacagaagcacaaaacagacagagagatggttactggaactcttcattcccttcattgggagatgcctggatgaacacagacaggatcctgtctccttgcacatcacgtgggttggtcagaattggaaggtggtgcccccaaagttagactaagtactgagtttgggtttcagcaagtgagaccatgtggaagggtttctacagtcaagaaaggagtttgagaccagcctgggcaacatagtgagaccttgtctctacaaaaaatgaaaacttagcagggtttggtggcacgcatgtgtagtcccagctacgtggggggtgggggctgacaggggcagatcacttgagcctgggaagttgaggctgcagttgtgccatgatcgtgccactgtactccagcctgggcgacagtgagactcagtctcttgaaaa

SEQ ID NO: 21910 - DNA, 544 bp, Homo sapiens
tagaacaaatgtgtaatggcaggtatccatcattatagtatcctacagagtatttccactgccctgaaattcttctgtggggtaatttttgtttttgtttgttgtttttttagagatggggtctcactatattgcccagactggagtgcagtggctgttagcaggcgcagtcatggctcactgtagcctcgaactcctcggcccaagctatccacctgcctcagcctctggagtagctgagactacaggcactagctctttggttactttttaaactcttttttccactttttggtaataagagatttaaaaatccaacggactctccagacaactctcaaagaaagaggtctctagagttctaggttactggaaggacgttagaagaaagtaatgaaatcagataggattattttgtggtaatactcaataattccaattgatttaacagcaaggaatcacttgggagcactgttagtagtatctcactgtctggttaaccacacatgacacggcataaagcatatttctctagcaagtagaa

SEQ ID NO: 21911 - DNA, 389 bp, Homo sapiens
gcaaagaaagggggagattttgcagttctaattctttgaccttgttgcacttgggggaagtcctggaagcagggacaaaacttcctgcaaagaaatgatgtaaaacatgttttgttcaacgtggctgaaaagcatttccagcatgggtccagttggagctccttcgtgaatctagatttgactgggttaagagaagctggtgatgccaaggctggaaaccttgtagacctgtagatctatcctgcctgaacctaggagagcagaggatagagagatttgaacccactacgtttggcctacaggatgcagttcttggcatgcttaaaattttgccttaacagtttcccgttttatagggaagtactgggctttggtgcatttgtgaaaaa

SEQ ID NO: 21912 - DNA, 283 bp, Homo sapiens
actgggagcaacacaaagatgactttgaatctctgtccaccacccctagactgtatgacacccgcaagtgacaacctcccctctctggcctcggtttccccctctgtaaaatgggggatggcctaccttgccagtcatggcaggtcaatataaaacaacttctggctgtgcacagtggcacatgcctgtaatcccagcactttgggaagctgaggcaggaggattgcttgaggccaggagttcaagaccagcctgggcaatatagcaagatcccatccctctt

SEQ ID NO: 21913 - DNA, 355 bp, Homo sapiens
gtttctgtcaatggcaatcatcaccagacagcctctgcctgaccaccaccagggacaggggactcatcaactccagcagtgatcagaattgatctacacaaatctcattaataaggaactctactttatgatgagttgaaacctaccttcctaaagtttccatccattaggcttaattctgctaaggacacagaataattattctcctcaaacagccaataattgctatcatatctgctgtggtttgaatatgtccctcaaaagttcatgtgttggaaacttaatccccaatgcaccagtgtatgagggcagaatggattaatgtcattactgtaaaatccaggttagttatctc

SEQ ID NO: 21914 - DNA, 260 bp, Homo sapiens
ggtaggagaaaaagagtggaaaagacagaagatgagatgatgtctgcagcaatttcataggccatgtctacaccgatctctggtgtttacaatgctggttggggtttgcttgcagaagggcaatgacagtgttaggggcgtttgaaccagagcaactccatcttaaataggagctaggtaaaatgaggctgagacctactgggctgcattcccagacggttaagacattctaagtcacagggtgagataggaggtcatca

SEQ ID NO: 21915 - DNA, 373 bp, Homo sapiens
caacatgggaaaagaattcccaacaaattacacgttttaaagtcaacaaacacccagatgtctgcagttcaccctcactggtggtgacacatctgtcacattttgttcctactttgcttggctgtgtcctctttcatcaccctttcccatgataatgatcttgtaatatcatgtaggaatagaaagattcctcaatctttccttgagcatggtcgatctctgttttgaattattgatactttagaaaagtttctgtcatcttcacaactcttattggcatagtcatgtaaatttttagaactgtcatcaaatgtggggcaactgttaccaagtttctttcatatctgagctgtaagattctagaacaccccca

SEQ ID NO: 21916 - DNA, 874 bp, Homo sapiens
ctcaaaaaaaaaaaaaaagataattcagtgcatttagtaagttcgtagcattgtgcaaccatcaacttccatctggttccagaacattttcatcatccccaaaagaaccccatacccatttcctcccactgctgtacacccatccctggccaccagtgatgtgctttgtatctctatgaattcacctattctgggcatttcatctcagtggaatcatttgatctgtagccttttgtgctttcgaggttcattccagggctgtcgtggagccggaatgatcagtgataaaactgctaggctggccaccccgggcttcccgaagtctgatcttttcctttgcatttaggattcaaggtcatacttagttagcaggagcgataccataatcatgaacgtggttttcccagggtgaggcttatccattgcactcccctgcaatctccccattaaaaaaaaaaaattcaagattctatctagaacactgtaccttttgacctgcaggtttgattgtgcaaacgttgaatgaacccgttttgggcgcgcaaggagtaggatgacacccaggaccttgtgagtgcccgaagtagcagcttgcactggcctattccagagaattctgaggctgttgaggctgaattgtttagaagcagatctgttgctgaaagtgaggtccctcgtggagtttatttccacgtcccgaggattccagatcggtgcattaatatcagttaagggcacggatgatcgctgggtctgacactgtggcttctccctgcgggttcctgggttttttgcctccacttttaacaaaactgaggccgggcgcggtggctcacacctgtaaccatagcattttgggaggctgaggtgagtg

SEQ ID NO: 21917 - DNA, 479 bp, Homo sapiens
aatctccaaaagaaagagaatatagagaaaagatcagaaaacaagagaatttatctaaaaagtccaacatctgactagtggtagttctagagaggccagaaacaggggaggaaattgtcaaatagtaggttggtacaaaagttattgtggtttttgccgtagaaagtaataccaaaaaagtgtctagaacttcagagcaagagtttctagattgaaagggcctgagtacccaccacaatgaatggaaaggaaaaataaagctgtaccagggcacattatcatacaatttcagaattgaggatgtagaaaacaacctaaaagctctgaagggaatatctctgggtggtgaggtgaaataaactaatagattacttaatgtagttgattatgagaaaaatactgttgagaagggttttgtgattgtgtaataaactttggagagatttccaatagtgacacagaaaactaagcaaatgaaa

SEQ ID NO: 21918 - DNA, 732 bp, Homo sapiens
  misc_feature (712)..(713): n is a, c, g, or t
  misc_feature (715)..(715): n is a, c, g, or t
tttcccttatccatagctaggtagtgttactactctcaattttaggacactgttcacagtcaaatgggatcctacagtcatttatattacttgctttctcaactcatgggctgaagtcacacccttaattgcttactaatatttcaaagcattgttagccttgaggcccttaggtctcttttaatagggaatgttgtctagttatcatttacctttcttataagtgtttaatctctttgtcataaaagttttacatgagttcctgaatctagtacaggggaaaggaattcctaagtatgtggtctgtattgtgcttgtactgaccatgtatatatgctatggttatttagtgctagctaagaacataccatttccccagtagcagtctgacttttgccttaagacttcatatcttgaggtgctactactctttgtgtagaaaagctttccctttcctagatttgttttcttgtccacccaccaagcacactaggtccttaatgttgagaatgaaatggtagtagtaaacttttgcaccaaggttgtttgcaaagaggtctttttcttttttagagatagggtttcatgttggtcaggctcgtctccaactcctgacctcaagtgatatgcctcccaaagtgctgggattacaagaattgtttttctttcttttttttttttttgagactccatcataaataaataaataaannantgggtcacattaaaaaa

SEQ ID NO: 21919 - DNA, 329 bp, Homo sapiens
tttgtttgtttgtttttcttaatctgagctttctgcccactcttagcacggggcaaagggaagatttttctgccacttcttttggtgagaagagtcactttctgattaggatttgagctgaaaataggtccccctttgggaagaaacatgagtgcagggcgcttcctgtgtcactcccaaggaggcacctcctcagggcagttcctctttgagaatttcatggtcagtaagaagtaggctcccagggaccccagagtggggaccctttgactgaagtcaccccagtgggtataagataaacataagagacgcttctcagagaagatttg

SEQ ID NO: 21920 - DNA, 325 bp, Homo sapiens
tatgatgccatctaacctcttcctctatccctggatagcctatatgttgatgtagttagtttgagattggcagttatggccaggtgcggtggctcatgcctgtaatctcaacactttgggaggctgaggtgggtggatcacctgaggtcaggagttcgagaccagactggccaacatggtgaaaccccatctctactaaaaatacaaaaattagccgggcatggtggtgcatgcctgtagtcccagctacttggggggctgaggcaggagaatcacttgaacctgggaggcagaggttgcagtcagcggggtgagactctgtctc

SEQ ID NO: 21921 - DNA, 578 bp, Homo sapiens
atgagtttttgaatgtctatgtttggacagagcgcaaatttaacagatggtgcttcaaaaatagacgtgagattttaaaaatagtttcttccagctacgggaatgtaggctccagttaagcagactgacatctggcgaattaagttgccatggtaacaggttttcaggtcaagcctggagactgggtcagccctcccctctgtcatgggaacagtcttccaggggggtcagtgaaaagaacatctttgacaacacacactttcagtcaagccaccagtgccctaaggtctctaccttttgtcatcttcatataaaagctctaagaaagaattccttaaaaaagaagccctcaggtgttcacttcctgtgatatgtgatcatagctagcttctacaaatggcaggggcaaattttcctaaaaatcttaacttttgtattccagcataaatacttctaatttctcctctgcaggagccactatgtggagaagaacctttaaaatcaatagcagaagttgctggcagtggttatctcaggaggatgggacgcagagattttcactttccgtgtcatgtatc

SEQ ID NO: 21922 - DNA, 128 bp, Homo sapiens
aagactaccaggctgcggaggagactgcttttgttgttgatgaagtgagcaaattgtaaaagaggctatagaaagcacaattggtggttaacgcttattaacacagcaaagtgaaccagtggaacaca

SEQ ID NO: 21923 - DNA, 431 bp, Homo sapiens
ggaggctgaggcaggagaattgcttgaacctgggaggcggaggttgcagtgagccgagatcacaccactgcactgcagcctggcgacagagtgagactctgtctcagaaaaaaaacaaaaaacaaaaaagaaaagaaaaagaaagaaaaagaaaaactagattgcccaaggtgaagacatcatttttttcctatactcccagtacccactgactccctctttatcctacacgtctaatgaaatggaccacgtctgtcttcctcagtcccatttctcacctcttcctcctcccctccgttactgagcccttgcgcgtgtggctctcaccagcacttctgtaacctgcagagtgctgctgtgctcctgagcccccaccctctcttctttttgaaactgttgtcagatcagtcttcctaaaccaccactttcac

SEQ ID NO: 21924 - DNA, 479 bp, Homo sapiens
aacatttgttgggctgacgctgtaatcacaccacaagggacacttgaaattatatctgtatttgggaagctaattttaaagaactttttctcttcataattatatgcaatcagccagctagtgttattggggattctctttttccctcttcagctgagaggccatctgccttcctcttcctgcctttccttccagcacacggtgagccatctccctgggagagggaccactggcccttggctgcctgcaagccccagggaaacctttccatggtgattgcggaggaagggatgaggaggaagagcaggggaggatgatgggggcctctggcttggctacaggatgagtccgttttcaagactggaggcgcaggttggtgatggaaatgatggagtgtagcgtttcgatttggacattgaagcagccagggctcttgtgaatgcaagtggcagaaaatccaattcagatgagtttaagca

SEQ ID NO: 21925 - DNA, 191 bp, Homo sapiens
tctcaaatgagtgctgtcctgctgctgccactcattgacttcctagtccttttagccttgacatttggactgcacagtgtttctctctggtaacctctgaatttgctgttttgttgttgttgttgttgttgttgttgtttcttttttagacacagtttcactctgttgcctggagtgcagtggcgcaatct

SEQ ID NO: 21926 - DNA, 164 bp, Homo sapiens
atggtgcgctgcttccccatgactcctctgcctgaggtttcctcacctggtcggccctccgcgactcctggcgtccggagaccatcctgttgacccctgggagaggtcaggctggagcctcgataccgacgcactgccacagtgggctcctgcttcgcccagcc

SEQ ID NO: 21927 - DNA, 160 bp, Homo sapiens
ttttatttactatgagcttcagctgaaaatccaaaagaaactttaatttcagatatttaatgaaatcattatagctgtggtaatttcctttagctgggtgtgagtgtgtgatgtgagcgtgtgatgtgtgtgtgtgtgtgtgtgtgtgtgtactctggca

SEQ ID NO: 21928 - DNA, 894 bp, Homo sapiens
  misc_feature (302)..(302): n is a, c, g, or t
acactaagatggctttggagcgtgagaaggacttcacctagcaaatgtgggaaaggagtgagacctccaggcagagggactggctggagacgagcgtgatgtgatattcactgaatggccactgtgtgcctggcactgttccaagtgctgaagaaaaatgaagaaaacaaaaatccctgcccttatagaggagacattataatgtgacaagataacataatgaaaaagaatgaagaataaaatagaaaagtaaaatggattgcatgtcacttgatgacaagtactgtggaatgaggccgtcnatctaaatggagcacagaaagtggaacatggcgacatctcagccaaaagacccggcagacaccatcttggccaagggatcgaggttggcatcgcagcctgtgagcagtgctgacatcttattatcttcgatatggcgtcatgagcaggctgcctcctcttggtgggatcttcccccaaacccagaacctcagtctaatcacaagaaaatgacagccaatcccaagttcagggacatttggcaaaatagcccaccactcctacttaaaagtgtcgaggtcttgaaaggcaaggaaaccctgggaaatcgtctttggccggaggaaactcagcagacatgacgactaaatgcaatgtagaatcctcggacagaaaaggacattagtgggacagctggtgaaacccaagtaagtccaggctgtaccaatgtccacttcccagttctgaggaacatgctgtggtctgtccacatttacattaggagaagcagggagagcgtatatgggacctctctgtattgtttttataacttttctgtaaatccaaaactgtcttaaaatagtttttttaaattatactttaagttctggggta

SEQ ID NO: 21929 - DNA, 467 bp, Homo sapiens
gaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttatttttttttctgttccaaagattcatcctatggggtggccataaagtctagaattagatactaatattttgtcattcattataacatatcgataaaccatttgttaaaagatttgc

SEQ ID NO: 21930 - DNA, 407 bp, Homo sapiens
gaaacacaatgcacatacagagaggaaaggaagtaacagcagccgtcttggaggctagtcccacagcacaatactcaggaattacagtcagaactgctgtccattatcacggaacgttcttaacacctttaaatgaaactttttttttttaaatgacagagaacttagaatttgtgtgtgatttcttttgtccagagtgccctatagatggtaaacacttaataatgttactaacttattaaccaagtccccactcctcattccctgctattgtgaatctacaaggaaattttggatgggtagagtccttgtgttctcacattgagttgagaaccttgtccagccacgttgtacctctcagtatggaggcagcagaaaagaataaaaacaatattggtcatttgtca

SEQ ID NO: 21931 - DNA, 475 bp, Homo sapiens
agcagccgcattaaagatgtaaattttttttaagtaaaaagaaaaggtgaaattattttagtaaatgccttagtttgttttatgctgctgtcacagaataccacagactgggtaatttgtaatgaacagaaatttatttagcttacagtttgagaggctgggcagtccaaggccaagcgaccagcatctggtgatggccttcttgctgcgtcataacatggtgaatggcatctcatgttcaagaaagagtacaagagagggccaaactgacttttatgacaaacccaccctcattttaatgacattgatccattcatgaaggtagagccctcatgacttaatcacctcttaaaggtctcatgtctcagtagtgttacattgggaattagatttccaacacatgaacttttgttgttgttattgtttttgttttgagatagagtctcattctagccacccaggctggagttcacag

SEQ ID NO: 21932 - DNA, 657 bp, Homo sapiens
tgcctggtgacagcatctgaattttctttgtgaaataacagttccctccccccaccacccacctcagctcatgtgatttgggcaaaactaatatgccctgtatctctgtactcctcgcaggggtgggcaggcaatccctgcagccatggtggatgcatatgactgacagtgtcctgtgatattcaattccacaactccagaggaaactactgatcaagaggcatcctccttctgctggggttccctgagctggtgacttggaagccaggagctgccggaggccacctgtgacactgcaaagggacaatctgccaaagagtgaagccaacacagagaaaagcaggggaaagaggcaagcagtttcctaaagacatattttgagacccccgaatccagccacacttgaatatattccaggtaaatgagccagtgtgaatttcctttctgcttaaaccagtctgactcgggtgcctctcacccacatctgaaaggctccaagtcaatactgcccctcatcacactgaataaccatcacttgtttccttggctgttgtcccattagacccagggcacttgagggcagggcctagttcaaagccatcacgatgtctcagtgcctgattccaaccatcctggatgaatatttgctgaatgaat

SEQ ID NO: 21933 - DNA, 232 bp, Homo sapiens
gcagagaaggaagatcaattgagctggggaggctgaggctgcggtgagctgagatcatatcactgcactccagcctggtcaacaaagggagatcctgtctcaaaaaaaaaaaaaaaaaaaaaaaaaaaaatccattctttcttcactcgttcacggaacctaggaaccttaactgagctcctattacatcagttgaagtgatggatgctaagtacagtagtggggataggct

SEQ ID NO: 21934 - DNA, 467 bp, Homo sapiens
actggagcttttactgagctgctgcttctacagggccctacaacatattccaggcatatctcccatctccactgcccaccacgaccatcaaacattaagtaggaatgggcaaaggtatgttgcaagactatctccctgccaccaagctatgcagagagcagaaacagagaacagtgatataattctcaccaccactcaaagtgaaactttgagatgagcaactttcagatgctcatcttcctgtttactccctagtcaaaagtcagtctgccccagctgctggccaatatctgtaagagctcatggtacctatgaagaagaaggaatccagtggcaagcaatagagcacctcaggttgcttcaggtcacagcctgtgggtgggaataccaggcaaagtcttccaagggaggagagcaggcttgatgcttggcatggcacagccacactaatgggctgtaccaggagt

SEQ ID NO: 21935 - DNA, 253 bp, Homo sapiens
acagagcaagactctgactgggcgggggccacaaaaaaatcatagcatagctacatatcctaacattttagtttgtagcatgaatactttagcagtatgtaattggtatgtagggctgatgccgtggctcacgcctgtaaccccaacactttgggagactgaggtgggtggatcacttgagggcaagttgggcttgaaggcctgaccccatgatccgcctgcctcatcctccaaaggtctgggattacaggtt

SEQ ID NO: 21936 - DNA, 788 bp, Homo sapiens
agctgcgcgtgcgcggcagagtcacaatggcagccagattcaggtgcggccatttgtgtgtccccgaggttcctcgcgggccggcatcccacgccgagggtggtggtggcaggctttccagaaaggcagcacaccaggctcagctctgctggcgagcaggaggcgacggcagaggaaacttcaacccgatgaacttcctggttgcggggacatttgcctcctcctgccactcaccacctctgctctggtccctccctccaagaatcctcatagcgtcctctctccccactctctcccatcccgcgtctcccatatttgccccagcttggctcagggccacagttctgcactcttcagccggcggcgccaccagcagttgtttctacgcgggaaatagggcaacagcatcccagcacagctgagtgcccaaggatggtcagccgggtagggcaagaagcttctttcagggattctgatctcacgctagaaacaagagtaatgatggcacttcactcagaggtttgtcctgaggcttaaatgaggcaacatggacacagcattttagcacaaggccaggtacagtatgtgtaaggagtgttggctgctattttctcaggctcatcatccatcagatgcaatcactgttccctgtctttgaattgtgcctttaattttcataccgcccctgaccaaaattccatcagaaaaaggtggcttcagctaaaggttcttacaccagaagcacaattagagtgattggtgaaaatttccctttgcatgagattggc

SEQ ID NO: 21937 - DNA, 1084 bp, Homo sapiens
agctgcgcgtgcgcggcagagtcacaatggcagccagattcaggtgcggccatttgtgtgtccccgaggttcctcgcgggccggcatcccacgccgagggtggtggtggcaggctttccagaaaggcagcacaccaggctcagctctgctggcgagcaggaggcgacggcagaggaaacttcaacccgatgaacttcctggttgcggggacatttgcctcctcctgccactcaccacctctgctctggtccctccctccaagaatcctcatagcgtcctctctccccactctctcccatcccgcgtctcccatatttgccccagcttggctcagggccacagttctgcactcttcagccggcggcgccaccagcagttgtttctacgcgggaaatagggcaacagcatcccagcacagctgagtgcccaaggatggtcagccgggtagggcaagaagcttctttcagggattctgatctcacgctagaaacaagagtaatgatggcacttcactcagaggtttgtcctgaggcttaaatgaggcaacatggacacagcattttagcacaaggccaggtggtgaagccccctaatgtcctgactccacagttcctgtcccatgaccagggccagctcaccaaagagctatagcagcacataaagtcagtgacaggcccatgcaagtaccaaaggaagccaagactgaccatgaggaacacttggagctcaggaaggaaagatcagcccagaagcagggacagggagctggttggggaggatgagaagtcagaaggtctgcgaagtttccagagaggacctgtctttgggatggcgcatcaggggttcaggtgggggagggggtgttggaagaatgtggacatcacatggaatgcccactgtgaggcactatggtaccaggaccgaggattggtggagaggaagtataaagccccagggttgctaaggtagcgcccagacaggagaaggtttggtagaaaccagagccctggtctccctccaactgctcctgagcctcctgctcccctgccccactcctcctgctgttttgctgatagactttttc

SEQ ID NO: 21938 - DNA, 723 bp, Homo sapiens
agctgcgcgtgcgcggcagagtcacaatggcagccagattcaggtgcggccatttgtgtgtccccgaggttcctcgcgggccggcatcccacgccgagggtggtggtggcaggctttccagaaaggcagcacaccaggctcagctctgctggcgagcaggaggcgacggcagaggaaacttcaacccgatgaacttcctggttgcggggacatttgcctcctcctgccactcaccacctctgctctggtccctccctccaagaatcctcatagcgtcctctctccccactctctcccatcccgcgtctcccatatttgccccagcttggctcagggccacagttctgcactcttcagccggcggcgccaccagcagttgtttctacgcgggaaatagggcaacagcatcccagcacagctgagtgcccaaggatggtcagccgggtagggcaagaagcttctttcagggattctgatctcacgctagaaacaagagtaatgatggcacttcactcagaggtttgtcctgaggcttaaatgaggcaacatggacacagcattttagcacaaggccagatgtgatggtgctgatgtttaagaagaaagtccttattaggaggatgctgctgaaatatttaaggacaaagtgtcataatgtctgcatttactcccaaatgtctcatcaaaaatgtgcaaatatgaagtaaatggggcaaaatctta

SEQ ID NO: 21939 - DNA, 818 bp, Homo sapiens
cggcacgagcgccgtcggctccgcgtctccgccgtcggctccgcggcgccgccatggccgacgtggaagacggagaggaaacctgcgccctggcctctcactccgggagctcaggctccaagtcgggaggcgacaagatgttctccctcaagaagtggaacgcggtggccatgtggagctgggacgtggagtgcgatacgtgcgccatctgcagggtccaggtgatggatgcctgtcttagatgtcaagctgaaaacaaacaagaggactgtgttgtggtctggggagaatgtaatcattccttccacaactgctgcatgtccctgtgggtgaaacagaacaatcgctgccctctctgccagcaggactgggtggtccaaagaatcggcaaatgagagtggttagaaggcttcttagcgcagttgttcagagccctggtggatcttgtaatccagtgccctacaaaggctagaacactacaggggatgaattcttcaaataggagccgatggatctgtggtcctttgggactcatcaaagccttggtttagcattttgtcagttttatcttcagaaattctctgcgattaagaagataatttattaaaggtggtccttcctacctctgtggtgtgtgtcgcgcacacagcttagaagtgctataaaaaaggaaagagctccaaattgaatcacctttataatttacccatttctatacaacaggcagtggaagcagtttcagagaactttttgcatgcttatggttgatcagttaaaaaagaatgttacagtaacaaataaagtgcagtttaaaaccc

SEQ ID NO: 21940 - DNA, 1051 bp, Homo sapiens
  misc_feature (980)..(980): n is a, c, g, or t
gtgggcagccggggtctaggcaccacggtggctggcggcctgcgggcggcgctgtggcccgtcgggcggctccacagagccgccctagccttccgccttccccaagccaacgtctccgccgtcggctccgcggcgccgccatggccgacgtggaagacggagaggaaacctgcgccctggcctctcactccgggagctcaggctccaagtcgggaggcgacaagatgttctccctcaagaagtggaacgcggtggccatgtggagctgggacgtggagtgcgatacgtgcgccatctgcagggtccaggtgatggatgcctgtcttagatgtcaagctgaaaacaaacaagaggactgtgttgtggtctggggagaatgtaatcattccttccacaactgctgcatgtccctgtgggtgaaacagaacaatcgctgccctctctgccagcaggactgggtggtccaaagaatcggcaaatgagagtggttagaaggcttcttagcgcagttgttcagagccctggtggatcttgtaatccagtgccctacaaaggctagaacactacaggggatgaattcttcaaataggagccgatggatctgtggtcctttgggactcatcaaagccttggtttagcattttgtcagttttatcttcagaaattctctgcgattaagaagataatttattaaaggtggtccttcctacctctgtggtgtgtgtcgcgcacacagcttagaagtgctataaaaaaggaaagagctccaaattgaatcacctttataatttacccatttctatacaacaggcagtggaagcagtttcagagaactttttgcatgcttatggttgatcagttaaaaaagaatgtccgtacacaataagggcgttaacccaaaaaaaaaggggccgctaagttcccgggccatagcaccgcttgtaaggccccagggggtttagagcggcgctacccggggngcaggccttggaccggggcaggcccaacagaaatggaacggcgggtaaatacacaccgacacctccccaag

SEQ ID NO: 21941 - DNA, 917 bp, Homo sapiens
ccacgcgttccgcccacgcgttcgcggacgcggtggggtcgcgcacacagcttagaagtgctataaaaaaggaaagagctccaaattgaatcacctttataatttacccatttctatacaacaggcagtggaagcagtttcagagaactttttgcatgcttatggttgatcagttaaaaaagaatgttacagtaacaaataaagtgcagtttaaaacccaactcttactcttaatttgttcctaatacgtatttttggcagggagagggaacggtccatgaaatctttatgtgatataaggattttaagtttgggccagtgaacagggtaaataaaatttaacttttgagcatatggaattttgattgcctttaaagttactattctgtatcattgattcatcaagaaaacctagatctgcactcacctcactgttcaatcattgagtggtaaaggacagaagtattttctagttctggtcagatgatataattttttttttttttttttgtgggggtgaagtcttgctctgccacccaggctggagtgcagtggcatgatgtcaactcactgcaacctccgcctcccgggttcaagtgattctcctgcctcagcctcccgagtagctgggattacaggtgtgtgccaccacacccggctaatttttgtatttttagtagagacgggatttccccatgttggccaggctggtctcaaactcctgacctcaggtgattcgcccacctcagcctcccaaagtgctgggattacaggtgtgggccactgcacctggcccagatgatataatttaactgtgttttaggtaacatgttaatgagggaaaatgtttaccagtgtagcattggatcaaaaagtttatcacacagtgttttaataaatggtttattctgcttacc

SEQ ID NO: 21942 - DNA, 1193 bp, Homo sapiens
  misc_feature (917)..(917): n is a, c, g, or t
gtgggcagccggggtctaggcaccacggtggctggcggcctgcgggcggcgctgtggcccgtcgggcggctccacagagccgccctagccttccgccttccccaagccaacgtctccgccgtcggctccgcggcgccgccatggccgacgtggaagacggagaggaaacctgcgccctggcctctcactccgggagctcaggctccaagtcgggaggcgacaagatgttctccctcaagaagtggaacgcggtggccatgtggagctgggacgtggagtgcgatacgtgcgccatctgcagggtccaggtgatggatgcctgtcttagatgtcaagctgaaaacaaacaagaggactgtgttgtggtctggggagaatgtaatcattccttccacaactgctgcatgtccctgtgggtgaaacagaacaatcgctgccctctctgccagcaggactgggtggtccaaagaatcggcaaatgagagtggttagaaggcttcttagcgcagttgttcagagccctggtggatcttgtaatccagtgccctacaaaggctagaacactacaggggatgaattcttcaaataggagccgatggatctgtggtcctttgggactcatcaaagccttggtttagcattttgtcagttttatcttcagaaattctctgcgattaagaagataatttattaaaggtggtccttcctacctctgtggtgtgtgtcgcgcacacagcttagaagtgctataaaaaaggaaagagctccaaattgaatcacctttataatttacccatttctatacaacaggcagtggaagcagtttcagagaactttttgcatgcttatggttgatcagttaaaaaagaatgttacagtaacaaataaagtgcagtttaaaacccaaaaaaaaaaanaaaaaaaaatgggggggttagtggggggggggggaaaaggggtaggaatgggccatgggtcataggctggtttcttggacccagtttttctggtccaaggggggaaagatctggccgggtccccctaataagggaggcggataaattcggataaagcgaggttaccggggtagtgtctggggagagaaaaccggggataaccagacaaggagcggttttgagacaaagacacacgaggaaaacctcaagggagaaatagcaagacaaacaaaaaga

SEQ ID NO: 21943 - DNA, 1867 bp, Homo sapiens
gtgggcagccggggtctaggcaccacggtggctggcggcctgcgggcggcgctgtggcccgtcgggcggctccacagagccgccctagccttccgccttccccaagccaacgtctccgccgtcggctccgcggcgccgccatggccgacgtggaagacggagaggaaacctgcgccctggcctctcactccgggagctcaggctccaagtcgggaggcgacaagatgttctccctcaagaagtggaacgcggtggccatgtggagctgggacgtggagtgcgatacgtgcgccatctgcagggtccaggtgatggatgagggaattggagttcgtaattggtccgaggccctgaacctaataaatgccagtgaaatgggatttgactgtagatctggctccacagccctcgctgtcccctctgtctcactggcttctcaccagccttgtctggatgaccatcggtagcaacctattggaagcatacaaagcagtttattttagaggaactctcaagtgtcttagggtagaaagtaaaaagttgcttcttatgagttgctaaaggaaggcttctgtgtcaatgcctgtcttagatgtcaagctgaaaacaaacaagaggactgtgttgtggtctggggagaatgtaatcattccttccacaactgctgcatgtccctgtgggtgaaacagaacaatcgctgccctctctgccagcaggactgggtggtccaaagaatcggcaaatgagagtggttagaaggcttcttagcgcagttgttcagagccctggtggatcttgtaatccagtgccctacaaaggctagaacactacaggggatgaattcttcaaataggagccgatggatctgtggtcctttgggactcatcaaagccttggtttagcattttgtcagttttatcttcagaaattctctgcgattaagaagataatttattaaaggtggtccttcctacctctgtggtgtgtgtcgcgcacacagcttagaagtgctataaaaaaggaaagagctccaaattgaatcacctttataatttacccatttctatacaacaggcagtggaagcagtttcagagaactttttgcatgcttatggttgatcagttaaaaaagaatgttacagtaacaaataaagtgcagtttaaaacccaactcttactcttaatttgttcctaatacgtatttttggcagggagagggaacggtccatgaaatctttatgtgatataaggattttaagtttgggccagtgaacagggtaaataaaatttaacttttgagcatatggaattttgattgcctttaaagttactattctgtatcattgattcatcaagaaaacctagatctgcactcacctcactgttcaatcattgagtggtaaaggacagaagtattttctagttctggtcagatgatataattttttttttttttttttgtgggggtgaagtcttgctctgccacccaggctggagtgcagtggcatgatgtcaactcactgcaacctccgcctcccgggttcaagtgattctcctgcctcagcctcccgagtagctgggattacaggtgtgtgccaccacacccggctaatttttgtatttttagtagagacgggatttccccatgttggccaggctggtctcaaactcctgacctcaggtgattcgcccacctcagcctcccaaagtgctgggattacaggtgtgggccactgcacctggcccagatgatataatttaactgtgttttaggtaacatgttaatgagggaaaatgtttaccagtgtagcattggatcaaaaagtttatcacacagtgttttaataaatggtttattctgcttacc

SEQ ID NO: 21944 - DNA, 985 bp, Homo sapiens
ttctttcgaaaggccggtttttggaaagaagaaaaggcagtcaccgtgtgcaccgattaagaagataatttattaaaggtggtccttcctacctctgtggtgtgtgtcgcgcacacagcttagaagtgctataaaaaaggaaagagctccaaattgaatcacctttataatttacccatttctatacaacaggcagtggaagcagtttcagagaactttttgcatgcttatggttgatcagttaaaaaagaatgttacagtaacaaataaagtgcagtttaaaacccaactcttactcttaatttgttcctaatacgtatttttggcagggagagggaacggtccatgaaatctttatgtgatataaggattttaagtttgggccagtgaacagggtaaataaaatttaacttttgagcatatggaattttgattgcctttaaagttactattctgtatcattgattcatcaagaaaacctagatctgcactcacctcactgttcaatcattgagtggtaaaggacagaagtattttctagttctggtcagatgatataattttttttttttttttttgtgggggtgaagtcttgctctgccacccaggctggagtgcagtggcatgatgtcaactcactgcaacctccgcctcccgggttcaagtgattctcctgcctcagcctcccgagtagctgggattacaggtgtgtgccaccacacccggctaatttttgtatttttagtagagacgggatttccccatgttggccaggctggtctcaaactcctgacctcaggtgattcgcccacctcagcctcccaaagtgctgggattacaggtgtgggccactgcacctggcccagatgatataatttaactgtgttttaggtaacatgttaatgagggaaaatgtttaccagtgtagcattggatcaaaaagtttatcacacagtgttttaataaatggtttattctgcttacc

SEQ ID NO: 21945 - DNA, 401 bp, Homo sapiens
gtaaaattctcaccagtttgtatcatccccacttaatatataaatacctcacagtattgtcccttttttacagatgagggaattggagttcgtaattggtccgaggccctgaacctaataaatgccagtgaaatgggatttgactgtagatctggctccacagccctcgctgtcccctctgtctcactggcttctcaccagccttgtctggatgaccatcggtagcaacctattggaagcatacaaagcagtttattttagaggaactctcaagtgtcttagggtagaaagtaaaaagttgcttcttatgagttgctaaaggaaggcttctgtgtcagtaagtatggatgactttaaaaaacttgtttatgaagcaattttttaatttaattttttataag

SEQ ID NO: 21946 - DNA, 521 bp, Homo sapiens
ttccttccacaactgctgcatgtccctgtgggtgaaacagaacaatcgctgccctctctgccagcaggactgggtggtccaaagaatcggcaaatgagagtggttagaaggcttcttagcgcagttgttcagagccctggtggatcttgtaatccagtgccctacaaaggctagaacactacaggggatgaattcttcaaataggagccgatggatctgtggtcctttgggactcatcaaagccttggtttagcattttgtcagttttatcttcagaaattctctgcgattaagaagataatttattaaaggtggtccttcctacctctgtggtgtgtgtcgcgcacacagcttagaagtgctataaaaaaggaaagagctccaaattgaatcacctttataatttacccatttctatacaacaggcagtggaagcagtttcagagaactttttgcatgcttatggttgatcagttaaaaaagaatgttacagtaacaaataaagtgcagtttaaaaccca

SEQ ID NO: 21947 - DNA, 905 bp, Homo sapiens
gtgggcagccggggtctaggcaccacggtggctggcggcctgcgggcggcgctgtggcccgtcgggcggctccacagagccgccctagccttccgccttccccaagccaacgtctccgccgtcggctccgcggcgccgccatggccgacgtggaagacggagaggaaacctgcgccctggcctctcactccgggagctcaggctccaagtcgggaggcgacaagatgttctccctcaagaagtggaacgcggtggccatgtggagctgggacgtggagtgcgatacgtgcgccatctgcagggtccaggtgatggatgcctgtcttagatgtcaagctgaaaacaaacaagaggactgtgttgtggtctggggagaatgtaatcattccttccacaactgctgcatgtccctgtgggtgaaacagaacaatcgctgccctctctgccagcaggactgggtggtccaaagaatcggcaaatgagagtggttagaaggcttcttagcgcagttgttcagagccctggtggatcttgtaatccagtgccctacaaaggctagaacactacaggggatgaattcttcaaataggagccgatggatctgtggtcctttgggactcatcaaagccttggtttagcattttgtcagttttatcttcagaaattctctgcgattaagaagataatttattaaaggtggtccttcctacctctgtggtgtgtgtcgcgcacacagcttagaagtgctataaaaaaggaaagagctccaaattgaatcacctttataatttacccatttctatacaacaggcagtggaagcagtttcagagaactttttgcatgcttatggttgatcagttaaaaaagaatgttacagtaacaaataaagtgcagtttaaaaccc

SEQ ID NO: 21948 - DNA, 1603 bp, Homo sapiens
gtgggcagccggggtctaggcaccacggtggctggcggcctgcgggcggcgctgtggcccgtcgggcggctccacagagccgccctagccttccgccttccccaagccaacgtctccgccgtcggctccgcggcgccgccatggccgacgtggaagacggagaggaaacctgcgccctggcctctcactccgggagctcaggctccaagtcgggaggcgacaagatgttctccctcaagaagtggaacgcggtggccatgtggagctgggacgtggagtgcgatacgtgcgccatctgcagggtccaggtgatggatgcctgtcttagatgtcaagctgaaaacaaacaagaggactgtgttgtggtctggggagaatgtaatcattccttccacaactgctgcatgtccctgtgggtgaaacagaacaatcgctgccctctctgccagcaggactgggtggtccaaagaatcggcaaatgagagtggttagaaggcttcttagcgcagttgttcagagccctggtggatcttgtaatccagtgccctacaaaggctagaacactacaggggatgaattcttcaaataggagccgatggatctgtggtcctttgggactcatcaaagccttggtttagcattttgtcagttttatcttcagaaattctctgcgattaagaagataatttattaaaggtggtccttcctacctctgtggtgtgtgtcgcgcacacagcttagaagtgctataaaaaaggaaagagctccaaattgaatcacctttataatttacccatttctatacaacaggcagtggaagcagtttcagagaactttttgcatgcttatggttgatcagttaaaaaagaatgttacagtaacaaataaagtgcagtttaaaacccaactcttactcttaatttgttcctaatacgtatttttggcagggagagggaacggtccatgaaatctttatgtgatataaggattttaagtttgggccagtgaacagggtaaataaaatttaacttttgagcatatggaattttgattgcctttaaagttactattctgtatcattgattcatcaagaaaacctagatctgcactcacctcactgttcaatcattgagtggtaaaggacagaagtattttctagttctggtcagatgatataattttttttttttttttttgtgggggtgaagtcttgctctgccacccaggctggagtgcagtggcatgatgtcaactcactgcaacctccgcctcccgggttcaagtgattctcctgcctcagcctcccgagtagctgggattacaggtgtgtgccaccacacccggctaatttttgtatttttagtagagacgggatttccccatgttggccaggctggtctcaaactcctgacctcaggtgattcgcccacctcagcctcccaaagtgctgggattacaggtgtgggccactgcacctggcccagatgatataatttaactgtgttttaggtaacatgttaatgagggaaaatgtttaccagtgtagcattggatcaaaaagtttatcacacagtgttttaataaatggtttattctgcttacc

SEQ ID NO: 21949 - DNA, 1033 bp, Homo sapiens
gtgggcagccggggtctaggcaccacggtggctggcggcctgcgggcggcgctgtggcccgtcgggcggctccacagagccgccctagccttccgccttccccaagccaacgtctccgccgtcggctccgcggcgccgccatggccgacgtggaagacggagaggaaacctgcgccctggcctctcactccgggagctcaggctccaagtcgggaggcgacaagatgttctccctcaagaagtggaacgcggtggccatgtggagctgggacgtggagtgcgatacgtgcgccatctgcagggtccaggtgatgggtaagcgctgcacgcgagtccagggccgccctgcggcctccgggagccgacctcggggttgggaagggacgggcgtccgtcagaagcctcggaaagtgccctgcctgggagagtgggtggaggtcgccctgccccggcgccggaggaacgcggagccacgctcctgctgcggctcctgagggctgcggccgccgcctggggctgcggggttgtgcaacaggcgccctgcgccgggtggttggtgttctagggagagagacgggcaataaacggagttaaacaaggtaatttcaggtagtgatgggtgtgaccaagaaagtaaaaccgggtgattgttgggaactagcaggaaacacttcggtttgtgtgtccagccccagccccacctctaaaagctcaacacaaggtggtcagggtaaaggccgtgattcagcagtgaactttaatagtcttggtcaccaccaaagtgatgctccagagtcatcttccacaaaacgacacccttagttctcctcgagggacgcaggaaagtgttcatagccattgcatttccggattagcttaccgccgctcttcgaatggcttttaaatctggattgatttaagacgggtcagatagcactagcgtggcttgaagggaacagtgtggttcaagaatatctaagtttcatggaagctgaagaattgtaagcccttttttcagaaacgtaaaacttca

SEQ ID NO: 21950 - DNA, 1564 bp, Homo sapiens
gtgggcagccggggtctaggcaccacggtggctggcggcctgcgggcggcgctgtggcccgtcgggcggctccacagagccgccctagccttccgccttccccaagccaacgtctccgccgtcggctccgcggcgccgccatggccgacgtggaagacggagaggaaacctgcgccctggcctctcactccgggagctcaggctccaagtcgggaggcgacaagatgttctccctcaagaagtggaacgcggtggccatgtggagctgggacgtggagtgcgatacgtgcgccatctgcagggtccaggtgatggatgcctgtcttagatgtcaagctgaaaacaaacaagaggactgtgttgtggtctggggagaatgtaatcattccttccacaactgctgcatgtccctgtgggtgaaacagaacaatcgctgccctctctgccagcaggactgggtggtccaaagaatcggcaaatgagagtggttagaaggcttcttagcgcagttgttcagagccctggtggatcttgtaatccagtgccctacaaaggctagaacactacaggggatgaatttcatcaaagccttggtttagcattttgtcagttttatcttcagaaattctctgcgattaagaagataatttattaaaggtggtccttcctacctctgtggtgtgtgtcgcgcacacagcttagaagtgctataaaaaaggaaagagctccaaattgaatcacctttataatttacccatttctatacaacaggcagtggaagcagtttcagagaactttttgcatgcttatggttgatcagttaaaaaagaatgttacagtaacaaataaagtgcagtttaaaacccaactcttactcttaatttgttcctaatacgtatttttggcagggagagggaacggtccatgaaatctttatgtgatataaggattttaagtttgggccagtgaacagggtaaataaaatttaacttttgagcatatggaattttgattgcctttaaagttactattctgtatcattgattcatcaagaaaacctagatctgcactcacctcactgttcaatcattgagtggtaaaggacagaagtattttctagttctggtcagatgatataattttttttttttttttttgtgggggtgaagtcttgctctgccacccaggctggagtgcagtggcatgatgtcaactcactgcaacctccgcctcccgggttcaagtgattctcctgcctcagcctcccgagtagctgggattacaggtgtgtgccaccacacccggctaatttttgtatttttagtagagacgggatttccccatgttggccaggctggtctcaaactcctgacctcaggtgattcgcccacctcagcctcccaaagtgctgggattacaggtgtgggccactgcacctggcccagatgatataatttaactgtgttttaggtaacatgttaatgagggaaaatgtttaccagtgtagcattggatcaaaaagtttatcacacagtgttttaataaatggtttattctgcttacc

SEQ ID NO: 21951 - DNA, 408 bp, Homo sapiens
taatctattgtatttctcaaccgtaatcttctgtctcagtcattttcaggttatttcaccttgcagcattttctacctatgcacaccacttttctggcctgagttctgatataagcgaaacaaaggtgagcacttgcatcaatgctttaggtggcttcagacatgttagaacagacaagaacaaataagatctgctcttcttggtccagaagctggaaccagaattccacactggaaaggctatcactgcttccagattgctgacattctagggaaacagtgaggcaagggaatgtttatatatgggaaagctttcctactgttttcaagttggcattttctttattaaaacaggcaaggttgttgtaaacctttgaatattttccaaagttctgacaatgttgatac

SEQ ID NO: 21952 - DNA, 437 bp, Homo sapiens
ggaagatggcctttgggtcctggatggttccgttgcaggccggcacagtggtctttcaaaggtcatcttttggctgcttttgatttatctcccttaatctcagatgtggctccccagagcactgtgcaggaaaaaagtcaaaacagccaggcttccccctctccgaggcagatggagaaagggcaggcaggcttccctgtccccatccacaacgtgcaagaggggcaggggccccagtggctaaaacccagccctacccatgatctgcttgaaatttcctccatccaggctacccctttggtttaaggtgctggttttccaccttagccacacattccagccacctggcaatggctaaaatacacctttcccgaggctgcacccccagagagttggattccatttttcaacagtggggtctagacatcggtgttttg

SEQ ID NO: 21953 - DNA, 474 bp, Homo sapiens
taagatactaatgatagagaaaactgaataagggtatatgggaactgtctgtagtatctttgcaacttttttgttatgtctaaaatgattctaaaataaaaagcttattaaaataatcatagcactatggcataattgttacttagagaatgagcaggaacaatttggtaatagtaataactttttccttgatatgattattttcactgtgctttaagggaagaaagaagccagatgcactggctcacgcctgtcatttcaacactttggaaggctgctacaggcagatcacttgagctcaggtgttcgagactagtctgggcaatagggcgaaacttcatctctacaaaaaaaaatttttttaaaattaactgggcatggtggtgtgtgcctgtagtcccagctatttgggaggttgaggtgggagaattacctgagcctgagaggttgaggctgccatgagctgagttgtga

SEQ ID NO: 21954 - DNA, 546 bp, Homo sapiens
gagaaatgagaaaagttggaagctgttgtggcctgactttatacccccaaaattcatattttgaataccccaaaaagaagtataatgtaagtccagaatcattactggtgatgacattcaaaagtcagaattgagatataccccaaagaacacaccttgctattgccctagagaagtttaatgtgttttatgcctatgttcctattgatgcagttaaagtgaccaactattagcaacaaaccccaaattgtcctttgtacaaaaatagttgattaggccaggtgcagtagctcatacctgtaaactcccagtactttgggaggccaaagtgggaagttcgcttgaagccaggaatttgagaccagtgggcaacatagcaagcccgtctctacaaagtgttaaaaaattagctgggctacttggaggatctggctacgtggtggctgagatgggaggattgcttgagcccaggagttcaagaccgcagtgagctatgattgtgccactgcactctagctgggcaagagtgagaccctttctcaaaaa

SEQ ID NO: 21955 - DNA, 799 bp, Homo sapiens
gtagtgccttacccatattccttttcgactgcactgattgttcctaacaactgaaatgttttctattgtagcatctgtagataaaatagataacaatcaaaagagttacagtttatttagtcccttgtgatgggacagtggtttctttctaactaggcttaggcaaagaaaatacagttttcttcttcttcttcttttttttttttgttcgagaaggagtcttgctctgtcacccaggctatggtgcagtggcagaatctcagctcactgcaacctctgcctcctgggttcaagcaattctcctacctcagctacttggaaggctgaggcacaagaatcgcttgaagccaggaaacagattgcagtgggccaagatcgtgccatgcactccagcctggactctgtctaaaaaaaaaaatacggagtcataatttattatgcatattatatacatattgagcacttactatatagagtactgtcctgtgcatttcttatgtattagttaaccttcacttttattttctccattttgtggataagaaactaaaggacagggtatttaggaaaattgcaaaagatgtctccattagaaaataaaagaaccacattttgaccccaagcaatcttcctctagtgcctggttggtgtctccatataaaataaactgaatttgaatcctggctctactatttagtaggaatatagctttggataagtcatctaatctctttgagcctcactttctacatgaggtagttggcagattgtgagtaaagctccttagtccattgtgatt

SEQ ID NO: 21956 - DNA, 337 bp, Homo sapiens
tgcagtactttatagtttgtaaagtgcttttatgactattagctcatttgatcctctgggaggtaggcagggcaggtagttattccattttacagatgagaaaagtgaggttcagagaggatgaagtgacttcattagggtttcaaagggtcaagtggtgaaataaagacctgagtttgggtcatttgacttctaatctaatcatctcctcttcattaaggctgacttcatctgttctatgttgtcatatccagttgccctttcagagaatgcagttatctgactttgtcaccacatttttggggataccctgaaaataaaactgtggtggttcatg

SEQ ID NO: 21957 - DNA, 534 bp, Homo sapiens
ctgcagtggtttaagaagtatggaattttacctcattctttaaatttgggtggcattcagaaagcccttctaaaaccttctaataaattggatcagctgagtttagacttgtaatttattttttaaaacaaagagggcatattaaatgagtaatttggaaatacttcagatgaataaataacatctctgcaacttcctttttctcctgatcagtcctgtgagtgacccttgataacttttcttaaaagcaatatgagtcaaccaaagaataagattaatttttgaggatttgtgataaccagaagaaagcactgtaggctgtgacaacctgtgagggccgagagaaatacaggggagccaactggtgatccatattggctttcatagagtggtagtatttttgtgtcagcttgttacatgcctgaacctctggattgcagcagtgttgtcattgtaccagcagttgctcagactctaatcagagtctgatttaccctcaataaagttctgtacgcatcagattggaatcatgaa

SEQ ID NO: 21958 - DNA, 1142 bp, Homo sapiens
agcctacttgcaggagatatggaaggcagaagtgaagaaagcattagtcaggttttatagccaccatatgtggagacagatggatgcataggagcttcagggacacctgcttccaccacattgtcctgatcctttgctctgccaattgagagtattcttagaaccaccactaactgcttgactgccatattttccttccttccttccttctttctttccctttccctttcttttctttctttactttctttttccgagatggagtcttgctctgtcgcccaggctggagtgcagtggtacgatcttggctcactgcaacctctgccttctgggttcaagcaattgtcctgccccagcctcccaagtagctgggattataggtgcccaccaccaagcccagctaaattttttttgtatttttagtagagacagggtttcatcattgttggccaggctggtctcaaactcctgacctcatgatctgcccaccttggccttccaaagtgctgagattacaggcgtgagccactgtgcatggccccagctgccatattttcaaagatgtagttttccacaaattgtcttcaaaagttctactcaaagatgcactgcagtttggattttcctagaaactctaatgtgtccaccaggcaaccatttagactcttaaggttgggaatattctctgatgctctgactcacctcatctctaggttgaatttatccaaggtattatttatgtaataaacaccatgttttgttaacagtaccagtgactatgtgtttctgattccaccgtgacaactacagtggtgcagtcaaaaagaactacatgggtgtttgcttctccactgcactgtgcagggaatgcacttacccagtcctacagtgtaagaataagcaccttcctaatatcaagcagattgtcggtgtttcctattacagttgaatgtcatctctcagtacattttcaattttgtttcattatatgtgattaaaaaccatgtgtatgtttttgttgaacaaaagcttctgtagatgtttcttagaaatattttattaacttttcaaataacttgtatgctatcacttgtctatttaattttctgcaaggatatattaaaatattccattgcaattat

SEQ ID NO: 21959 - DNA, 5526 bp, Homo sapiens
tggatttcgaggtcggggataaaatccgaattctggcgaccttggaagatggctggctggaaggatccctgaagggcaggacaggcatctttccttaccggtttgtgaaattatgtcctgacacacgggtggaggaaaccatggctctgccccaggaaggcagccttgccaggatcccggaaacttctttggattgtttggagaacaccttaggagtagaggaacaaagacatgaaaccagtgaccatgaggccgaggagcctgactgcattatttctgaagcacccacttctcccctcggtcatctgacttcagagtatgacacagacagaaactcttatcaggacgaggacaccgcaggagggcccccgagaagcccaggcgtggagtgggaaatgcctcttgccacagactctcccacatctgaccctacagaagtagtcaatggtatttcctcccaacctcaggtcccttttcatcccaacttgcagaaaagccagtattattctacagtgggagggagccacccgcactcagaacagtaccccgaccttcttcccctagaagcaaggactagagactatgccagcctacctcccaaaagaatgtattcccagctaaaaactcttcagaagccagtgctccctctttacaggggctcttctgtttcagcttcaagggtagtcaaacccagacaatcaagtcctcagctccacaacctagcaagttatactaaaaagcaccacacgtccagtgtttactccatctcagagagattggagatgaagcctggtccgcaagcccaagggcttgttatggaagcagcaacacattcacagggagacggcagcactgacctggactcgaagctgacacaacagctgatcgagtttgagaagagcttggcagggcccggcacagagccagataaaattttacgccacttttcaatcatggactttaactctgagaaggatattgtccgaggttcctcaaagttaatcaccgagcaggagctgccggaaaggagaaaggccctaaggccaccgccacctcgtccctgtactccggtatccacttctccccatttgctggttgaccagaacctaaaacctgcaccacccttggtggtgcgaccctctcgcccagctcccctgcctccctcagcacagcagagaacgaatgcggtatcccccaagctcctatctcgacaccgtcctacctgtgagaccttagaaaaggagggccctggtcatatgggaaggagtctggaccagacctccccatgccccttagtgctggtgaggattgaggaaatggagcgggacttggatatgtacagtagagctcaagaagagctaaacctcatgctggaggagaagcaggatgaatcatcaagagcagagaccctcgaggatctcaagttctgtgaaagtaacattgaaagtttgaatatggaactccagcaactaagagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtaccaaacattgattttgagggactttttggaaatatgcagatggtgattaaggtctcgaagcaattattggctgctctggaaatcagcgatgctgtaggacctgtgtttcttggtcaccgggatgagcttgagggaacatacaagatttactgccagaatcatgatgaggccattgcgctgcttgaaatctacgagaaggatgagaagatccagaagcatcttcaggactccttggcagatctgaagagcctatacaacgaatggggatgcacaaattatattaacctgggctccttcctcatcaaaccagtacagagagtaatgcgttacccgctgttgctaatggagttgctgaattccaccccagaatcccacccagataaagtgcctttaaccaatgcagtccttgcggtcaaggaaatcaacgttaacattaatgaatataaacggcgaaaggacctggtcctcaagtaccgtaagggtgatgaagatagccttatggagaaaatttccaaactgaacatccactccatcatcaagaaatccaaccgagttagcagtcacctgaagcatctcactggctttgctcctcagataaaagatgaagtatttgaagaaacagaaaaaaacttccgaatgcaagaaagattgattaagtcttttatccgagacctgtctctctacctccaacacatccgggagtccgcatgtgtgaaagtggtggctgctgtgagcatgtgggatgtgtgcatggagagaggacaccgggacctggagcagtttgagagggtgcatcgctacatcagtgaccagctcttcacaaactttaaggagaggacagagcggcttgtcatctcccccttaaatcagttactgagcatgtttacagggccccataagctggtacagaaacgctttgacaagctcctggacttctataactgtacagaacgggcagaaaagctaaaggacaagaagaccctggaggagctgcagtcggcccggaacaactatgaggccctgaatgcacagctgctggatgagctgcccaagttccaccagtacgcccagggcctcttcaccaactgtgtccacggctatgctgaagcccactgtgactttgtgcaccaggctctggagcaattaaagccactgctttcgttactcaaagtggctggcagagagggaaaccttattgccatcttccacgaagagcacagcagagttctgcagcaactccaggtttttaccttcttcccggagtctcttccagctaccaagaagccatttgagaggaaaaccattgaccgccagtctgctcgaaagccactcctgggcctgccaagttacatgctacagtcagaagaactccgggcctccctcctggccaggtatccccctgaaaaactcttccaggcagaacggaacttcaatgctgctcaagacttggatgtctcacttttggaaggtgacctggtgggtgtgattaagaaaaaagaccccatgggcagccagaaccgctggctgattgacaatggagtcaccaaaggcttcgtgtacagctctttcctaaagccctacaatcctcgccgcagccactccgatgcctccgtgggtagccactcctccacagagtctgagcacggcagctcctcccccaggttcccacgccagaacagcggcagcaccctgaccttcaaccccagcagcatggctgtatcctttacctcggggtcttgccagaagcagcctcaagatgcatctcctccgccaaaagaatgtgaccaaggaactctcagtgcatccctaaatccgagtaattcagagagtagtccttccagatgcccttcagacccagactccacctcccagccaaggtcaggggactctgcagatgtagctagagatgtaaagcaacccactgccacgccgaggagctaccggaacttcaggcatccagaaatagttggctactccgtaccaggacgaaatgggcaaagtcaagacctcgtcaaaggatgtgcaagaacagcccaggctccggaagacagaagtacagagccagatggcagtgaggcagaaggcaaccaggtctattttgctgtctacaccttcaaggcacgaaacccaaatgagctgagcgtgtcagccaatcagaaactcaagatcctcgagtttaaagatgttacaggaaatacagagtggtggttagctgaggttaacgggaagaagggctacgttccctccaattatatccgcaaaaccgagtacacctgagcccacgttgcctgccacccagccttgctgcctttgctttcagtccgccgagggttctggcggcccaccgagagggcgcctgctcctgagacacaggccctgtctgcgttgcttaaccatggcatggtggagcacaccacagatcttgttctcctcgattgggttgtaaaccttgatgctcactagaatctctagaatttgaaatggaccctggggctttgcaaatgacttagtgactatgagaagagagacaagtcttagagctggcttttggaaaggagaaacttgcagtcagaagcccagtgtcctatgtatgcaggaagctgtgctctagcaatagacagtgttggtaatggttgtgctgtacggcgtttggggtggccccatgttccatgctcagctgaccggatgccaactcagatgaaaagaattcatggctctgggcaccccgtgaggcagtgcttgcacatggctgggagtttgtcgggattgaaccaaacctagtgcttcaaagctcctgggacacctccagtgtccagcacacattctcatacatactgcccctaatttctaaagtccctaaagcactacattctgtaaccttgtttcttttactccattcccagattagttatgcaaaattcaactgcgttctacttttagaagtgtttagggtctttattttctgttgacccttcatctgaaagattctcttcccttgttaggtacaatcactgcccccccgcttttttttttgagatggggtcttgctatgttgcccaggctggtcttaaacgcctgggctcaagcaaccctcccgcctccctgctgagattacaggtgtaagccaccataccgcaacctcaatgacacctttctgatggtctttacacagtctgtgatgtctggtggcccccctgccctggactcaataattgatagattttcctagagtaacagtatgagagctccagccattccattaaaagtattagttctgctttgagctgaaaccagttgagcctaatggaagactggatgtctttcttcttcatccaagcaccctaatgactgtttagttacatccatagatgcagacaacataacacctgtgacttacttgaattgggataagccattccagaagtagcttatcctagacttggaaataagatttttttcaccactaacttccatgcttcagagatgacattcaaagccagattcccaagtgcctgatcatacctcccagtctcaggaagatatttgcttaccccttagaccaagaatcttaagatcttccccagctatgaagcctatcttggaatgggaaaccatgaaatttgtcttttaaaagaaagggaagaaatagccttacagcccctgttccctccaagtgcacatttagccttaaaatcctgggagtcgggagacaccgtggagtccttacatccacagtgtctgctggtcgtggtcagaaggcagtaatgcaagagtccttttgtgaagagtgtttctatgtagagatgtttatatttaagtagttcttttataaataaaagcatttctaatggcc

SEQ ID NO: 21960 - DNA, 494 bp, Homo sapiens
gtttttgtgtgtcttgttttaagcaagctacttttgccagtaagattaaaggagtgtccagatttgctaacagcacttgtttatttttgaacagataaaagatgaagtatttgaagaaacagaaaaaaacttccgaatgcaagaaagattgattaagtcttttatccgagacctgtctctctacctccaacacatccgggtgagcgtcaacatcactgtagttagattaacatacgatgtaattctgtcccctttcctgttcatcagtcatattgtttaatgaatgctgagtaatctggactcaaattactattatgccccatcatactttttgttgagatgccagtaggttatttaacagtaatagcatttagatcaatgttgtcacattcatttcaaagcagcccaactttttccaccctctttttggtcttcatcacccttcatcccacacacaccttatttttcttttacttattacagttcattttatc

SEQ ID NO: 21961 - DNA, 4898 bp, Homo sapiens
gaggtgacagcgggctggggactggcggctgcaactgcctgccgcgccgagggaccgccgggcggcggaaagcagcattggccaggactactagaactgtgtcaaaacagctgctacactaacgggcatctttgtcttgttctcagtcttaaaaagagttataaaacatggaggctggctcagtggttcgagccatttttgacttctgccctagcgtatcagcactgacctggactcgaagctgacacaacagctgatcgagtttgagaagagcttggcagggcccggcacagagccagataaaattttacgccacttttcaatcatggactttaactctgagaaggatattgtccgaggttcctcaaagttaatcaccgagcaggagctgccggaaaggagaaaggccctaaggccaccgccacctcgtccctgtactccggtatccacttctccccatttgctggttgaccagaacctaaaacctgcaccacccttggtggtgcgaccctctcgcccagctcccctgcctccctcagcacagcagagaacgaatgcggtatcccccaagctcctatctcgacaccgtcctacctgtgagaccttagaaaaggagggccctggtcatatgggaaggagtctggaccagacctccccatgccccttagtgctggtgaggattgaggaaatggagcgggacttggatatgtacagtagagctcaagaagagctaaacctcatgctggaggagaagcaggatgaatcatcaagagcagagaccctcgaggatctcaagttctgtgaaagtaacattgaaagtttgaatatggaactccagcaactaagagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtaccaaacattgattttgagggactttttggaaatatgcagatggtgattaaggtctcgaagcaattattggctgctctggaaatcagcgatgctgtaggacctgtgtttcttggtcaccgggatgagcttgagggaacatacaagatttactgccagaatcatgatgaggccattgcgctgcttgaaatctacgagaaggatgagaagatccagaagcatcttcaggactccttggcagatctgaagagcctatacaacgaatggggatgcacaaattatattaacctgggctccttcctcatcaaaccagtacagagagtaatgcgttacccgctgttgctaatggagttgctgaattccaccccagaatcccacccagataaagtgcctttaaccaatgcagtccttgcggtcaaggaaatcaacgttaacattaatgaatataaacggcgaaaggacctggtcctcaagtaccgtaagggtgatgaagatagccttatggagaaaatttccaaactgaacatccactccatcatcaagaaatccaaccgagttagcagtcacctgaagcatctcactggctttgctcctcagataaaagatgaagtatttgaagaaacagaaaaaaacttccgaatgcaagaaagattgattaagtcttttatccgagacctgtctctctacctccaacacatccgggagtccgcatgtgtgaaagtggtggctgctgtgagcatgtgggatgtgtgcatggagagaggacaccgggacctggagcagtttgagagggtgcatcgctacatcagtgaccagctcttcacaaactttaaggagaggacagagcggcttgtcatctcccccttaaatcagttactgagcatgtttacagggccccataagctggtacagaaacgctttgacaagctcctggacttctataactgtacagaacgggcagaaaagctaaaggacaagaagaccctggaggagctgcagtcggcccggaacaactatgaggccctgaatgcacagctgctggatgagctgcccaagttccaccagtacgcccagggcctcttcaccaactgtgtccacggctatgctgaagcccactgtgactttgtgcaccaggctctggagcaattaaagccactgctttcgttactcaaagtggctggcagagagggaaaccttattgccatcttccacgaagagcacagcagagttctgcagcaactccaggtttttaccttcttcccggagtctcttccagctaccaagaagccatttgagaggaaaaccattgaccgccagtctgctcgaaagccactcctgggcctgccaagttacatgctacagtcagaagaactccgggcctccctcctggccaggtatccccctgaaaaactcttccaggcagaacggaacttcaatgctgctcaagacttggatgtctcacttttggaaggtgacctggtgggtgtgattaagaaaaaagaccccatgggcagccagaaccgctggctgattgacaatggagtcaccaaaggcttcgtgtacagctctttcctaaagccctacaatcctcgccgcagccactccgatgcctccgtgggtagccactcctccacagagtctgagcacggcagctcctcccccaggttcccacgccagaacagcggcagcaccctgaccttcaaccccagcagcatggctgtatcctttacctcggggtcttgccagaagcagcctcaagatgcatctcctccgccaaaagaatgtgaccaaggaactctcagtgcatccctaaatccgagtaattcagagagtagtccttccagatgcccttcagacccagactccacctcccagccaaggtcaggggactctgcagatgtagctagagatgtaaagcaacccactgccacgccgaggagctaccggaacttcaggcatccagaaatagttggctactccgtaccaggacgaaatgggcaaagtcaagacctcgtcaaaggatgtgcaagaacagcccaggctccggaagacagaagtacagagccagatggcagtgaggcagaaggcaaccaggtctattttgctgtctacaccttcaaggcacgaaacccaaatgagctgagcgtgtcagccaatcagaaactcaagatcctcgagtttaaagatgttacaggaaatacagagtggtggttagctgaggttaacgggaagaagggctacgttccctccaattatatccgcaaaaccgagtacacctgagcccacgttgcctgccacccagccttgctgcctttgctttcagtccgccgagggttctggcggcccaccgagagggcgcctgctcctgagacacaggccctgtctgcgttgcttaaccatggcatggtggagcacaccacagatcttgttctcctcgattgggttgtaaaccttgatgctcactagaatctctagaatttgaaatggaccctggggctttgcaaatgacttagtgactatgagaagagagacaagtcttagagctggcttttggaaaggagaaacttgcagtcagaagcccagtgtcctatgtatgcaggaagctgtgctctagcaatagacagtgttggtaatggttgtgctgtacggcgtttggggtggccccatgttccatgctcagctgaccggatgccaactcagatgaaaagaattcatggctctgggcaccccgtgaggcagtgcttgcacatggctgggagtttgtcgggattgaaccaaacctagtgcttcaaagctcctgggacacctccagtgtccagcacacattctcatacatactgcccctaatttctaaagtccctaaagcactacattctgtaaccttgtttcttttactccattcccagattagttatgcaaaattcaactgcgttctacttttagaagtgtttagggtctttattttctgttgacccttcatctgaaagattctcttcccttgttaggtacaatcactgcccccccgcttttttttttgagatggggtcttgctatgttgcccaggctggtcttaaacgcctgggctcaagcaaccctcccgcctccctgctgagattacaggtgtaagccaccataccgcaacctcaatgacacctttctgatggtctttacacagtctgtgatgtctggtggcccccctgccctggactcaataattgatagattttcctagagtaacagtatgagagctccagccattccattaaaagtattagttctgctttgagctgaaaccagttgagcctaatggaagactggatgtctttcttcttcatccaagcaccctaatgactgtttagttacatccatagatgcagacaacataacacctgtgacttacttgaattgggataagccattccagaagtagcttatcctagacttggaaataagatttttttcaccactaacttccatgcttcagagatgacattcaaagccagattcccaagtgcctgatcatacctcccagtctcaggaagatatttgcttaccccttagaccaagaatcttaagatcttccccagctatgaagcctatcttggaatgggaaaccatgaaatttgtcttttaaaagaaagggaagaaatagccttacagcccctgttccctccaagtgcacatttagccttaaaatcctgggagtcgggagacaccgtggagtccttacatccacagtgtctgctggtcgtggtcagaaggcagtaatgcaagagtccttttgtgaagagtgtttctatgtagagatgtttatatttaagtagttcttttataaataaaagcatttctaatggcc

SEQ ID NO: 21962 - DNA, 5570 bp, Homo sapiens
  misc_feature (5209)..(5209): n is a, c, g, or t
  misc_feature (5217)..(5217): n is a, c, g, or t
tggatttcgaggtcggggataaaatccgaattctggcgaccttggaagatggctggctggaaggatccctgaagggcaggacaggcatctttccttaccggtttgtgaaattatgtcctgacacacgggtggaggaaaccatggctctgccccaggaaggcagccttgccaggatcccggaaacttctttggattgtttggagaacaccttaggagtagaggaacaaagacatgaaaccagtgaccatgaggccgaggagcctgactgcattatttctgaagcacccacttctcccctcggtcatctgacttcagagtatgacacagacagaaactcttatcaggacgaggacaccgcaggagggcccccgagaagcccaggcgtggagtgggaaatgcctcttgccacagactctcccacatctgaccctacagaagtagtcaatggtatttcctcccaacctcaggtcccttttcatcccaacttgcagaaaagccagtattattctacagtgggagggagccacccgcactcagaacagtaccccgaccttcttcccctagaagcaaggactagagactatgccagcctacctcccaaaagaatgtattcccagctaaaaactcttcagaagccagtgctccctctttacaggggctcttctgtttcagcttcaagggtagtcaaacccagacaatcaagtcctcagctccacaacctagcaagttatactaaaaagcaccacacgtccagtgtttactccatctcagagagattggagatgaagcctggtccgcaagcccaagggcttgttatggaagcagcaacacattcacagggagacggcagcactgacctggactcgaagctgacacaacagctgatcgagtttgagaagagcttggcagggcccggcacagagccagataaaattttacgccacttttcaatcatggactttaactctgagaaggatattgtccgaggttcctcaaagttaatcaccgagcaggagctgccggaaaggagaaaggccctaaggccaccgccacctcgtccctgtactccggtatccacttctccccatttgctggttgaccagaacctaaaacctgcaccacccttggtggtgcgaccctctcgcccagctcccctgcctccctcagcacagcagagaacgaatgcggtatcccccaagctcctatctcgacaccgtcctacctgtgagaccttagaaaaggagggccctggtcatatgggaaggagtctggaccagacctccccatgccccttagtgctggtgaggattgaggaaatggagcgggacttggatatgtacagtagagctcaagaagagctaaacctcatgctggaggagaagcaggatgaatcatcaagagcagagaccctcgaggatctcaagttctgtgaaagtaacattgaaagtttgaatatggaactccagcaactaagagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtaccaaacattgattttgagggactttttggaaatatgcagatggtgattaaggtctcgaagcaattattggctgctctggaaatcagcgatgctgtaggacctgtgtttcttggtcaccgggatgagcttgagggaacatacaagatttactgccagaatcatgatgaggccattgcgctgcttgaaatctacgagaaggatgagaagatccagaagcatcttcaggactccttggcagatctgaagagcctatacaacgaatggggatgcacaaattatattaacctgggctccttcctcatcaaaccagtacagagagtaatgcgttacccgctgttgctaatggagttgctgaattccaccccagaatcccacccagataaagtgcctttaaccaatgcagtccttgcggtcaaggaaatcaacgttaacattaatgaatataaacggcgaaaggacctggtcctcaagtaccgtaagggtgatgaagatagccttatggagaaaatttccaaactgaacatccactccatcatcaagaaatccaaccgagttagcagtcacctgaagcatctcactggctttgctcctcagataaaagatgaagtatttgaagaaacagaaaaaaacttccgaatgcaagaaagattgattaagtcttttatccgagacctgtctctctacctccaacacatccgggagtccgcatgtgtgaaagtggtggctgctgtgagcatgtgggatgtgtgcatggagagaggacaccgggacctggagcagtttgagagggtgcatcgctacatcagtgaccagctcttcacaaactttaaggagaggacagagcggcttgtcatctcccccttaaatcagttactgagcatgtttacagggccccataagctggtacagaaacgctttgacaagctcctggacttctataactgtacagaacgggcagaaaagctaaaggacaagaagaccctggaggagctgcagtcggcccggaacaactatgaggccctgaatgcacagctgctggatgagctgcccaagttccaccagtacgcccagggcctcttcaccaactgtgtccacggctatgctgaagcccactgtgactttgtgcaccaggctctggagcaattaaagccactgctttcgttactcaaagtggctggcagagagggaaaccttattgccatcttccacgaagagcacagcagagttctgcagcaactccaggtttttaccttcttcccggagtctcttccagctaccaagaagccatttgagaggaaaaccattgaccgccagtctgctcgaaagccactcctgggcctgccaagttacatgctacagtcagaagaactccgggcctccctcctggccaggtatccccctgaaaaactcttccaggcagaacggaacttcaatgctgctcaagacttggatgtctcacttttggaaggtgacctggtgggtgtgattaagaaaaaagaccccatgggcagccagaaccgctggctgattgacaatggagtcaccaaaggcttcgtgtacagctctttcctaaagccctacaatcctcgccgcagccactccgatgcctccgtgggtagccactcctccacagagtctgagcacggcagctcctcccccaggttcccacgccagaacagcggcagcaccctgaccttcaaccccagcagcatggctgtatcctttacctcggggtcttgccagaagcagcctcaagatgcatctcctccgccaaaagaatgtgaccaaggaactctcagtgcatccctaaatccgagtaattcagagagtagtccttccagatgcccttcagacccagactccacctcccagccaaggtcaggggactctgcagatgtagctagagatgtaaagcaacccactgccacgccgaggagctaccggaacttcaggcatccagaaatagttggctactccgtaccaggacgaaatgggcaaagtcaagacctcgtcaaaggatgtgcaagaacagcccaggctccggaagacagaagtacagagccagatggcagtgaggcagaaggcaaccaggtctattttgctgtctacaccttcaaggcacgaaacccaaatgagctgagcgtgtcagccaatcagaaactcaagatcctcgagtttaaagatgttacaggaaatacagagtggtggttagctgaggttaacgggaagaagggctacgttccctccaattatatccgcaaaaccgagtacacctgagcccacgttgcctgccacccagccttgctgcctttgctttcagtccgccgagggttctggcggcccaccgagagggcgcctgctcctgagacacaggccctgtctgcgttgcttaaccatggcatggtggagcacaccacagatcttgttctcctcgattgggttgtaaaccttgatgctcactagaatctctagaatttgaaatggaccctggggctttgcaaatgacttagtgactatgagaagagagacaagtcttagagctggcttttggaaaggagaaacttgcagtcagaagcccagtgtcctatgtatgcaggaagctgtgctctagcaatagacagtgttggtaatggttgtgctgtacggcgtttggggtggccccatgttccatgctcagctgaccggatgccaactcagatgaaaagaattcatggctctgggcaccccgtgaggcagtgcttgcacatggctgggagtttgtcgggattgaaccaaacctagtgcttcaaagctcctgggacacctccagtgtccagcacacattctcatacatactgcccctaatttctaaagtccctaaagcactacattctgtaaccttgtttcttttactccattcccagattagttatgcaaaattcaactgcgttctacttttagaagtgtttagggtctttattttctgttgacccttcatctgaaagattctcttcccttgttaggtacaatcactgcccccccgcttttttttttgagatggggtcttgctatgttgcccaggctggtcttaaacgcctgggctcaagcaaccctcccgcctccctgctgagattacaggtgtaagccaccataccgcaacctcaatgacacctttctgatggtctttacacagtctgtgatgtctggtggcccccctgccctggactcaataattgatagattttcctagagtaacagtatgagagctccagccattccattaaaagtattagttctgctttgagctgaaaccagttgagcctaatggaagactggatgtctttcttcttcatccaagcaccctaatgactgtttagttacatccatagatgcagacaacataacacctgtgacttacttgaattgggataagccattccagaagtagcttatcctagacttggaaataagatttttttcaccactaacttccatgcttcagagatgacattcaaagccagattcccaagtgcctgatccaaaaattataaaccccnccttctcnccccaaggtttcttacgaaggggggaaaaaagggaaaaaatatttgcttaccccttagaccaagaatcttaagatcttccccagctatgaagcctatcttggaatgggaaaccatgaaatttgtcttttaaaagaaagggaagaaatagccttacagcccctgttccctccaagtgcacatttagccttaaaatcctgggagtcgggagacaccgtggagtccttacatccacagtgtctgctggtcgtggtcagaaggcagtaatgcaagagtccttttgtgaagagtgtttctatgtagagatgtttatatttaagtagttcttttataaataaaagcatttctaatggcc

SEQ ID NO: 21963 - DNA, 2667 bp, Homo sapiens
tggatttcgaggtcggggataaaatccgaattctggcgaccttggaagatggctggctggaaggatccctgaagggcaggacaggcatctttccttaccggtttgtgaaattatgtcctgacacacgggtggaggaaaccatggctctgccccaggaaggcagccttgccaggatcccggaaacttctttggattgtttggagaacaccttaggagtagaggaacaaagacatgaaaccagtgaccatgaggccgaggagcctgactgcattatttctgaagcacccacttctcccctcggtcatctgacttcagagtatgacacagacagaaactcttatcaggacgaggacaccgcaggagggcccccgagaagcccaggcgtggagtgggaaatgcctcttgccacagactctcccacatctgaccctacagaagtagtcaatggtatttcctcccaacctcaggtcccttttcatcccaacttgcagaaaagccagtattattctacagtgggagggagccacccgcactcagaacagtaccccgaccttcttcccctagaagcaaggactagagactatgccagcctacctcccaaaagaatgtattcccagctaaaaactcttcagaagccagtgctccctctttacaggggctcttctgtttcagcttcaagggtagtcaaacccagacaatcaagtcctcagctccacaacctagcaagttatactaaaaagcaccacacgtccagtgtttactccatctcagagagattggagatgaagcctggtccgcaagcccaagggcttgttatggaagcagcaacacattcacagggagacggcagcactgacctggactcgaagctgacacaacagctgatcgagtttgagaagagcttggcagggcccggcacagagccagataaaattttacgccacttttcaatcatggactttaactctgagaaggatattgtccgaggttcctcaaagttaatcaccgagcaggagctgccggaaaggagaaaggccctaaggccaccgccacctcgtccctgtactccggtatccacttctccccatttgctggttgaccagaacctaaaacctgcaccacccttggtggtgcgaccctctcgcccagctcccctgcctccctcagcacagcagagaacgaatgcggtatcccccaagctcctatctcgacaccgtcctacctgtgagaccttagaaaaggagggccctggtcatatgggaaggagtctggaccagacctccccatgccccttagtgctggtgaggattgaggaaatggagcgggacttggatatgtacagtagagctcaagaagagctaaacctcatgctggaggagaagcaggatgaatcatcaagagcagagaccctcgaggatctcaagttctgtgaaagtaacattgaaagtttgaatatggaactccagcaactaagagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtaccaaacattgattttgagggactttttggaaatatgcagatggtgattaaggtctcgaagcaattattggctgctctggaaatcagcgatgctgtaggacctgtgtttcttggtcaccgggatgagcttgagggaacatacaagatttactgccagaatcatgatgaggccattgcgctgcttgaaatctacgagaaggatgagaagatccagaagcatcttcaggactccttggcagatctgaagagcctatacaacgaatggggatgcacaaattatattaacctgggctccttcctcatcaaaccagtacagagagtaatgcgttacccgctgttgctaatggagttgctgaattccaccccagaatcccacccagataaagtgcctttaaccaatgcagtccttgcggtcaaggaaatcaacgttaacattaatgaatataaacggcgaaaggacctggtcctcaagtaccgtaagggtgatgaagatagccttatggagaaaatttccaaactgaacatccactccatcatcaagaaatccaaccgagttagcagtcacctgaagcatctcactggctttgctcctcagataaaagatgaagtatttgaagaaacagaaaaaaacttccgaatgcaagaaagattgattaagtcttttatccgagacctgtctctctacctccaacacatccgggtgagcgtcaacatcactgtagttagattaacatacgatgtaattctgtcccctttcctgttcatcagtcatattgtttaatgaatgctgagtaatctggactcaaattactattatgccccatcatactttttgttgagatgccagtaggttatttaacagtaatagcatttagatcaatgttgtcacattcatttcaaagcagcccaactttttccaccctctttttggtcttcatcacccttcatcccacacacaccttatttttcttttacttattacagttcattttatc

SEQ ID NO: 21964 - DNA, 719 bp, Homo sapiens
gtttcaccatgttggccaggctggtcttaaattcccaacttcaggtgatccacccatctcagcctcccagagtgctgggattacaggcatgagccaccgtgcccggccaaattggtgttttcttttaatcatccctattatggtagccatcatccgtatgtacctatttaaatttattttagttaaaattaaataagattaaaaattcagttcctctgtctcactggccatatttcaggggctcagtagccacatgtgggcatgtggatgtggaaccctccccaacaccgcacgaagctgttggatggcattgctcccagcaatttcccattttctctctctccctcacacaggtctattttgctgtctacaccttcaaggcacgaaacccaaatgagctgagcgtgtcagccaatcagaaactcaagatcctcgagtttaaagatgttacaggaaatacagagtggtggttagctgaggttaacgggaagaagggctacgttccctccaattatatccgcaaaaccgagtacacctgagcccacgttgcctgccacccagccttgctgcctttgctttcagtccgccgagggttctggcggcccaccgagagggcgcctgctcctgagacacaggccctgtctgcgttgcttaaccatggcatggtggagcacaccacagatcttgttctcctcgattgggttgtaaaccttgatgct

SEQ ID NO: 21965 - DNA, 4180 bp, Homo sapiens
ggggaaatgccgaccctattcaaaggagtttggggggttgtggagcattccagagctctgggaagattctgtcccgcctgcttaccctcaggcccacacctccacacacagccagctctgggcactgcagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtaccaaacattgattttgagggactttttggaaatatgcagatggtgattaaggtctcgaagcaattattggctgctctggaaatcagcgatgctgtaggacctgtgtttcttggtcaccgggatgagcttgagggaacatacaagatttactgccagaatcatgatgaggccattgcgctgcttgaaatctacgagaaggatgagaagatccagaagcatcttcaggactccttggcagatctgaagagcctatacaacgaatggggatgcacaaattatattaacctgggctccttcctcatcaaaccagtacagagagtaatgcgttacccgctgttgctaatggagttgctgaattccaccccagaatcccacccagataaagtgcctttaaccaatgcagtccttgcggtcaaggaaatcaacgttaacattaatgaatataaacggcgaaaggacctggtcctcaagtaccgtaagggtgatgaagatagccttatggagaaaatttccaaactgaacatccactccatcatcaagaaatccaaccgagttagcagtcacctgaagcatctcactggctttgctcctcagataaaagatgaagtatttgaagaaacagaaaaaaacttccgaatgcaagaaagattgattaagtcttttatccgagacctgtctctctacctccaacacatccgggagtccgcatgtgtgaaagtggtggctgctgtgagcatgtgggatgtgtgcatggagagaggacaccgggacctggagcagtttgagagggtgcatcgctacatcagtgaccagctcttcacaaactttaaggagaggacagagcggcttgtcatctcccccttaaatcagttactgagcatgtttacagggccccataagctggtacagaaacgctttgacaagctcctggacttctataactgtacagaacgggcagaaaagctaaaggacaagaagaccctggaggagctgcagtcggcccggaacaactatgaggccctgaatgcacagctgctggatgagctgcccaagttccaccagtacgcccagggcctcttcaccaactgtgtccacggctatgctgaagcccactgtgactttgtgcaccaggctctggagcaattaaagccactgctttcgttactcaaagtggctggcagagagggaaaccttattgccatcttccacgaagagcacagcagagttctgcagcaactccaggtttttaccttcttcccggagtctcttccagctaccaagaagccatttgagaggaaaaccattgaccgccagtctgctcgaaagccactcctgggcctgccaagttacatgctacagtcagaagaactccgggcctccctcctggccaggtatccccctgaaaaactcttccaggcagaacggaacttcaatgctgctcaagacttggatgtctcacttttggaaggtgacctggtgggtgtgattaagaaaaaagaccccatgggcagccagaaccgctggctgattgacaatggagtcaccaaaggcttcgtgtacagctctttcctaaagccctacaatcctcgccgcagccactccgatgcctccgtgggtagccactcctccacagagtctgagcacggcagctcctcccccaggttcccacgccagaacagcggcagcaccctgaccttcaaccccagcagcatggctgtatcctttacctcggggtcttgccagaagcagcctcaagatgcatctcctccgccaaaagaatgtgaccaaggaactctcagtgcatccctaaatccgagtaattcagagagtagtccttccagatgcccttcagacccagactccacctcccagccaaggtcaggggactctgcagatgtagctagagatgtaaagcaacccactgccacgccgaggagctaccggaacttcaggcatccagaaatagttggctactccgtaccaggacgaaatgggcaaagtcaagacctcgtcaaaggatgtgcaagaacagcccaggctccggaagacagaagtacagagccagatggcagtgaggcagaaggcaaccaggtctattttgctgtctacaccttcaaggcacgaaacccaaatgagctgagcgtgtcagccaatcagaaactcaagatcctcgagtttaaagatgttacaggaaatacagagtggtggttagctgaggttaacgggaagaagggctacgttccctccaattatatccgcaaaaccgagtacacctgagcccacgttgcctgccacccagccttgctgcctttgctttcagtccgccgagggttctggcggcccaccgagagggcgcctgctcctgagacacaggccctgtctgcgttgcttaaccatggcatggtggagcacaccacagatcttgttctcctcgattgggttgtaaaccttgatgctcactagaatctctagaatttgaaatggaccctggggctttgcaaatgacttagtgactatgagaagagagacaagtcttagagctggcttttggaaaggagaaacttgcagtcagaagcccagtgtcctatgtatgcaggaagctgtgctctagcaatagacagtgttggtaatggttgtgctgtacggcgtttggggtggccccatgttccatgctcagctgaccggatgccaactcagatgaaaagaattcatggctctgggcaccccgtgaggcagtgcttgcacatggctgggagtttgtcgggattgaaccaaacctagtgcttcaaagctcctgggacacctccagtgtccagcacacattctcatacatactgcccctaatttctaaagtccctaaagcactacattctgtaaccttgtttcttttactccattcccagattagttatgcaaaattcaactgcgttctacttttagaagtgtttagggtctttattttctgttgacccttcatctgaaagattctcttcccttgttaggtacaatcactgcccccccgcttttttttttgagatggggtcttgctatgttgcccaggctggtcttaaacgcctgggctcaagcaaccctcccgcctccctgctgagattacaggtgtaagccaccataccgcaacctcaatgacacctttctgatggtctttacacagtctgtgatgtctggtggcccccctgccctggactcaataattgatagattttcctagagtaacagtatgagagctccagccattccattaaaagtattagttctgctttgagctgaaaccagttgagcctaatggaagactggatgtctttcttcttcatccaagcaccctaatgactgtttagttacatccatagatgcagacaacataacacctgtgacttacttgaattgggataagccattccagaagtagcttatcctagacttggaaataagatttttttcaccactaacttccatgcttcagagatgacattcaaagccagattcccaagtgcctgatcatacctcccagtctcaggaagatatttgcttaccccttagaccaagaatcttaagatcttccccagctatgaagcctatcttggaatgggaaaccatgaaatttgtcttttaaaagaaagggaagaaatagccttacagcccctgttccctccaagtgcacatttagccttaaaatcctgggagtcgggagacaccgtggagtccttacatccacagtgtctgctggtcgtggtcagaaggcagtaatgcaagagtccttttgtgaagagtgtttctatgtagagatgtttatatttaagtagttcttttataaataaaagcatttctaatggcc

SEQ ID NO: 21966 - DNA, 4678 bp, Homo sapiens
cgagctcggtaccccaacgatggtcctccgctgtgctgagggagtcaggggagcttggcagggcccggcacagagccagataaaattttacgccacttttcaatcatggactttaactctgagaaggatattgtccgaggttcctcaaagttaatcaccgagcaggagctgccggaaaggagaaaggccctaaggccaccgccacctcgtccctgtactccggtatccacttctccccatttgctggttgaccagaacctaaaacctgcaccacccttggtggtgcgaccctctcgcccagctcccctgcctccctcagcacagcagagaacgaatgcggtatcccccaagctcctatctcgacaccgtcctacctgtgagaccttagaaaaggagggccctggtcatatgggaaggagtctggaccagacctccccatgccccttagtgctggtgaggattgaggaaatggagcgggacttggatatgtacagtagagctcaagaagagctaaacctcatgctggaggagaagcaggatgaatcatcaagagcagagaccctcgaggatctcaagttctgtgaaagtaacattgaaagtttgaatatggaactccagcaactaagagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtaccaaacattgattttgagggactttttggaaatatgcagatggtgattaaggtctcgaagcaattattggctgctctggaaatcagcgatgctgtaggacctgtgtttcttggtcaccgggatgagcttgagggaacatacaagatttactgccagaatcatgatgaggccattgcgctgcttgaaatctacgagaaggatgagaagatccagaagcatcttcaggactccttggcagatctgaagagcctatacaacgaatggggatgcacaaattatattaacctgggctccttcctcatcaaaccagtacagagagtaatgcgttacccgctgttgctaatggagttgctgaattccaccccagaatcccacccagataaagtgcctttaaccaatgcagtccttgcggtcaaggaaatcaacgttaacattaatgaatataaacggcgaaaggacctggtcctcaagtaccgtaagggtgatgaagatagccttatggagaaaatttccaaactgaacatccactccatcatcaagaaatccaaccgagttagcagtcacctgaagcatctcactggctttgctcctcagataaaagatgaagtatttgaagaaacagaaaaaaacttccgaatgcaagaaagattgattaagtcttttatccgagacctgtctctctacctccaacacatccgggagtccgcatgtgtgaaagtggtggctgctgtgagcatgtgggatgtgtgcatggagagaggacaccgggacctggagcagtttgagagggtgcatcgctacatcagtgaccagctcttcacaaactttaaggagaggacagagcggcttgtcatctcccccttaaatcagttactgagcatgtttacagggccccataagctggtacagaaacgctttgacaagctcctggacttctataactgtacagaacgggcagaaaagctaaaggacaagaagaccctggaggagctgcagtcggcccggaacaactatgaggccctgaatgcacagctgctggatgagctgcccaagttccaccagtacgcccagggcctcttcaccaactgtgtccacggctatgctgaagcccactgtgactttgtgcaccaggctctggagcaattaaagccactgctttcgttactcaaagtggctggcagagagggaaaccttattgccatcttccacgaagagcacagcagagttctgcagcaactccaggtttttaccttcttcccggagtctcttccagctaccaagaagccatttgagaggaaaaccattgaccgccagtctgctcgaaagccactcctgggcctgccaagttacatgctacagtcagaagaactccgggcctccctcctggccaggtatccccctgaaaaactcttccaggcagaacggaacttcaatgctgctcaagacttggatgtctcacttttggaaggtgacctggtgggtgtgattaagaaaaaagaccccatgggcagccagaaccgctggctgattgacaatggagtcaccaaaggcttcgtgtacagctctttcctaaagccctacaatcctcgccgcagccactccgatgcctccgtgggtagccactcctccacagagtctgagcacggcagctcctcccccaggttcccacgccagaacagcggcagcaccctgaccttcaaccccagcagcatggctgtatcctttacctcggggtcttgccagaagcagcctcaagatgcatctcctccgccaaaagaatgtgaccaaggaactctcagtgcatccctaaatccgagtaattcagagagtagtccttccagatgcccttcagacccagactccacctcccagccaaggtcaggggactctgcagatgtagctagagatgtaaagcaacccactgccacgccgaggagctaccggaacttcaggcatccagaaatagttggctactccgtaccaggacgaaatgggcaaagtcaagacctcgtcaaaggatgtgcaagaacagcccaggctccggaagacagaagtacagagccagatggcagtgaggcagaaggcaaccaggtctattttgctgtctacaccttcaaggcacgaaacccaaatgagctgagcgtgtcagccaatcagaaactcaagatcctcgagtttaaagatgttacaggaaatacagagtggtggttagctgaggttaacgggaagaagggctacgttccctccaattatatccgcaaaaccgagtacacctgagcccacgttgcctgccacccagccttgctgcctttgctttcagtccgccgagggttctggcggcccaccgagagggcgcctgctcctgagacacaggccctgtctgcgttgcttaaccatggcatggtggagcacaccacagatcttgttctcctcgattgggttgtaaaccttgatgctcactagaatctctagaatttgaaatggaccctggggctttgcaaatgacttagtgactatgagaagagagacaagtcttagagctggcttttggaaaggagaaacttgcagtcagaagcccagtgtcctatgtatgcaggaagctgtgctctagcaatagacagtgttggtaatggttgtgctgtacggcgtttggggtggccccatgttccatgctcagctgaccggatgccaactcagatgaaaagaattcatggctctgggcaccccgtgaggcagtgcttgcacatggctgggagtttgtcgggattgaaccaaacctagtgcttcaaagctcctgggacacctccagtgtccagcacacattctcatacatactgcccctaatttctaaagtccctaaagcactacattctgtaaccttgtttcttttactccattcccagattagttatgcaaaattcaactgcgttctacttttagaagtgtttagggtctttattttctgttgacccttcatctgaaagattctcttcccttgttaggtacaatcactgcccccccgcttttttttttgagatggggtcttgctatgttgcccaggctggtcttaaacgcctgggctcaagcaaccctcccgcctccctgctgagattacaggtgtaagccaccataccgcaacctcaatgacacctttctgatggtctttacacagtctgtgatgtctggtggcccccctgccctggactcaataattgatagattttcctagagtaacagtatgagagctccagccattccattaaaagtattagttctgctttgagctgaaaccagttgagcctaatggaagactggatgtctttcttcttcatccaagcaccctaatgactgtttagttacatccatagatgcagacaacataacacctgtgacttacttgaattgggataagccattccagaagtagcttatcctagacttggaaataagatttttttcaccactaacttccatgcttcagagatgacattcaaagccagattcccaagtgcctgatcatacctcccagtctcaggaagatatttgcttaccccttagaccaagaatcttaagatcttccccagctatgaagcctatcttggaatgggaaaccatgaaatttgtcttttaaaagaaagggaagaaatagccttacagcccctgttccctccaagtgcacatttagccttaaaatcctgggagtcgggagacaccgtggagtccttacatccacagtgtctgctggtcgtggtcagaaggcagtaatgcaagagtccttttgtgaagagtgtttctatgtagagatgtttatatttaagtagttcttttataaataaaagcatttctaatggcc

SEQ ID NO: 21967 - DNA, 5524 bp, Homo sapiens
tggatttcgaggtcggggataaaatccgaattctggcgaccttggaagatggctggctggaaggatccctgaagggcaggacaggcatctttccttaccggtttgtgaaattatgtcctgacacacgggtggaggaaaccatggctctgccccaggaaggcagccttgccaggatcccggaaacttctttggattgtttggagaacaccttaggagtagaggaacaaagacatgaaaccagtgaccatgaggccgaggagcctgactgcattatttctgaagcacccacttctcccctcggtcatctgacttcagagtatgacacagacagaaactcttatcaggacgaggacaccgcaggagggcccccgagaagcccaggcgtggagtgggaaatgcctcttgccacagactctcccacatctgaccctacagaagtagtcaatggtatttcctcccaacctcaggtcccttttcatcccaacttgcagaaaagccagtattattctacagtgggagggagccacccgcactcagaacagtaccccgaccttcttcccctagaagcaaggactagagactatgccagcctacctcccaaaagaatgtattcccagctaaaaactcttcagaagccagtgctccctctttacaggggctcttctgtttcagcttcaagggtagtcaaacccagacaatcaagtcctcagctccacaacctagcaagttatactaaaaagcaccacacgtccagtgtttactccatctcagagagattggagatgaagcctggtccgcaagcccaagggcttgttatggaagcagcaacacattcacagggagacggcagcactgacctggactcgaagctgacacaacagctgatcgagtttgagaagagcttggcagggcccggcacagagccagataaaattttacgccacttttcaatcatggactttaactctgagaaggatattgtccgaggttcctcaaagttaatcaccgagcaggagctgccggaaaggagaaaggccctaaggccaccgccacctcgtccctgtactccggtatccacttctccccatttgctggttgaccagaacctaaaacctgcaccacccttggtggtgcgaccctctcgcccagctcccctgcctccctcagcacagcagagaacgaatgcggtatcccccaagctcctatctcgacaccgtcctacctgtgagaccttagaaaaggagggccctggtcatatgggaaggagtctggaccagacctccccatgccccttagtgctggtgaggattgaggaaatggagcgggacttggatatgtacagtagagctcaagaagagctaaacctcatgctggaggagaagcaggatgaatcatcaagagcagagaccctcgaggatctcaagttctgtgaaagtaacattgaaagtttgaatatggaactccagcaactaagagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtaccaaacattgattttgagggactttttggaaatatgcagatggtgattaaggtctcgaagcaattattggctgctctggaaatcagcgatgctgtaggacctgtgtttcttggtcaccgggatgagcttgagggaacatacaagatttactgccagaatcatgatgaggccattgcgctgcttgaaatctacgagaaggatgagaagatccagaagcatcttcaggactccttggcagatctgaagagcctatacaacgaatggggatgcacaaattatattaacctgggctccttcctcatcaaaccagtacagagagtaatgcgttacccgctgttgctaatggagttgctgaattccaccccagaatcccacccagataaagtgcctttaaccaatgcagtccttgcggtcaaggaaatcaacgttaacattaatgaatataaacggcgaaaggacctggtcctcaagtaccgtaagggtgatgaagatagccttatggagaaaatttccaaactgaacatccactccatcatcaagaaatccaaccgagttagcagtcacctgaagcatctcactggctttgctcctcagataaaagatgaagtatttgaagaaacagaaaaaaacttccgaatgcaagaaagattgattaagtcttttatccgagacctgtctctctacctccaacacatccgggagtccgcatgtgtgaaagtggtggctgctgtgagcatgtgggatgtgtgcatggagagaggacaccgggacctggagcagtttgagagggtgcatcgctacatcagtgaccagctcttcacaaactttaaggagaggacagagcggcttgtcatctcccccttaaatcagttactgagcatgtttacagggccccataagctggtacagaaacgctttgacaagctcctggacttctataactgtacagaacgggcagaaaagctaaaggacaagaagaccctggaggagctgcagtcggcccggaacaactatgaggccctgaatgcacagctgctggatgagctgcccaagttccaccagtacgcccagggcctcttcaccaactgtgtccacggctatgctgaagcccactgtgactttgtgcaccaggctctggagcaattaaagccactgctttcgttactcaaagtggctggcagagagggaaaccttattgccatcttccacgaagagcacagcagagttctgcagcaactccaggtttttaccttcttcccggagtctcttccagctaccaagaagccatttgagaggaaaaccattgaccgccagtctgctcgaaagccactcctgggcctgccaagttacatgctacagtcagaagaactccgggcctccctcctggccaggtatccccctgaaaaactcttccaggcagaacggaacttcaatgctgctcaagacttggatgtctcacttttggaaggtgacctggtgggtgtgattaagaaaaaagaccccatgggcagccagaaccgctggctgattgacaatggagtcaccaaaggcttcgtgtacagctctttcctaaagccctacaatcctcgccgcagccactccgatgcctccgtgggtagccactcctccacagagtctgagcacggcagctcctcccccaggttcccacgccagaacagcggcagcaccctgaccttcaaccccagcagcatggctgtatcctttacctcggggtcttgccagaagcagcctcaagatgcatctcctccgccaaaagaatgtgaccaaggaactctcagtgcatccctaaatccgagtaattcagagagtagtccttccagatgcccttcagacccagactccacctcccagccaaggtcaggggactctgcagatgtagctagagatgtaaagcaacccactgccacgccgaggagctaccggaacttcaggcatccagaaatagttggctactccgtaccaggacgaaatgggcaaagtcaagacctcgtcaaaggatgtgcaagaacagcccaggctccggaagacagaagtacagagccagatggcagtgaggcagaaggcaaccaggtctattttgctgtctacaccttcaaggcacgaaacccaaatgagctgagcgtgtcagccaatcagaaactcaagatcctcgagtttaaagatgttacaggaaatacagagtggtggttagctgaggttaacgggaagaagggctacgttccctccaattatatccgcaaaaccgagtacacctgagcccacgttgcctgccacccagccttgctgcctttgctttcagtccgccgagggttctggcggcccaccgagagggcgcctgctcctgagacacaggccctgtctgcgttgcttaaccatggcatggtggagcacaccacagatcttgttctcctcgattgggttgtaaaccttgatgctcactagaatctctagaatttgaaatggaccctggggctttgcaaatgacttagtgactatgagaagagagacaagtcttagagctggcttttggaaaggagaaacttgcagtcagaagcccagtgtcctatgtatgcaggaagctgtgctctagcaatagacagtgttggtaatggttgtgctgtacggcgtttggggtggccccatgttccatgctcagctgaccggatgccaactcagatgaaaagaattcatggctctgggcaccccgtgaggcagtgcttgcacatggctgggagtttgtcgggattgaaccaaacctagtgcttcaaagctcctgggacacctccagtgtccagcacacattctcatacatactgcccctaatttctaaagtccctaaagcactacattctgtaaccttgtttcttttactccattcccagattagttatgcaaaattcaactgcgttctacttttagaagtgtttagggtctttattttctgttgacccttcatctgaaagattctcttcccttgttaggtacaatcactgcccccccgcttttttttttgagatggggtcttgctatgttgcccaggctggtcttaaacgcctgggctcaagcaaccctcccgcctccctgctgagattacaggtgtaagccaccataccgcaacctcaatgacacctttctgatggtctttacacagtctgtgatgtctggtggcccccctgccctggactcaataattgatagattttcctagagtaacagtatgagagctccagccattccattaaaagtattagttctgctttgagctgaaaccagttgagcctaatggaagactggatgtctttcttcttcatccaagcaccctaatgactgtttagttacatccatagatgcagacaacataacacctgtgacttacttgaattgggataagccattccagaagtagcttatcctagacttggaaataagatttttttcaccactaacttccatgcttcagagatgacattcaaagccagattcccaagtgcctgatcatacctcccagtctcaggaagatatttgcttaccccttagaccaagaatcttaagatcttccccagctatgaagcctatcttggaatgggaaaccatgaaatttgtcttttaaaagaaagggaagaaatagccttacagcccctgttccctccaagtgcacatttagccttaaaatcctgggagtcggcaccccccgccgagtccgtgcatgtacagtgggttggggtcgagttgaaaagacacagatgcaagagttcccctttcagtagtgctcccatgtactccaggaccctcccccgttgttaaaaattaattgctggcaagtgtgaaaa

SEQ ID NO: 21968 - DNA, 4629 bp, Homo sapiens
tggatttcgaggtcggggataaaatccgaattctggcgaccttggaagatggctggctggaaggatccctgaagggcaggacaggcatctttccttaccggtttgtgaaattatgtcctgacacacgggtggaggaaaccatggctctgccccaggaaggcagccttgccaggatcccggaaacttctttggattgtttggagaacaccttaggagtagaggaacaaagacatgaaaccagtgaccatgaggccgaggagcctgactgcattatttctgaagcacccacttctcccctcggtcatctgacttcagagtatgacacagacagaaactcttatcaggacgaggacaccgcaggagggcccccgagaagcccaggcgtggagtgggaaatgcctcttgccacagactctcccacatctgaccctacagaagtagtcaatggtatttcctcccaacctcaggtcccttttcatcccaacttgcagaaaagccagtattattctacagtgggagggagccacccgcactcagaacagtaccccgaccttcttcccctagaagcaaggactagagactatgccagcctacctcccaaaagaatgtattcccagctaaaaactcttcagaagccagtgctccctctttacaggggctcttctgtttcagcttcaagggtagtcaaacccagacaatcaagtcctcagctccacaacctagcaagttatactaaaaagcaccacacgtccagtgtttactccatctcagagagattggagatgaagcctggtccgcaagcccaagggcttgttatggaagcagcaacacattcacagggagacggcagcactgacctggactcgaagctgacacaacagctgatcgagtttgagaagagcttggcagggcccggcacagagccagataaaattttacgccacttttcaatcatggactttaactctgagaaggatattgtccgaggttcctcaaagttaatcaccgagcaggagctgccggaaaggagaaaggccctaaggccaccgccacctcgtccctgtactccggtatccacttctccccatttgctggttgaccagaacctaaaacctgcaccacccttggtggtgcgaccctctcgcccagctcccctgcctccctcagcacagcagagaacgaatgcggtatcccccaagctcctatctcgacaccgtcctacctgtgagaccttagaaaaggagggccctggtcatatgggaaggagtctggaccagacctccccatgccccttagtgctggtgaggattgaggaaatggagcgggacttggatatgtacagtagagctcaagaagagctaaacctcatgctggaggagaagcaggatgaatcatcaagagcagagaccctcgaggatctcaagttctgtgaaagtaacattgaaagtttgaatatggaactccagcaactaagagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtaccaaacattgattttgagggactttttggaaatatgcagatggtgattaaggtctcgaagcaattattggctgctctggaaatcagcgatgctgtaggacctgtgtttcttggtcaccgggatgagcttgagggaacatacaagatttactgccagaatcatgatgaggccattgcgctgcttgaaatctacgagaaggatgagaagatccagaagcatcttcaggactccttggcagatctgaagagcctatacaacgaatggggatgcacaaattatattaacctgggctccttcctcatcaaaccagtacagagagtaatgcgttacccgctgttgctaatggagttgctgaattccaccccagaatcccacccagataaagtgcctttaaccaatgcagtccttgcggtcaaggaaatcaacgttaacattaatgaatataaacggcgaaaggacctggtcctcaagtaccgtaagggtgatgaagatagccttatggagaaaatttccaaactgaacatccactccatcatcaagaaatccaaccgagttagcagtcacctgaagcatctcactggctttgctcctcagataaaagatgaagtatttgaagaaacagaaaaaaacttccgaatgcaagaaagattgattaagtcttttatccgagacctgtctctctacctccaacacatccgggagtccgcatgtgtgaaagtggtggctgctgtgagcatgtgggatgtgtgcatggagagaggacaccgggacctggagcagtttgagagggtgcatcgctacatcagtgaccagctcttcacaaactttaaggagaggacagagcggcttgtcatctcccccttaaatcagttactgagcatgtttacagggccccataagctggtacagaaacgctttgacaagctcctggacttctataactgtacagaacgggcagaaaagctaaaggacaagaagaccctggaggagctgcagtcggcccggaacaactatgaggccctgaatgcacagctgctggatgagctgcccaagttccaccagtacgcccagggcctcttcaccaactgtgtccacggctatgctgaagcccactgtgactttgtgcaccaggctctggagcaattaaagccactgctttcgttactcaaagtggctggcagagagggaaaccttattgccatcttccacgaagagcacagcagagttctgcagcaactccaggtttttaccttcttcccggagtctcttccagctaccaagaagccatttgagaggaaaaccattgaccgccagtctgctcgaaagccactcctgggcctgccaagttacatgctacagtcagaagaactccgggcctccctcctggccaggtatccccctgaaaaactcttccaggcagaacggaacttcaatgctgctcaagacttggatgtctcacttttggaaggtgacctggtgggtgtgattaagaaaaaagaccccatgggcagccagaaccgctggctgattgacaatggagtcaccaaaggcttcgtgtacagctctttcctaaagccctacaatcctcgccgcagccactccgatgcctccgtgggtagccactcctccacagagtctgagcacggcagctcctcccccaggttcccacgccagaacagcggcagcaccctgaccttcaaccccagcagcatggctgtatcctttacctcggggtcttgccagaagcagcctcaagatgcatctcctccgccaaaagaatgtgaccaaggaactctcagtgcatccctaaatccgagtaattcagagagtagtccttccagatgcccttcagacccagactccacctcccagccaaggtcaggggactctgcagatgtagctagagatgtaaagcaacccactgccacgccgaggagctaccggaacttcaggcatccagaaatagttggctactccgtaccaggacgaaatgggcaaagtcaagacctcgtcaaaggatgtgcaagaacagcccaggctccggaagacagaagtacagagccagatggcagtgaggcagaaggcaaccaggtctattttgctgtctacaccttcaaggcacgaaacccaaatgagctgagcgtgtcagccaatcagaaactcaagatcctcgagtttaaagatgttacaggaaatacagagtggtggttagctgaggttaacgggaagaagggctacgttccctccaattatatccgcaaaaccgagtacacctgagcccacgttgcctgccacccagccttgctgcctttgctttcagtccgccgagggttctggcggcccaccgagagggcgcctgctcctgagacacaggccctgtctgcgttgcttaaccatggcatggtggagcacaccacagatcttgttctcctcgattgggttgtaaaccttgatgctcactagaatctctagaatttgaaatggaccctggggctttgcaaatgacttagtgactatgagaagagagacaagtcttagagctggcttttggaaaggagaaacttgcagtcagaagcccagtgtcctatgtatgcaggaagctgtgctctagcaatagacagtgttggtaatggttgtgctgtacggcgtttggggtggccccatgttccatgctcagctgaccggatgccaactcagatgaaaagaattcatggctctgggcaccccgtgaggcagtgcttgcacatggctgggagtttgtcgggattgaaccaaacctagtgcttcaaagctcctgggacacctccagtgtccagcacacattctcatacatactgcccctaatttctaaagtccctaaagcactacattctgtaaccttgtttcttttactccattcccagattagttatgcaaaattcaactgggaatggagtaaaaaaaaccggcgcggccg

SEQ ID NO: 21969 - DNA, 1832 bp, Homo sapiens
tggatttcgaggtcggggataaaatccgaattctggcgaccttggaagatggctggctggaaggatccctgaagggcaggacaggcatctttccttaccggtttgtgaaattatgtcctgacacacgggtggaggaaaccatggctctgccccaggaaggcagccttgccaggatcccggaaacttctttggattgtttggagaacaccttaggagtagaggaacaaagacatgaaaccagtgaccatgaggccgaggagcctgactgcattatttctgaagcacccacttctcccctcggtcatctgacttcagagtatgacacagacagaaactcttatcaggacgaggacaccgcaggagggcccccgagaagcccaggcgtggagtgggaaatgcctcttgccacagactctcccacatctgaccctacagaagtagtcaatggtatttcctcccaacctcaggtcccttttcatcccaacttgcagaaaagccagtattattctacagtgggagggagccacccgcactcagaacagtaccccgaccttcttcccctagaagcaaggactagagactatgccagcctacctcccaaaagaatgtattcccagctaaaaactcttcagaagccagtgctccctctttacaggggctcttctgtttcagcttcaagggtagtcaaacccagacaatcaagtcctcagctccacaacctagcaagttatactaaaaagcaccacacgtccagtgtttactccatctcagagagattggagatgaagcctggtccgcaagcccaagggcttgttatggaagcagcaacacattcacagggagacggcagcactgacctggactcgaagctgacacaacagctgatcgagtttgagaagagcttggcagggcccggcacagagccagataaaattttacgccacttttcaatcatggactttaactctgagaaggatattgtccgaggttcctcaaagttaatcaccgagcaggagctgccggaaaggagaaaggccctaaggccaccgccacctcgtccctgtactccggtatccacttctccccatttgctggttgaccagaacctaaaacctgcaccacccttggtggtgcgaccctctcgcccagctcccctgcctccctcagcacagcagagaacgaatgcggtatcccccaagctcctatctcgacaccgtcctacctgtgagaccttagaaaaggagggccctggtcatatgggaaggagtctggaccagacctccccatgccccttagtgctggtgaggattgaggaaatggagcgggacttggatatgtacagtagagctcaagaagagctaaacctcatgctggaggagaagcaggatgaatcatcaagagcagagaccctcgaggatctcaagttctgtgaaagtaacattgaaagtttgaatatggaactccagcaactaagagaaatgacgctcctctcctcccagtcttcatcactggtggccccttctgggtctgtgtctgccgaaaatccagagcagaggatgctggagaagagagccaaggtcatagaagaacttcttcagacagaaagagactacattcgggatctggaaatgtgtattgagcggatcatggtacccatgcagcaggcacaggtgggaactgggagacagagttagtttgaccttgaatatggtcctccaggccagaagcattaggatataggagctttcgccacagatttattggatttgaaatagaaactgtgactgtgagtgctgctgctcttaatcaagggcctcaacatacgtgtgtca

SEQ ID NO: 21970 - DNA, 779 bp, Homo sapiens
catgggcacagtgaacataatgaactattcattcaagaaacttgactgtgaaaggaaggagggagagaaggtacagtagttagagaggagcaggggatcatggcaaagttttttgattctgtttaagagttgtttactgagtccctgcttatgtctctttattatctttctggctacccacgtttgctcccagttagaatcctggactctaaccatgggatggaaggtggtgttggcacaggccactgctctttagcagcctaaaggattatattctcatcaggtagaaactttgtggtcactgaagtccttacatgccccatgaagacttgtgtgtggatttgctgcctgcactgagctaacacgttcctgtcctgaaggcttcttccacagtgagctcatcacagcaccctgtggaatggtgcttctcagatgaggctgcacataagaatcacttagtgagctttcaagaaaaatgttccttcatgatggttctttctaggagtggggtgcaggagtctgggcttttgtcaagctcctcaggagatttgtttttttggacagcaggtttgaaaacgctagtcaattgcatgtctttattgtctgtgcttttctgtcagtgaaggttggttgtctttttgaatcatgctagatctttttccatttttgttacctaagatcacacctcctctaagatgaacataagtcattatatagttgtctgttttgtatataaaatatgtgcttaataaaacaaacaatggaaacaaaaaaaaaaa

SEQ ID NO: 21971 - DNA, 726 bp, Homo sapiens
gggagaaggaaatgtcaaggaagaagaaattgtgacttaaaattcaatttgggttctatattactgtgccatcaaaaatacttaagatgatccttttaggtgttcacaaatgtttgactggattcaatagcagtggtaattctttgaagaaatacttaattgaggccaggcacagtggctcctgcctgtaatcccagtacttcgggaagctgagacaggaggattacttgagaccaggagctcatgaccagcctgggcaacataggaagacctccgtctctacaaaaaaattaaaaaattagccaggcatggtgatacatgcttgtagtcccccagctacttgggaagcttaggcgggaggattgtttgagcccaggagtttaaggctgcattgagctgtgatcatgccactgcactccagcctgggtaacagagtgagactctcaaaagaaatacttggcgggggtggtggctctgtaatcctagcactttgggaggccgaggcgggcggatcacgaggtcaggagatcgagaccatcttggctaacatggtgaaaacctgtctctactaaaaattcagaaacaaaattagccaggtgtggtggcaggcgccggtagtcccagctatgccggaggctgaggcaggagaatggcgtgaacccgggaggcggagcttgctgggagccaagatcgtgccactgcactccatcctgggcaacagagtga

SEQ ID NO: 21972 - DNA, 486 bp, Homo sapiens
aggcgtgggttgtttcctaagtgtgggtgcaaagtaatgggcgctaggcgctggcgtcggtattcagcccagctgcacatctgaggcttggcagcttctcatagcgccttatcctctgccatacagcatccatctggagccctgtcttttaggatgagtggctttagggtcgggcattaaaccttaagcttcagtcgccatctgtgatgtaagtgggaggagagggtattggaaagagctctttctgggtcaaatagagttgggcttttcttgcaattgattttgagccagatgccacatatcttgaaaaagaaaaacggctgactttagtttgaagcgtaaataatagatattcgcacatgtcctttttagtagcagcccaaaaattgaatttcaacttaaaaaaaaatctgcgtcataataatagggatgttacttgctcttgctcatgcaccttttgcttagacctgctgtttctacgtcaga

SEQ ID NO: 21973 - DNA, 229 bp, Homo sapiens
tgagccaagattgtgccactgcattacagcctgggcagcagagcaagactctgtctcaaaaaaaaaaagctaagtcagatcatgatcatttctcctctactcaaaaccttccagggactccccatactcagaataaaagccaaagtcctaacaatggccaacaaaatcactacttcacctgtgccccctttacttctccgacttcacctcctactgttctctctctcaa

SEQ ID NO: 21974 - DNA, 431 bp, Homo sapiens
gaggtatttcctgagaatgaatttttttttttttggattactgtttttctctccatataccttgacttggattttgacaggagggagcctgggaaaataattttttcctccaagattctcagatccaggttaggaaaggattcagcactacagcatacccctctacaacatacagccctgtcacattgagatcataatccctcctgtcccactcctctctaccaaccccaccctactagctaggtcttcagtgttttacattgaatattggtacattttaattattttttctcataaatgggttatttatagaaattttgttaactcttgagccatatgcatgtgtagatactggcagggctatgtttgtttatgatgctctgcaaacatttcatattggccaataaacagaaatatatccaaaaaacttg

SEQ ID NO: 21975 - DNA, 341 bp, Homo sapiens
aaatgtaaagatgtaaagtatagagaaaggatgtaaaactgcccgacatatagtaagggccatttaaaagatgcctgttattgtccctcttcttgagagcatattaagggctcaaatctagccagagtctggcgggtacagaggtaaacaaataatggcaggttggttaagtactggacaccagtgatgtccaaggtctctaggatgccctggagaaataatgaactcttctaagattgtttggaagggatttataaaggacatctaggctgggttttgagtgaggtatgggagttcgctggtcaagaatgtaggaattacaaaagcagaaagtgcatatt

SEQ ID NO: 21976 - DNA, 589 bp, Homo sapiens
ctacagtcatttcttcatggaattagacacatagcagtggggaccaggagtgttttattagtgattgtcctcctgcaagtttccagggtatctcagcttagacacatgaattattttttcctgttgcttggagggtatacttttaattatattcattcaataacagagcagttcaggtttgtaaaatattttttctcccccaaccttttccccagcatacatccccgtcccgtaagtttctgggcagagacaatctcaggaacctaaaggttgctaaaaaattagctagttggccaggcgcatgactcatgccagtaatcccagcactttgggaggctgaggtgggtggatcgcttgagcccagaaattcgagaccagcctagacaacatggcaaaaccctgtctctacaaacaaaacaaaatctagctgggcatggtggtgcatgcctgtagtcccagctactggggaggctgaggtgggcgggcgattgagctcaggaggtccaggctgcagtgagccgtgattgtgccactgcactgcagcctggatgactgagtgggaccctgtctcaataataaataaataaat

SEQ ID NO: 21977 - DNA, 841 bp, Homo sapiens
cacccaccacttacccttctcgctggtgaagtggccaactgccatctgattctgcaggtgggacaccctattggatgaagtgtttctggagtggcccctgcacccagcagtgcctttgttggggatggagagtcagaatgcctgccatcggggacttgagattaatttggtggtggtcctagacggatgtgagggatttggagagagaccaggtgtggaggggctttggggcagagccgggggtggcctgacttggcttaatgggcaggaagagggggcatggagctctcagaccaggggaatgggcagccttccctgatgttgccagaaactgcttccatgtcctctcatctggtttaggggcccctaaacaaggggatctggaaggtcgggaaaagcccactgtctttcagaccctgggcttcagcacatccctcaggccagggccagggccagggggggtcgcagggtgggatgacaggttgtgatccaggcaggtgaggacctgtccccaccgtaagcagccaacccctggaaaagcccaggtggctgagttctgcctgtgttcaaaagatgtctctttgtaggggatgtgtgcgtgggaggctggaatttgctttggaaattaattgcctgttgaattcttcccaccacggccgtaaccgtgcaggatccagggcatgtgaggagggctgtgaatgggcttcctctggcccatttcatcagttattgccctatcatcgctcctctggcttcatttacccagcaggacattgcttttacaggctcatctgggcacttttaaaaaataaagtcagtgcattccaggaacccctcttcc

SEQ ID NO: 21978 - DNA, 378 bp, Homo sapiens
gtgtagggcagcagcaggaaacatggagatggattcatcacgtatcagtcacagaaacaatccccggagctcagcaagaagctgggccttttgcaaagaggccagccagttctagattgggcttctgaaggaactcacttctgactttagttctctgtatctttctgacctttgtatcttctttaaatcttcattttcatcatttcctccactatttatgaatgctccctctgggatctattctcaatcccttcctaataaggaaatgtccttccttaattgtctcaactatcttggtgcagatagtcattcccttcttgacatgtcctggccctactcaagaggctcatgtgtggtcatgtgggagcatatttcctt

SEQ ID NO: 21979 - DNA, 135 bp, Homo sapiens
atctcccatctgagatgggagagcccgtctcagaggcggaaaggctgacccaggaagtgcctgaacaagtgagcctctgtcggtgaccccaacggaggcagcccgagtttcagcaccactgggaggacagctccc

SEQ ID NO: 21980 - DNA, 395 bp, Homo sapiens
tttcttgaataccctctagatcaggtttttaaaagaagttgctcaactacatcaattctaagacttctttctggttcgcagattctgcggcttattggttgatatgattctgttcccagcccatgctttcagagcatttcatgagtcccaggccgctgagggaatatatgcaaacccgagactagtatctgctcctaaagaaagctgtgaattctcttgccacagatcgccatcattgtaagatgatatggaacttagaataggcacttacttaaagctgttagtttatttcttcttacgatgtgctgtctttgtgttgtagctcacacaatggtcacttgagctgttaactctattctggttttctggctgatctggaagatcctgcacccatg

SEQ ID NO: 21981 - DNA, 514 bp, Homo sapiens
ggtgattccagtgacacagacacacgtttggactgtcttgtactatgctatgcactgttctgctcttttttgaattggaacatgagaattgaggtccatgtaattttgagtttcagtagttttttgctcacattagtctcatttttgtttttcctcttgtagctgccatttatcaaatcgaaattatttcctcagagaaaaaggtttaggtatcctaagactttaaaatctcagtacgtttttttttaaagtatgttgtctcattctattgagaagttatacaacatacaggcttctaggtctagccaggccatctagtttagtcaagacagctgtgtaacaaacgtagccttgaggcctggcacggtggctcatgcctgtaatcccagctacttgggaggctgaggcgagagaatcacttgaactggggaggcagaggttgcagtggcccgagaccccaccattgcactccagtccgggaaacaagaacgaaactcccatctcaaaaaaaaaa

SEQ ID NO: 21982 - DNA, 650 bp, Homo sapiens
ggtgattccagtgacacagacacacgtttggactgtcttgtactatgctatgcactgttctgctcttttttgaattggaacatgagaattgaggtccatgtaattttgagtttcagtagttttttgctcacattagtctcatttttgtttttcctcttgtagctgccatttatcaaatcgaaattatttcctcagagaaaaaggtttaggtatcctaagactttaaaatctcagtacgtttttttttaaagtatgttgtctcattctattgagaagttatacaacatacaggcttctaggtctagccaggccatctagtttagtcaagacagctgtgtaacaaacgtagccttgaggcctggcacggtggctcatgcctgtaatcccagcacttttgaggctgaggcgggcggattacctgaagtcaggagttagagaccagcctgtccaacgtggtgaaaccccgtctgtactaaaaatacaaaaaagctagccgagtgtggtggcaggtgcctgtaatcccagctacttgggaggctgaggcgagagaatcacttgaactggggaggcagaggttgcagtggcccgagaccccaccattgcactccagtccgggaaacaagaacgaaactcccatctcaaaaaaaaaa

SEQ ID NO: 21983 - DNA, 319 bp, Homo sapiens
tgaggaaaagtgaacaaagctcaaggaaattgtgagatatcaataagtgaactgatatacacatttaggaatttacagaaagagagagaagaagaaagattattcaaacaaataatggccaaaaatttcccaagtttgataaaatgcataaatttacaaatccaatctaagaagtacaatgagctacaagtaggatacacctaaagagacccacatcaagacacattgtaagcatactgtcaaaaacaaaaaacgaagaaactcaaaagcagttaggttaactggggtgactacaacagtatcagacaaaatatacgtt

SEQ ID NO: 21984 - DNA, 490 bp, Homo sapiens
atggtgatgtggttttttttgtctgtttgttttgagacagggtctcgatttgctgctcaggctagagtgcagtggcatgatcatacctcactgtagccttgaactcttggattcaagagatgcttccacctcagcttcccaagtagctaggcctacagtcatgtacataccaccaggcttggctaacttttttttttttttttggtagagatggagtatccttatgttgcctaggctggtctagaactcctgaggtcaagtgatcctccagcctcagccttccaatgtgatgggattataggtatgagccactgcaccctgccaggaaagttgttgaaaaagactagcatgttggtgtgtgttggcagctcctcagatccttcagtatgggatataaaggggttgtaattgattggttggaaataatcagtgtgcaaacaacaatggaaatggaagagaatacatcttggtaataaaatctctgtctgtc

SEQ ID NO: 21985 - DNA, 427 bp, Homo sapiens
ctcattaattcagccctatgaaagagggtgcaaaggaagaaggtggaagttactttgccaagagtagcaggcttgggggaaactaaaatagaggcttcaggggaagggcagcagcatggtgtcagagattacacttggagtttgtgaagtctgggcaggcttcaatctaaagaaactttatgcacaaaagcccaaatccagggaaataaatgaaagtgattattcacttttctaaagtccttacagtagcgttcctctggtattgtttgaatacagtttaacctgaagggcacttggtttttgtgcagctcttcaagaacagaagcatctaagtaagtagaaagtctgagaaattaacagagaagattccctaaaagtcagccttcattacttgaccattattcataattctgcatttgtctattcc

SEQ ID NO: 21986 - DNA, 701 bp, Homo sapiens
aggatcgcttgaagccagaagttcaaggctacagtatgctatgatcatttctgtgaatggccactgcacttcagcctgagtaacgtagcaagacgctgtctccaacagaaaattgacatctgaagccttgactacagggggactatactggtttatgtgaagtgtggggagagagcaggattgtgcttctttgtacacatttgcttctcccaggatagtgtcatagtgcctaggaaggtgatgtgtgtgtcagatacaatgatagtgaaaagaagggattggaattttcatacctgtgtcagtctaaatgagcattaccttgtctgaattgtctaagtggtaagcttcgtgatttgaaacagttttcactttgaaaaactgcttccgtggattaaaagttgtcaccactaaagtgggctgtggtggagtcgatgctgatcctcacttagggcagtggcctccaaggggaagagggcacacaggatggctgggtgggggtgggaagaaaagattaggcctttgatttatattcattttgaggctcagccttatttagtttctcactttggatgtattttatatatatacatcaaatatacatcaatattagttcattagtacatgtaggtcattaatttataaataaaaggttgaaccacaaaaaactgctgataattgtttttgatctgtaaaaaaaaaaa

SEQ ID NO: 21987 - DNA, 657 bp, Homo sapiens
aggatcgcttgaagccagaagttcaaggctacagtatgctatgatcatttctgtgaatggccactgcacttcagcctgagtaacgtagcaagacgctgtctccaacagaaaattgacatctgaagccttgactacagggggactatactggtttatgtgaagtgtggggagagagcaggattgtgcttctttgtacacatttgcttctcccaggatagtgtcatagtgcctaggaaggtgatgtgtgtgtcagatacaatgatagtgaaaagaagggattggaattttcatacctgtgtcagtctaaatgagcattaccttgtctgaattgtctaagtggtaagcttcgtgatttgaaacagttttcactttgaaaaactgcttccgtggattaaaagttgtcaccactaaagtgggctgtggtggagtcgatgctgatcctcacttagggcagtggcctccaaggggaagagggcacacaggatggctgggtgggggtgggaagaaaagattaggcctttgatttatattcattttgaggctcagccttatttagtttctcactttggatgtattttatatatatacatcaaatatacatcaatattagttcattagtacatgtaggtcattaatttataaataaaaggttgaacc

SEQ ID NO: 21988 - DNA, 850 bp, Homo sapiens
ctcatcgcccgcgccgccgccgcgcctcagcttcagcttcggcctcagtcagccgcgcagggacgcggagcccggcgccgagccctgctcttgcgcttgccgggcgggcatggacgggcgagaggcgttctgcaagcgcgaaatcgcgatgaacgggatcgtgcacgatgtggacgtgctgggcgcgggcatccggctggtgaccctgctggtggatcgggacgggctgtacaagatgaaccgcctgtacctcacccccgacggcttcttcttccgagtccacatgttagccctggactcctccagctgcaataagccgtgtccagagtttaaacctggcagcaggtatattgtgatgggccacatctaccataagagacggcagctccctacagctctgctccaggtcctgagaggccgcctccgtccagggatggactgctaaggagcagcagcagctatgtgaaaaggttaatcgaacaaagggaagggcagataccacaggtgcaattcatacccaattgcattttgaaaacaaccatcctggccattttcttggaccgcaggagacttggaccgtcgggcaacaaggacatgaaagggtctacccttcatgtaatgggtgcctccctttccgaagagagccctcagcttacctctgtgaatgaatttgcttagctgcagctgtaatctcgacaggtgtaccttggttattacaagaatgctcttaatgggcatgattctgaactcaggggtcaagagaatcacaccgggatgccagaaatagattcaccagatcagatactgagacggtccaatacacaactgctctaggtcacaatatctatac

SEQ ID NO: 21989 - DNA, 441 bp, Homo sapiens
  misc_feature (22)..(22): n is a, c, g, or t
  misc_feature (25)..(25): n is a, c, g, or t
  misc_feature (68)..(68): n is a, c, g, or t
  misc_feature (408)..(408): n is a, c, g, or t
  misc_feature (429)..(429): n is a, c, g, or t
cggcgctgagcctgcgcgcgcnctngccggtccgatctggacgaacgcgaggcttctgcgagacgaanttcgcgatgaacgggatcgtgcacgatgtggacgtgctgggcgcgggcatccggctggtgaccctgctggtggatcgggacgggctgtacaagatgaaccgcctgtacctcacccccgacggcttcttcttccgagtccacatgttagccctggactcctccagctgcaataagccgtgtccagagtttaaacctggtattgaaactgacctgaatgacgctgcatatgtactttataccaccgtttgtaacgtggggtgccacagcccgggctgttaggttcgcccagcctttttttggggagcgatgggggaacaatgacatgaatggggattttagnacgacaggcaggcaggtatanttgttgatgggg

SEQ ID NO: 21990 - DNA, 514 bp, Homo sapiens
tacattgtattataagtaatctagacattaaagtgtatgggaggatgtatgtaggttacatgcaaatacttgtgtcattttatatcagggactggagcatctggggatcttgatatccaagggggtcctggatccacttcccctaagatatgcgaagtaaccgtactttcctctccaccaccacctcaggtaatcccagcactttgggaggccaaggtgggaggattgcttgagctccggagttcaagaccaatctcggcaacatagcgagaccccatctctataaataaaacaaaagtaaatgcattaaatggaaggttgacagtttatcataaacctacaaagatgtttgtaaaattttgttttagtcattttctttgaactcacatcattataccatcttcatttttgtatggagctggttcaattctaagtcctctagactttccctgcctatctttgttgttgttgttgttgttgtcgaagacagtaaaataagtgtttttcaagtcta

SEQ ID NO: 21991 - DNA, 507 bp, Homo sapiens
cagggcatggtggcatgcacttgtagtcctagctattcaggagtcattcagagtgagaccctgtctcttagaaaaaaattttaaaaagtgaatgagatcatgtcatttctctgttcagagccttccagttgcttcccatctcactcagaggaaaagccaaagtccttaccttgtcctgcaaagtaatcccagcactttgggaggccaaggtgggaggattgcttgagctccggagttcaagaccaatctcggcaacatagcgagaccccatctctataaataaaacaaaagtaaatgcattaaatggaaggttgacagtttatcataaacctacaaagatgtttgtaaaattttgttttagtcattttctttgaactcacatcattataccatcttcatttttgtatggagctggttcaattctaagtcctctagactttccctgcctatctttgttgttgttgttgttgttgtcgaagacagtaaaataagtgtttttcaagtcta

SEQ ID NO: 21992 - DNA, 356 bp, Homo sapiens
ctacccagctgagaattagatcaacccagaagaaaaggaacatgtttcactgaaacctacaaagtgctttagaacatcttcagtcgggcgcagtggctcacgcttttagtctcaacactgtgggaggatcacttgagcccaggagtttgagaccagcctgggcatagtgagaccccgtctctactaaaacattactttaaattaactggacatgatggcatgttcctgtggtcccagctacttgagagaccgaggcaggaggatcgtttgagcccaggagttggaggctgcagtgagctgttattgaaccactgctttccaggctggaagacagagcgaaactctatctcttaaaa

SEQ ID NO: 21993 - DNA, 343 bp, Homo sapiens
gttttaccatgttggccaggctggtcttgaactcctgacctcaggtgatcctcctgcctcggtcttccaaactgctgggattacaggtgctcctggccgacagttacatattttttatagaaagaaagtaaaagtatcttaggaaaatttaaataaattattattcttaacatctgtcatccatccatctgtttgtctatcggtgtgatggatgctcccaccaggtactttgctagtggacaccaaggatagaatgatgaataagacaaatacggcccttccctggtgcatagagtgggaaggtgaacattaagcagttccacagtaattatttaattacagt

SEQ ID NO: 21994 - DNA, 317 bp, Homo sapiens
ggaggcaaaaaggacaatagaaaaatcataattagccaaacataataactgttgtaaacaagatgtaccagggaatgctaaaactatgggcaaaagcttgacaaaaagcatgatatttgcatagtctcaaaatatctcccccaggatacttattagaagtggggaaatagcagctttatagtgaagaaactcaaaagacaccaccttcaccaagtgatgaaggttaacagcaccagtagaaagacatcaacatcctttaccctttgataggacacattgtgaagggaacatcacttctgtgatattcagaagtatgc

SEQ ID NO: 21995 - DNA, 647 bp, Homo sapiens
ctattaggaacttgtcatggtgaaattcaggactggcactggatcatggtcaatagttattctctaaagtataattgacacctgtgtaaacttataattagctttataccacacaaggtgccatatatttagaattgttgaaagattagtgaagagtgagtattttaataaccttaaacttgccagctttttgtcagtacctgggttaaatgggatatctgcagatttgctactcaggtatgattttatttgattcatttaattcagtctgtgattactgaatgcatactgtgttagatactcaaagtccaaaaatataactaaatattctgttccttttgaggtgctttagttatggtttttaaagcttttaaaattctgtacatagtactgtattaggcctacagtttgaaaatgatcattcattaatttattcactaattatttcaagcattctgtgtccttagcaaggtagcagaatatataatacatcaaaaataataatgctattctatattttaataagcaacttcagcaaagtctcaggatacaaaatcagtgtgcaaaaatcacaagcactcttatacaccaacaacagacaaacagagagccaaatcatgagtgaactcccattcacaattgcttca

SEQ ID NO: 21996 - DNA, 495 bp, Homo sapiens
gtcttcttaagctaggcaccgtggctcatgtctgtaatcccaacactttgggagaccaaggcaggtggatcacctgaggtcaggaatttgagaccagcctgaccaatatggtgaaacctcatctctaaaaaaaaaaaaaaagaaagaaagaaattgagggtcttcaagtgaactgcctagtgctctccatcaggtctatacctgcttcttcttggtctggagatttctaaactagaagagacatattcctttcctcctatacagacccaatatttaatgatggagtagggttaggacaactgcaataaatactttcacttttaaatggagagaatgaagacagataggggtaacaattttgaaatattcttaggctctgcacagtggcttatgtctgtaatcccaacaactttgggagactgaggcaggtggatcacctgatgtcaggagtttgagaccagtctgaccaatattatgaaaccccatctctaaaga

SEQ ID NO: 21997 - DNA, 412 bp, Homo sapiens
gatttttttatgctctcttctctcctcgcctgccgagagccattttcctgttctgaaagctgctgctgctgactgcctacccctcaccacaggtcttagatgctgcgtacctccctcttaacattcttgccatgtgtgcaaccacaggtgaatctacaatctgctcagcgcacagctgagagagggtgggaatatttaaacaagcctttactaaaagccagagcagtgaatctcaaactcatatgtctaagaatccatggaaggatattaaccgctttaatatcagataataagttcctaaacccaaagattccgtttcagtgggcctgggatggttttgagtgattctgagcaacatggtccgagaattacattttgagaaacactagcgaagagatttttttaaatgagg

SEQ ID NO: 21998 - DNA, 258 bp, Homo sapiens
atctatattgcccatttatggacattgcatggcatctcctgaattttggcccatgctaaaatgtgaagcgcgtaagaagcaaactagttcaaatttatgacagagatacttgcccctgtgatacgtcagtttaccttgaacaactgcagattttccacagtttaaaattagaggttgctatgttggtcctcattttttttctttctcagatgtttgattctgttgcaatatgactgttggatttacatgccagtgatg

SEQ ID NO: 21999 - DNA, 526 bp, Homo sapiens
  misc_feature (403)..(403): n is a, c, g, or t
  misc_feature (427)..(427): n is a, c, g, or t
  misc_feature (439)..(439): n is a, c, g, or t
  misc_feature (517)..(517): n is a, c, g, or t
ttcaaactctgtttaatggatgtgaataattcagtttcatcccactgaaatcttaaaactataaacctatctttgttctttatgttccttcagagatcatatgtcattactcatatatgaattatttgaagtatgggtgatcatgatgaaagtgaccaaatttctacttagctcctgtgggtttcaggagaggaggtggcctctagggtgaggctagggattaagtggagaaacaaattgggaaaagtccaggaaaagagaaaagggtgttaaattaggatttcttggcattatctttcctatcaagatatatgttcattatagacattttagaaaatataaacaagcaaaaagaagaaaataagttttcaacgtttttaatgtatttacttctggacacacncaccacaagaacatttcttaaganacatctcactcnactttcagacattttagattcatttcaacaagtagtgtccccccatacatggatatatatatgtgcacacgaataagngatcctcta

SEQ ID NO: 22000 - DNA, 775 bp, Homo sapiens
gtggaccagaaaggtgaggaggatgctcccttcgagggtggagagagtaagactggcattgcacatgggtgggggggcccgtcgaggcccctctttgcttctgagagtctgttttcatcgacagtcttctactaaatgtacatagcagcttttcagggcaagggtcaccgggattcatctttatgcctccccagcccgggagccaccacctccaccagacccatccacacagttgaatctcatctcaagttctctggtgcccgaccccccatgcacaccgtgctggtctgggcatctcacctgcatccgcacaagtgcctcaggagggtggagtgtctggtgctcggcgttggaggctcagcccacactgtgccgggcagtcgcaggcctcccagatgaatgaagcatgagtgaatcccgatcctgttatcacagcttctccctacgcatcccaggcagaatgttgtgcaaaaaccacaccaggattcgtacatgccagaggactgaacttctgcgtgttgcagataattcatcttcctgaatcactgcggatctaccatggtggttaaccacagaataaacataggggagagcgtaagcgctgtcctaacagaaacttatgcttcttccgttaccctttaaaagtaaagggtactgatttcataattgtgtttctcttgtaaatgagactctcatggaaaaatcagccatgtaggcgatagatttgtatacctttagattaaaatgtcacttcgattatttcaagtgtaaaagt

SEQ ID NO: 22001 - DNA, 343 bp, Homo sapiens
gtggaccagaaaggtgaggaggatgctcccttcgagggtggagagagtaagactggcattgcacatgggtgggggggcccgtcgaggcccctctttgcttctgagagtctgttttcatcgacagtcttctactaaatgtacatagcagcttttcagggcaagggtcaccgggattcatctttatgcctccccagcccgggagccaccacctccaccagacccatccacacagttgaatctcatctcaagttctctggtgcccgaccccccatgcacaccgtgctggtctgggcatctcacctgcatccgcacaagtgccagggatcctctagattacccagca

SEQ ID NO: 22002 - DNA, 814 bp, Homo sapiens
tcccaaagttctgggattacaggtgtgacccggccaagctggggtttcaccatgttggccaggctggtctcgaacccctgacctcagatgatccacccacctctgcctcccaaagtgctggggattacaggcgtgcactccgaacaggcctgggatgatttccgagaggtaagtgggttgctgcagagcgagagaaacctgctgtgtggggtcgtggggataggagtaaggggatttcggagttttgttttggcctattcaaaatatgaagccaagtcaccatggctcacacctgtgatcccagcattttggaaggctgaggtgggaggattgcttgaggccaggagttggagaccagcctgggcaacacagcgggtggatcacgaggtcaggagatcgagaccatcctggctaacacggtgaaaccccatctctaataaaaaatacaaaaaaattagccgggcgtggcggtgggtgcctgtaatcccagctactgaggaggctgaggcgggagaatggcgtgaacccgggaggcggagcttgcagtgagccaagattgcgccactgcactccagactgggcgacagaacaagactctgtctcaaaaaaaaaaaaaaaaaaagaaaaccccagctctactaaaatacaaaaattagccaggcatggtgataggcacctgtagtcccagctactctggaggcttaggcagaagaatcacttgaacctgggaggcggaggttgcagtgagtcgagattgtgccactgcacttcagccagggtgacacagcaagactctgtctcagaaaaaaaaaaa

SEQ ID NO: 22003 - DNA, 207 bp, Homo sapiens
tcttttaaaatgtataagccactctttcagtattttcttaatttttggtacaaaaaatactttttagatttatcttgtactttctgtgctccaggtcttgaatgagccttttctccagtgagctctgactcctcttagtggggaattggacatggacacacacacacacacacacacacacacacacacacacacacacacacacac

SEQ ID NO: 22004 - DNA, 341 bp, Homo sapiens
aaacattgtgtctgtagtcaacatgtatatttttgtcattattccttaaacaatagtgtaactatttacatagcacttacattataataggtattataagtaatctaaatattaacataagcgggaggatttgtgtagattgtatgcatatacaacatcattttattccagagacttgagcatctgcgaatttggatatccaaaggaagtcctagaaccagttcccgacaaataccaagagatgactttactttagacctaagatcttgctagacagcctttgagaggatgaaggataactagagcagaagcaaatcgcagcgaagtagactacaacaatc

SEQ ID NO: 22005 - DNA, 1055 bp, Homo sapiens
ggaaccttctgctgagctggcttctggggcctgagcttccagagctgtccccaagggctaggaaggccgacctgaaggatgagaacctcaaattcagttgctggtgggagccaaggaagacggcgggtgttctaacatggccctttctggctgagctggcggaagtgggcgttttggccgatgggatgtatctcggcgctgtgtctgtggcccagcaaaggtgcagggctgactggctgagccactgggttctacccgcaggctccccactgcactgggctttcacacagccatgctcttgggtttccctcccttgtaagcagagtcataataacacacgaatagtctaaggctgggtattctggtcagcagaggtccttgagtcacagtgttactgaaatggttctgagcctgagaatctctttggcctctgaaagggcagggcaggtgggcaccgacttcctgccagtcctttcaggtttcctgttcaaagccagtcctgttggtggaggggatcaccgagagtgtctgtatcattttgtagcccttttctctgacgttttctggtagaaaatgtcccttgtcaaaatgctaataattatcataataatctgctttccaaccaactcccacaagtgacaacctgtgtagaactgtgataaaggtttgcataatgtagggtttgtaccaagtgtgtgtaagtttctgttaaataaaaagtctgtttccaaaaaaaaaaaaaaaaaaaaaacaaaaaaagaaaaaaaataaaaaaaaaaaaaaaacaaaagaaaacgcaaaaacaagcaagaagacaagaacaacaacatagagaaacatcaaggcaagagaccccacacacaaaaaagtacatggggcgcggccggcgccggaaccacagtaagcccaccaccaccacttctgagtggggggccgcgccccggaagtgtagggggccacagggcgagcgaggctcgcgcgcacaccctacatgtgtgaatcgggtgggcaaacaaaaaaaaaccccggcgcgacgcgttcgcacagcacaccgg

SEQ ID NO: 22006 - DNA, 1247 bp, Homo sapiens
ccaccttggcctcgtaaagtgctgggattacaggcatgagtcaccgcacagggccaaacaaacaaacaaacaaacaaaaaaacacttaacacttaaaataaatccaagccagtcacagtggtgtgcacctgtagtcccagctactcaggaggctgaggcaagaggatcccttgagcccaggaaatggtttttcaatatggtgtgaagtagggatcaagtttcatcccctccagtatgtgtatccggttgtctcatctttttcacactgctctactgttctacattttttcattaattgggtccatatgtccatatttgagtggctgagttctctattctgttccattgttctctttgataccacactgtcttaatgagtatcgttttacattcatgctttatattcatgtccatatttgagtggctttgtttctgagctttatatattccgttccactgttctctttgtctttgattcaataccatactcccagctattcaggaggctaaggcaggagaatcgcttgaacccaggaggcggaggttgcagtgagccgaggtcgtgccattgcactccagcctgggcaataaaagcaaaactccatctcaaaaaaaaaaagggacataaaaaaaatctatattattataaacattgaaggcagaggagagtagactgaatttgcattgactctgaagtctacattaagtctactctgggtactctcctatcctgcgcaaatggcagatctgtctatttgatcatagcactctctcctggtgatcctaggcatagccccactatcctcagagtagggcttcctgtccttgttgttgcttgaggttaatcttttttgcttccctagttctgggttgctttagagcaacatgtaatgtaggatcctgtaagggattaactagggcaaatgaagctaacatcctcctatcctctgccccactccagattggacctggactttttcagcgatagggtatcactatgttgctctggctggcctccaactcctgggctcaagggaccctgattttttttttttaattgagtttaaattcatataacataaattaaccatttaaagcaaacaattaagtagcgttcagtacattcccagtgttgtacattcatcacatctatctagttccataacatttccatcaccccaaaatgaaaccccatgctgattaagcagtcattcccactccttcctccaacccctagcaaccattaa

SEQ ID NO: 22007 - DNA, 309 bp, Homo sapiens
agatggggtcttgctatatatccaggctggtctcgaactcctgggctcaagtgatcttccagccttggcctcccaaagtcctgggattacaggtgtgagtcatacccagcctgtattcctaatttttttaaaaaggaaacttttgcaacagtaatttattgtcatagggaaaatttttagcatttgttcatgctataaagtcacttttcacttaaatttaattatattaaatattagcttatcatgttgaacattggtccagagttctataatgacaaaaagaaataagatagaacaagggggggtgga

SEQ ID NO: 22008 - DNA, 437 bp, Homo sapiens
tccccaatattaatatcatctatgagtataatcttattagcaattagcttttaaactgtttgttctttgaaggtaacatttgcaaatcatttgaagaaattcatcaaatgactccccactgttggatttggcaaaaatggagtttaaagttgagggaaggggcaaggaatgcaggatctagggatctcgccaatttgggaaccaaaaaccaaaagagaaattcaagaaggaggtgccaaggcatatcctgagtcctggatcctgaatcagggagccagttggtgttgagaacccaatggagcattctgtcctggaaaccagacatggaatacagctgagaatgaggtttgcttgggggattttaagaaaaggaacacacttttgttccctggtgatgtccagtcctgcaccctctcccttctgctgggcaagagcca

SEQ ID NO: 22009 - DNA, 800 bp, Homo sapiens
tgatgttatacattcttagagccccttattttctattttgttccctgagatctcatgggagttactagtacaattctgaataggaatgaaattggagttcagtgtagagctgtagattaaagggaaagtagtgatggtttcctcttatttatacagagcactgccaagcatgtcatgttttggttcttctcatcctgacactaacatgcaattagcaactattgttaatccattttacagaggagaaaaactgaggctgagagaagcaagttgagttctctaacttcacatggctagcagatgacaaacctggattgaaacccaggtctggccgggcgcggtggctcacgcctgtaatcccagcactttgggaggtcgaggcgggtggatcacaaggtcaggagttcgagaccagcctggccaatatggtgaaaccatacaaaaaaaatacaaaaaaaattagccaggtgtggtggcacatgcctgtaatcccagctactcaggaggctgaggcaggagaattgcttgaatccgggaggcggaggttgcagtgagctgagatcacaccactgcactccggcttgggtgacagagcgagaccccgtctcaaaaaaaaaagaaacccaggtctgcctgggttgcttgttcttgtttttgccaagtgaacagaacttggctggttaggattttgacattaattcaagtctaattttgaacaacatataatataggggttcttaacctgagggtcacagactttcagagatagtccatgaactcctgcaagtgtatgcgtattc

SEQ ID NO: 22010 - DNA, 407 bp, Homo sapiens
ctcggctcactataacttctgcctcccgggttcaagcaattctcctgcctcagcctcctgagtagctggggttacaggtgtgcgccaccatgcctgtctaatttttatatttttagtagagacagggttttaccaggggtcaggctggtctcggactcctgacgtcgtgatctgcccatgtcagcctcccaaagtgctgggattacaggcatgagccaccgcgcctggccaacagtgctcctatcttaggcattttgcttttgtttcaggtcatccccatcgctcgctgctgatcttcctttctgagctgatcaatcccctcacgctggacatttcttctcaggtttcctctgaatcattttatttggtctaaacatgtccagtttttctgccttccttacagcact

SEQ ID NO: 22011 - DNA, 268 bp, Homo sapiens
cccttaaatatgccagctggaacccgtagatgccaatagaaggtacattacctcgtaagataaaggctcattacatgaaaagatgcagggccttgctgtacagtaagttgaaatcaattaattgtcctccctccccaccccaaatattgcatcctcccaaccacttatcttcatagggcaaaattaccattaaatggtgagtgaagaggactatctgagctacacctttcaccattcattcatcttggattgatggtccctaagctca

SEQ ID NO: 22012 - DNA, 605 bp, Homo sapiens
cagtctttggcattcttgagaaagagaagtggctgccccccacacccgtgggtgctaccagggagaccttttctgggacagtgtagggaaggacaaggaatcctttagcacagtggtggtaggtcgtggatagtgggtcatctaagcatgacattgcagagatcagagcaggttgagagagagagagagagagaccccctctccattcctgattatgttgtttgagtcacttgaagccagctaacagattccatttgcttaaaccagtttccattcattcatttctttgaccaatatatactgatcacttactatgtggacaatttctaggaaccatttgagctaggttttccatgagcataattctaaatctaatcttaacctaacccttagtcataaactagaactctgacccttttctagtgaagagcttttagtggcaagaaacaaagtcctggaccactcacactgacccagtccaaggggcattggtgtaagaatatgcatgaatcactaagtgaaattccaggaatattacaaagattttaccagcaatgggcctcatgagggacctaactgatgaggaattcaatccctccctacta

SEQ ID NO: 22013 - DNA, 515 bp, Homo sapiens
cagtctttggcattcttgagaaagagaagtggctgccccccacacccgtgggtgctaccagggagaccttttctgggacagtgtagggaaggacaaggaatcctttagcacagtggtggtaggtcgtggatagtgggtcatctaagcatgacattgcagagatcagagcaggttgagagagagagagagagagaccccctctccattcctgattatgttgtttgagtcacttgaagccagctaacagattccatttgcttaaaccagtttccattcattcatttctttgaccaatatatactgatcacttactatgtggacaatttctaggaaccatttgagctaggttttccatgagcataattctaaatctaatcttaacctaacccttagtcataaactagaactctgacccttttctagtgaagagcttttagtggcaagaaacaaagtcctggaccactcacactgacccagtccaggagcggtgggcaatcatgggatcctctagacta

SEQ ID NO: 22014 - DNA, 241 bp, Homo sapiens
gcttcccttcatccctgggatctggcttctcctccaaccactatggggaaactgttcttctgaggtcccctcaaaaacatcctaataaatgaatccaactgcagtttttcagtccgcatttcactgcagcatcagatacccttacctgtttggctcccaaggcactgcaccaacctgcttctcctttataaaccttctgtaattgattctttgctaactctttatcaaggtcctttgttct

SEQ ID NO: 22015 - DNA, 300 bp, Homo sapiens
ggcatcatggcatttggggcaggccccagaataatctgtgtgccatgaggaagcccaaatgtcctccagagatgaccctacctcctccagtgcgagcctttttcaagatgctctgtgtccaaagctgcctgcagagtgaggttgcgttactctaccacttctatttgcatcctcattgttccccccaaaaatgagtgaagactatggcaccagatgaagaataaacaaggaaaacaacttcaggttattaatattttcaaataatatgcatgctcccaataactgtacaaaacataagaa

SEQ ID NO: 22016 - DNA, 688 bp, Homo sapiens
tcagcactctccactttctggtggcttagggttggtggcgttggacctgggcagagatctccctccaggcaggcagctgtcaccactcggtgccccaggcttcagaagccacttctgtattttacaactacaaggccccaaaggacattccacacaaagctcaggacacagggtcgcaggtggcttctcactgtccccaaaagggccaggccgaatcactcctcctctcctctgcctacaccccctcccacttcccctccactcctcagagccggcttcagacccaacttaacgacacttgaagattgagatggacgaagccaaggcacaggggacccagatgggggccgagaacggggcgctgacaggtgcgttggggtgtaagggagtgggcagggatagaagtgggaggagcctaggtgaatcctagttatccaaacaagcacagttgcaaacgtaatgcaaataacacggatataaacgcaaaaacttatgaaaagaatgcaaacaacatgcagaggccatgcaaatgtcacaaaaacaaggcaaatgccacaaaacatgcaaactccttgtaaacgactcacgaaagcaatgcaaacctatgaaaagctatgcaaatggcacgtggaagccatgcaatggtacacactaatttaattcaaataaaggaaagcgtgcaaacggc

SEQ ID NO: 22017 - DNA, 245 bp, Homo sapiens
tcttgcatctatttttcacttctctgacattttgatggataaagtttcatttggaaggatttttatttcaaaatagaaatagcatataacatgagaatgggaactctgaaaggttcaactttctagtcattagtttcctaagattgtcatgaaagccacatatagtcaatcatgattggcctgtattaaaagtgagataacatcatgtacaacttaagcactgtactttctatcagatatagaaa

SEQ ID NO: 22018 - DNA, 285 bp, Homo sapiens
tttacctgctaggctcgtcccacctgtgtggagctcccatcgccctccagcgttgcgcagcctgaagggacaggacggacaagcgggtgcctccttctaattcatcttcaccattgtggttgtcaatatggcatgcagaattatccctctttccaggttttccccaaggaccctggacaatgctggtttttcctatgtgcaccaccaaagggcctatccagcttctggagtctacctggattcctgggctcatggccccttcctccatcttcaaaccagcaatgg

SEQ ID NO: 22019 - DNA, 1922 bp, Homo sapiens
taagcagaaattgctcaataatcttgcttttattcatcatggattaaattaactccagctgcttaaaatgcccattcaagatttaaatgcctggacgtgagtgtgcaaacctaggtcagaaatcacccctggcagtcttggagctttgagaggactctacaggaactacttcggcttaaatggtttgaggcaaagcagctgggtttactgattcatcaagactaaatgtgaaaggagaggtaatttattcaaaggaaattgtgggaaagactgttagacaaacaaaatctgacaaatgaccaggtggttacttgaagccctgacattgaaatatgttgggtgttgggtatatactaaatgaagggcaatattataacaagtggacatgctggaagtatgagcaacttacgtatgtagtttgtgtggacgggcctttagggactgctgcttcagatcccataagctccacttccacttgatgaatgctgcttggcttgccccactctgcctagatggatggtgagcaactttgcatggtaagcaaaggctgtcttgtgcaaatgaaatctcttaggcaacagctatcagaagaataggtgactgcctgtggtagtctctgttatagggaggtgtcagagctttatctttctttaggcagataaagggccttcagagagaaacctctgcttgcatcctctgtttagtaaggtggatagatgtaaatttcctttagaaatggacagcttttcagagctattcctgcctgcagttctcagaataatcaacttgaaatatgccaaagaagtatattctgaggtggcatattgtggcttcccctcattccatcaaacctttagacataagaacaattgactgacctggtgcctacccagtttgctggtttcctgcctataaggaaagttatgttgcagatcagtggtagacctgaaagtcacataatagaaaaaaaggaggataaggagaaaatgaattgctgttcccaagtaatcgagatttgtttcttcttgcagggaagatgattgggaaaatattgtgacctgataaaagtgttgatacatttaataagggtttgccaccatctgactaaatgataacatatgcctttcagagtcttttctgaaaaatatcctgaaacagtttggcatactccttcagcaacactgacatcttcatgtgtttacgtagacatatcccgccactttgccgtactaattggcactaggagccaccaagtaacatggggagaaaaaaggggactacaaatggcagctttgaattggctatttacatcagttgtatttggggtgaggatcagcagcaaaaaaaatgcatgaagcctttaggatagaagggaaggagggactcacggaaaaaagctgcaggcctgaaggctgctgaaagttttggtgggaacaggtaaccctttctgcattagaggtacaggggttgctgagagaaaaacccaactgcttccagccctactggtgaaactccttaggggcacttagagaataagatctgtgcctttgaagtaaagggaacaaagtagcttcatctcaaaaaaaaaaaaaaaaacaaaaaacaaacacctgtgatgaagttctgggctaaggaggccgctggacaacccagcaactaccaaaaatgtcattaagtgcttggctgagaccatgtatcttacacatctagagcacaatttagaatatgacaagaataggctgggcatggtggctcacatctgtaatcccagcactttgggaggctgaggcgggcagattgcttgagctcaggagttcaagaccagactagaccacatggcgaaaccccgtctctgccgaaagaaaaaaacaacaaaaattagccaggtgtggtggcgcacacctgtaatcccagctactctt

SEQ ID NO: 22020 - DNA, 1282 bp, Homo sapiens
ttttttgagatgaagctactttgttccctttacttcaaaggcacagatcttatcctctgtttagtaaggtggatagatgtaaatttcctttagaaatggacagcttttcagagctattcctgcctgcagttctcagaataatcaacttgaaatatgccaaagaagtatattctgaggtggcatattgtggcttcccctcattccatcaaacctttagacataagaacaattgactgacctggtgcctacccagtttgctggtttcctgcctataaggaaagttatgttgcagatcagtggtagacctgaaagtcacataatagaaaaaaaggaggataaggagaaaatgaattgctgttcccaagtaatcgagatttgtttcttcttgcagggaagatgattgggaaaatattgtgacctgataaaagtgttgatacatttaataagggtttgccaccatctgactaaatgataacatatgcctttcagagtcttttctgaaaaatatcctgaaacagtttggcatactccttcagcaacactgacatcttcatgtgtttacgtagacatatcccgccactttgccgtactaattggcactaggagccaccaagtaacatggggagaaaaaaggggactacaaatggcagctttgaattggctatttacatcagttgtatttggggtgaggatcagcagcaaaaaaaatgcatgaagcctttaggatagaagggaaggagggactcacggaaaaaagctgcaggcctgaaggctgctgaaagttttggtgggaacaggtaaccctttctgcattagaggtacaggggttgctgagagaaaaacccaactgcttccagccctactggtgaaactccttaggggcacttagagaataagatctgtgcctttgaagtaaagggaacaaagtagcttcatctcaaaaaaaaaaaaaaaaacaaaaaacaaacacctgtgatgaagttctgggctaaggaggccgctggacaacccagcaactaccaaaaatgtcattaagtgcttggctgagaccatgtatcttacacatctagagcacaatttagaatatgacaagaataggctgggcatggtggctcacatctgtaatcccagcactttgggaggctgaggcgggcagattgcttgagctcaggagttcaagaccagactagaccacatggcgaaaccccgtctctgccgaaagaaaaaaacaacaaaaattagccaggtgtggtggcgcacacctgtaatcccagctactctt

SEQ ID NO: 22021 - DNA, 811 bp, Homo sapiens
gttagtcacatctgctttttggctttcaaaaatttgatctctttgttccattactaattcttctcctgttttttggcgtttgtgccttttaaaattcttttactttgactttttctgggaggctggtatcaggagagagaaaagataaatgtatgtttaattcactgtatttaactgttttaactgtgcttttcctactaatagacatttacattttctataaataatgttatgataaaaatgattgcctaggttaggttcattaaaaaattttttttttcttttaagaataaataatttcttaagaacttcattttaaggtacttggaaattctgatcatttctaatttttcaaaaccacaattgagattaggaagtttttttttttaagtcttctcatagccttacctccaaagcctgtctgcactgtatgctacctctcctgcccccactattttaaaaatttacattccttctgctggttttgctactaatgaaccaattccctgtgcatgacccattgtccctaaatcctcctttgcaaaccagtaaaaggctagcgttgtttgtttctaagcagaatggtgataccaatctgccagactcctaccgtacatgcttccactttaatccttagagctactccgaaaggggtagacctgagccccgttttagacagggagcccagagctcacagagctgaggtggcaaggtctgctcgtaagcacagtgtagcgacccaggtttgtaagcttttgttcctgttgtaccccactgcctccctggaattgatgtgttctattcatgagga

SEQ ID NO: 22022 - DNA, 325 bp, Homo sapiens
gcctgcgccactatgcctggcctgaatttctttctaactgcctatctcagatatgttccttcctgcaaggcaacaacaaaatgtgattgtggtcatgtctagatactacaaagaatatcacagcctgctctaagcctgtatagagaaagtcaatgatttttccagataagtcaaacatgttaggggacattccctaggagtgttctaagtatgcctgggctctcaaattggcaatctcattgttggggaatttttatgtctgacacataaagtatgaggattcattcctggagtgataacagtcttaaaacactagataatggaa

SEQ ID NO: 22023 - DNA, 470 bp, Homo sapiens
agggcctttgagtttgtctggaatactctctctcctcagagagaggcttatttccctaggcttctgtgtcctcatgtatacaatgaagttcacttagatgacctctaaggtcttttccagccacaaaatagtattgctgtagtactctggaatatatacagctccagggttggaatcctgcctcaactcctcaaactaatgtctaaggccttctataatctaaccccacctaattatatgatgtatgtccaaccatttggacataatagtctgttctagttagactggtctctttactttatctttcccacagatgattcccatttggggttatgtgttctttttgttccttccacttagaatgcccattttttctctcactacaaataaccccctaggtctcagtcaaaatctcctatttccttgagaatcacttgatattatattttctcattatctcctacatgcaa

SEQ ID NO: 22024 - DNA, 838 bp, Homo sapiens
gtgagtagacttgctcactggagaaacttcaagcactaatgctttcggaatgtgaggcttttccttggacagcatgactttgttttgtagaaaagtacggctggctgggagtttgtgatataatttagttcagtggtattctaagtgttcttagtgttctttcagacttttgggccatctcccaaagggtgaatgggaagaataagctgggtgtggctgagtttaagccaaaagttttttgtgcttgtttcaatcagagaagacctgctttttcatgtttttactattataatactaagcaagagctcatttgaaaacagagttcttcatatttaaaaaaaaaaagtcttgaaaccattgatgggaagatggatatctatttatgtttaaaaacccatcataaagatgacattgtgggctgtcacagttggaaggccctggaattagatgagaccacactatttagcttacttagtaataacattgcaaagaaaaattccgacgaagttttttcagcctaggaatcaatagttcagagaagcactctatgagaatacccattcattcttaaccaaaaaatactggtgagcctgagcagtttggtcatcagagtgttttatatagttccagaacaaatatgtctctaggtgttctgagagctctggtgaaattcctctcgctaccccaaacatcatcatttaatatccaggattctggttttctactcaccagatagattctcttaaaaccagggaaagattcctggaggaaggatgtatctggaaagagatgttccttattataataaaatgaaattgtaatactcttggattttgtg

SEQ ID NO: 22025 - DNA, 354 bp, Homo sapiens
aaatgaaagaaggagagaaagctctctgctgcagagaggggccctgaaaaagggttgctattctatagtggaatacaagggtttttataaatgagctagtggggagggggtactttatttacataaggtgtgaaaaactggttaggactaggtgtgtcatttgcagaaggcatgaatttctgacaacccccacgctgtccttccagtgtgcatgtgggctcgtagcctaagttacttcatgttgtttgacttcccttactgtgcacgtgttggggatagaatcctccattgtggacatgcctagctcagtgtaactccccttatctgtgtagctgtaggcatgttccaagcatg

SEQ ID NO: 22026 - DNA, 400 bp, Homo sapiens
gcacctggccctccaggaaggcctgcctgcgaggagctgctctgcacagctggtctcgaccctccgctaggcaccaggagcgaagagggagaggctttgggaaggagacacaggtcagagagcttacagaaaagtcagcctcgatggacggcaagatgcacctgtcagccacgaaggagccccccgaggtgcagatccccacatccgccgcacccgtgtggagaaaacagcgctggatttcctgtcgtgggttttgtgactttgaaagccgaggctgctgattgggaattaaatcccagaggacgccgctcaacacactggaaacccagcagctgctgctgttcccagcaatttttctttctctaaattgaaacatcattttctatttttcttctgacac

SEQ ID NO: 22027 - DNA, 390 bp, Homo sapiens
acgcctggctaattttttcactttttgtagagatggggtcttgctatgttgccccgcctgggtctcaaactcctagactcaagcgatcttcctgcctcagcctcccaaagttctgggattacaggcgtgagccaccacacctggcccatcttttgtaatacaccagcaattgtaagtaaagtgtgttcctgagttctgtgagctattccagtaaattattgaacatgaggcggaagctgtgggaaaccccaaactattgccagtcggtcagaagcaccagcggctaggtaattgcaactcgtgtctgaagtgggagcagttttttgggactgagcccctttcacctgtggaatctgatgtgaactccaggtagccagcgtcagaattgct

SEQ ID NO: 22028 - DNA, 668 bp, Homo sapiens
gtatgtgtaacatacagcatggattcatttttctggtatcaataggaggattggtattgtgttagatatgtaataagttcttgcttctttcaataaatgggaagtttaaggtttaggattgtattttaacagcatttcaatgaacgtgagaaagcggcaaggttgcggtctgatttgcatttatgggtcatgatttttttcttgggaaaaattcatgcataggctgggcacacagttgttcacacctgtaatcccaacactttgggaggctgaggcaggaggatcacatgagcccaggagttggggcccaccctgagaaacatagtgggaccccatctctacaaaaaatacaaaaattcgccagggtggtggtgcacacctgtagtcctagtgactcgggagtctgaggtgggaggatcactcgagccagggaagtcaaggctgcagcagagtgagtcttcctccagcctgggctacagtgagaccctgtctccagaaaaaaggaaaagaaaaagaaaagaaaaattcatgcacacaaacataagcctaattgaaaaatttaggcatatgtttaagaaacagataataaagggaaattgtattcttaggaattcttagatatattttagaatctttatcaaggaagggttctatcatagatggaagat

SEQ ID NO: 22029 - DNA, 248 bp, Homo sapiens
gatgatgattggtaaaaggtctgattgcactgaatgtcacggtccctttgttgccctcaactcccagcagcccattttttccctcccgtcacatttaagtcatgtgtatgggatcatggagcagctgataatttgggattctgtcagtgtgtgtttctgagagtgatcggctcacagctgacgagtatccaacaaaaccagttacacaggagactgacgagtggcagtcatgggtgtgatggtgcatg

SEQ ID NO: 22030 - DNA, 695 bp, Homo sapiens
acagaagatttatgacatcatgagttgttaatttggaaaatatttgcttactgagttatacagatcttcaaatgttgatacatttcattacacaatatcacagaaattgtaactgttaatctcaccactgatctcatctgaaaaatctttaaatattaagaagctgtcaaagtttatggtagcagatacaaagttttccaaaattctgattttacttgaatgcttgaattttattattggcaacaaatattgtcagttgttttccttgaaatgacagttttactatgttaatttcagggaaaatatctgccaaatacctgtcagttgttttttcatgtaaaaaatggtattccatgacaaaagtggctacttcagccttccactcagtcacacaagtacttttcctctagacaaccattgtacttgggtatgcagtgaaatgctttatgtgtacttctcattttgtcacacagaatattaaaatgatgtatattcaagaatcaagattcaataaaattgattttgtttttgctgcttcataagggcattcctgagactggcttttattttttaaggtttgtttgtttgtttgcttgttttgagatggagtctcgccctgtcacccaggcagaggttgcagtgagctaaggtcatgccactgcactccagcctgggagacagagcaagaccctgcc

SEQ ID NO: 22031 - DNA, 650 bp, Homo sapiens
gcactgttgatttgttttgcagaatccttgcagcctttcctggaagcctgtagcaactctttattttttcgtacttgctctgtgctgcttcgagcccctaagcttgatcttcaaatactagaaaaactcagtattattttacagaaactttccaaaatcaagagtaataagaagctctttgaactttttacgattcatctgatgcttcaagaaatacaaaggacaacaaacccagagcatgcatttctctgtattaatctaaattcaactctgttcaatctgggtttaacaaaatgtaactccctggtctccagtgcaagcccttagactggctaattttttaatatagtatatgtggtgcttatttataaacatgtagaaattaccaaagtaactacaattctaccaagtaaagttatcagtagcatcatttatcatgaaaaataaataatttttttgaactgtaaaaatgaaatctgtagaaggtattggaacttttggaatgtttcagttcaggtaaggtagtactaatatacaagatggcgtttctagaatgtatgacactgaagtgactttttgtaaaaatatattaggaaaattatttcttaaaattatgtgaatatttggaataaaattggtgcttatgtgag

SEQ ID NO: 22032 - DNA, 1888 bp, Homo sapiens
  misc_feature (2)..(3): n is a, c, g, or t
gnnggggtttgatgaacgcggttcccggggagactggtacggttgctgtgtgctatggagccgagggtcgtcaagccaccggggcaggatttagtagtggagagtctcaaaagccgctacggactcgggggcagctgccccgacgagtatgatttttcaaatttttatcagtctaagtataagagaagaactctaacctccccaggtgatttggatatctactctggagataaagttggttcatcgttaaaatattctgatgaaagcaagcattgtagaacaccattgggcagcttattcaagcacgtaaatgtgaattgcctagatgatgaactggattctttccatgatttgaagaaacaggaaacagaagaagagttaattgaaaatgattatagagttagtacctcgaaaataaccaagcagtcttttaaagaaatagaaaaagttgccttgccaactaatacgacctcatcgagacctcggactgagtgttgtagtgatgcaggtgactctcctttgaaacctgtcagctgtccaaaatctaaagcatcagacaagcggagtttacttccacatcagatcagtcagatatatgacgaattatttcagatacatctgaaattgcagtgtgaaactgcagcacaacagaaatttgctgaagaacttcaaaagcgagaacgttttttacttgaaagagaacaactgcttttcagacatgaaaatgccttgagtaaaattaaaggtgttgaagaagaggttcttacaagatttcaaattataaaagagcagcatgatgcagaagttgaacacttaaccgaagttcttaaggaaaagaataaagaaaccaagagactgaggtcctcttttgatgcattgaaagaattgaatgataccttaaaaaaacagttaaatgaagcaagtgaagaaaacaggaagatagacattcaggctaaaagagttcaagcacgtttagataatttacagaggaagtacgagtttatgacaatacagagattgaaaggaagttcccatgctgttcatgaaatgaaaagtttaaaacaagaaaaagcaccagtttcaaaaacttacaaggtaccacttaatgggcaagtttatgaacttttaactgtcttcatggactggatttcggatcatcatcttagcaaagtgaaacatgaagaatctggaatggatggtaaaaaaccacaactcaaatttgcttcccagagaaatgatattcaggagaagtgtgtaaagaatccttgcagcctttcctggaagcctgtagcaactctttattttttcgtacttgctctgtgctgcttcgagcccctaagcttgatcttcaaatactagaaaaactcagtattattttacagaaactttccaaaatcaagagtaataagaagctctttgaactttttacgattcatctgatgcttcaagaaatacaaaggacaacaaacccagagcatgcatttctctgtattaatctaaattcaactctgttcaatctgggtttaacaaaatgtaactccctggtctccagtgcaagcccttagactggctaattttttaatatagtatatgtggtgcttatttataaacatgtagaaattaccaaagtaactacaattctaccaagtaaagttatcagtagcatcatttatcatgaaaaataaataatttttttgaactgtaaaaatgaaatctgtagaaggtattggaacttttggaatgtttcagttcaggtaaggtagtactaatatacaagatggcgtttctagaatgtatgacactgaagtgactttttgtaaaaatatattaggaaaattatttcttaaaattatgtgaatatttggaataaaattggtgcttatgtgag

SEQ ID NO: 22033 - DNA, 2421 bp, Homo sapiens
  misc_feature (2)..(3): n is a, c, g, or t
gnnggggtttgatgaacgcggttcccggggagactggtacggttgctgtgtgctatggagccgagggtcgtcaagccaccggggcaggatttagtagtggagagtctcaaaagccgctacggactcgggggcagctgccccgacgagtatgatttttcaaatttttatcagtctaagtataagagaagaactctaacctccccaggtgatttggatatctactctggagataaagttggttcatcgttaaaatattctgatgaaagcaagcattgtagaacaccattgggcagcttattcaagcacgtaaatgtgaattgcctagatgatgaactggattctttccatgatttgaagaaacaggaaacagaagaagagttaattgaaaatgattatagagttagtacctcgaaaataaccaagcagtcttttaaagaaatagaaaaagttgccttgccaactaatacgacctcatcgagacctcggactgagtgttgtagtgatgcaggtgactctcctttgaaacctgtcagctgtccaaaatctaaagcatcagacaagcggagtttacttccacatcagatcagtcagatatatgacgaattatttcagatacatctgaaattgcagtgtgaaactgcagcacaacagaaatttgctgaagaacttcaaaagcgagaacgttttttacttgaaagagaacaactgcttttcagacatgaaaatgccttgagtaaaattaaaggtgttgaagaagaggttcttacaagatttcaaattataaaagagcagcatgatgcagaagttgaacacttaaccgaagttcttaaggaaaagaataaagaaaccaagagactgaggtcctcttttgatgcattgaaagaattgaatgataccttaaaaaaacagttaaatgaagcaagtgaagaaaacaggaagatagacattcaggctaaaagagttcaagcacgtttagataatttacagaggaagtacgagtttatgacaatacagagattgaaaggaagttcccatgctgttcatgaaatgaaaagtttaaaacaagaaaaagcaccagtttcaaaaacttacaaggtaccacttaatgggcaagtttatgaacttttaactgtcttcatggactggatttcggatcatcatcttagcaaagtgaaacatgaagaatctggaatggatggtaaaaaaccacaactcaaatttgcttcccagagaaatgatattcaggagaagtgtgtaaagaatccttgcagcctttcctggaagcctgtagcaactctttattttttcgtacttgctctgtgctgcttcgagcccctaagcttgatcttcaaatactagaaaaactcagtattattttacagaaactttccaaaatcaagagtaataagaagctctttgaactttttacgattcatctgatgcttcaagaaatacaaaggacaacaaacccagagcatgcatttctctgtattaatctaaattcaactctgttcaatctgggtttaacaaaatgtaactccctggtctccagtgcaagcccttagactggctaattttttaatatagtatatgtggtgcttatttataaacatgtagaaattaccaaagtaactacaattctaccaagtaaagttatcagtagcatcatttatcatgaaaaataaataatttttttgaactgtaaaaatgaaatctgtagaaggtattggaacttttggaatgtttcagttcaggtaaggtagtactaatatacaagatggcgtttctagaatgtatgacactgaagtgactttttgtaaaaatatattaggaaaattatttcttaaaattatgtgaatatttggaataaaattggtgcttatgtgagaacagggttaaataatactgtctttctattttcctaatatattagaatccttgcttttgaaagcaaaaatgtatatctttaaactatcatcttgataccataacttttctatatactgtatcctagattaacagatgttgattttttttttattgtgctctttgtgggatagaaaaagttttttattatgctgttcacaggtttaaaaacttttgttttcaaaataattattactggagcatgtatatacaaggcaagacattttttaaacattgaaaggtaaacaaaaataatcgtcctgttaccagagatatctcttggtatagccaaagatgagtaaagtggccacaggtctgggtgaagtaaaggtggtaaaacttgggacttaggacaggatactgagaaacattgttttaaagagtcataaaatcatatatgatcagtgtataatctcagtttcaggagttagaagaaattttcaagaaactattgggcctcttcaaaaaaataccagaaaatgtgccatttttgaa

SEQ ID NO: 22034 - DNA, 1570 bp, Homo sapiens
  misc_feature (2)..(3): n is a, c, g, or t
gnnggggtttgatgaacgcggttcccggggagactggtacggttgctgtgtgctatggagccgagggtcgtcaagccaccggggcaggatttagtagtggagagtctcaaaagccgctacggactcgggggcagctgccccgacgagtatgatttttcaaatttttatcagtctaagtataagagaagaactctaacctccccaggtgatttggatatctactctggagataaagttggttcatcgttaaaatattctgatgaaagcaagcattgtagaacaccattgggcagcttattcaagcacgtaaatgtgaattgcctagatgatgaactggattctttccatgatttgaagaaacaggaaacagaagaagagttaattgaaaatgattatagagttagtacctcgaaaataaccaagcagtcttttaaagaaatagaaaaagttgccttgccaactaatacgacctcatcgagacctcggactgagtgttgtagtgatgcaggtgactctcctttgaaacctgtcagctgtccaaaatctaaagcatcagacaagcggagtttacttccacatcagatcagtcagatatatgacgaattatttcagatacatctgaaattgcagtgtgaaactgcagcacaacagaaatttgctgaagaacttcaaaagcgagaacgttttttacttgaaagagaacaactgcttttcagacatgaaaatgccttgagtaaaattaaaggtgttgaagaagaggttcttacaagatttcaaattataaaagagcagcatgatgcagaagttgaacacttaaccgaagttcttaaggaaaagaataaagaaaccaagagactgaggtcctcttttgatgcattgaaagaattgaatgataccttaaaaaaacagttaaatgaagcaagtgaagaaaacaggaagatagacattcaggctaaaagagttcaagcacgtttagataatttacagaggaagtacgagtttatgacaatacagagattgaaaggaagttcccatgctgttcatgaaatgaaaagtttaaaacaagaaaaagcaccagtttcaaaaacttacaaggtaccacttaatgggcaagtttatgaacttttaactgtcttcatggactggatttcggatcatcatcttagcaaagtgaaacatgaagaatctggaatggatggtaaaaaaccacaactcaaatttgcttcccagagaaatgatattcaggagaagtgtgtaaagcttttgcctctaatgacagagcagctacagtggatgccatttgtgaatatcaaacttcacgagccttttgtaaaatttatatattggtccctaaggcagctagatgctggagcacagcactcgactatgacatcaacattgaggagattgggtgaagacatttttaaaggagtggtaactaacaggaattcaggataattctccacagcattctgtggagaataaacaaagacagctgctttctttaagagctccaatttgccattgagatttttatcaaccttaattgttctcaaaacagtcactcaag

SEQ ID NO: 22035 - DNA, 1945 bp, Homo sapiens
gaaacgcggtatcacggggagacttggtagcgggggctgtgtagctatatggagacacgatggtcagtcaatggtactcggagggagagattttggtaagtgagaggagtgtctatgaagccgcatgcggatatcagggggcacggtgggcaaagacgagatagtgatgaattaaaaatttatgaaatcgagatctaaggtagtacatagaagagattcttataacatcggcagggtgagttgggactactctacttctggtagataacaggttgggtgcatcagttaaagatatttctgatgcaaagcaaggcattgtaggaacacacaattgggcaggcttagttcaaggcacgtaaaatggtgaatttgcctagaatgatgaacgtgggattctttccagtgatttgaagaaaacaggaaacagaagaagagttaattgaaaatgattatagagttagtacctcgaaaataaccaagcagtcttttaaagaaatagaaaaagttgccttgccaactaatacgacctcatcgagacctcggactgagtgttgtagtgatgcaggtgactctcctttgaaacctgtcagctgtccaaaatctaaagcatcagacaagcggagtttacttccacatcagatcagtcagatatatgacgaattatttcagatacatctgaaattgcagtgtgaaactgcagcacaacagaaatttgctgaagaacttcaaaagcgagaacgttttttacttgaaagagaacaactgcttttcagacatgaaaatgccttgagtaaaattaaaggtgttgaagaagaggttcttacaagatttcaaattataaaagagcagcatgatgcagaagttgaacacttaaccgaagttcttaaggaaaagaataaagaaaccaagagactgaggtcctcttttgatgcattgaaagaattgaatgataccttaaaaaaacagttaaatgaagcaagtgaagaaaacaggaagatagacattcaggctaaaagagttcaagcacgtttagataatttacagaggaagtacgagtttatgacaatacagagattgaaaggaagttcccatgctgttcatgaaatgaaaagtttaaaacaagaaaaagcaccagtttcaaaaacttacaaggtaccacttaatgggcaagtttatgaacttttaactgtcttcatggactggatttcggatcatcatcttagcaaagtgaaacatgaagaatctggaatggatggtaaaaaaccacaactcaaatttgcttcccagagaaatgatattcaggagaagtgtgtaaagaatccttgcagcctttcctggaagcctgtagcaactctttattttttcgtacttgctctgtgctgcttcgagcccctaagcttgatcttcaaatactagaaaaactcagtattattttacagaaactttccaaaatcaagagtaataagaagctctttgaactttttacgattcatctgatgcttcaagaaatacaaaggacaacaaacccagagcatgcatttctctgtattaatctaaattcaactctgttcaatctgggtttaacaaaatgtaactccctggtctccagtgcaagcccttagactggctaattttttaatatagtatatgtggtgcttatttataaacatgtagaaattaccaaagtaactacaattctaccaagtaaagttatcagtagcatcatttatcatgaaaaataaataatttttttgaactgtaaaaatgaaatctgtagaaggtattggaacttttggaatgtttcagttcaggtaaggtagtactaatatacaagatggcgtttctagaatgtatgacactgaagtgactttttgtaaaaatatattaggaaaattatttcttaaaattatgtgaatatttggaataaaattggtgcttatgtgag

SEQ ID NO: 22036 - DNA, 1777 bp, Homo sapiens
  misc_feature (2)..(3): n is a, c, g, or t
gnnggggtttgatgaacgcggttcccggggagactgtatgatttttcaaatttttatcagtctaagtataagagaagaactctaacctccccaggtgatttggatatctactctggagataaagttggttcatcgttaaaatattctgatgaaagcaagcattgtagaacaccattgggcagcttattcaagcacgtaaatgtgaattgcctagatgatgaactggattctttccatgatttgaagaaacaggaaacagaagaagagttaattgaaaatgattatagagttagtacctcgaaaataaccaagcagtcttttaaagaaatagaaaaagttgccttgccaactaatacgacctcatcgagacctcggactgagtgttgtagtgatgcaggtgactctcctttgaaacctgtcagctgtccaaaatctaaagcatcagacaagcggagtttacttccacatcagatcagtcagatatatgacgaattatttcagatacatctgaaattgcagtgtgaaactgcagcacaacagaaatttgctgaagaacttcaaaagcgagaacgttttttacttgaaagagaacaactgcttttcagacatgaaaatgccttgagtaaaattaaaggtgttgaagaagaggttcttacaagatttcaaattataaaagagcagcatgatgcagaagttgaacacttaaccgaagttcttaaggaaaagaataaagaaaccaagagactgaggtcctcttttgatgcattgaaagaattgaatgataccttaaaaaaacagttaaatgaagcaagtgaagaaaacaggaagatagacattcaggctaaaagagttcaagcacgtttagataatttacagaggaagtacgagtttatgacaatacagagattgaaaggaagttcccatgctgttcatgaaatgaaaagtttaaaacaagaaaaagcaccagtttcaaaaacttacaaggtaccacttaatgggcaagtttatgaacttttaactgtcttcatggactggatttcggatcatcatcttagcaaagtgaaacatgaagaatctggaatggatggtaaaaaaccacaactcaaatttgcttcccagagaaatgatattcaggagaagtgtgtaaagaatccttgcagcctttcctggaagcctgtagcaactctttattttttcgtacttgctctgtgctgcttcgagcccctaagcttgatcttcaaatactagaaaaactcagtattattttacagaaactttccaaaatcaagagtaataagaagctctttgaactttttacgattcatctgatgcttcaagaaatacaaaggacaacaaacccagagcatgcatttctctgtattaatctaaattcaactctgttcaatctgggtttaacaaaatgtaactccctggtctccagtgcaagcccttagactggctaattttttaatatagtatatgtggtgcttatttataaacatgtagaaattaccaaagtaactacaattctaccaagtaaagttatcagtagcatcatttatcatgaaaaataaataatttttttgaactgtaaaaatgaaatctgtagaaggtattggaacttttggaatgtttcagttcaggtaaggtagtactaatatacaagatggcgtttctagaatgtatgacactgaagtgactttttgtaaaaatatattaggaaaattatttcttaaaattatgtgaatatttggaataaaattggtgcttatgtgag

SEQ ID NO: 22037 - DNA, 1042 bp, Homo sapiens
  misc_feature (2)..(3): n is a, c, g, or t
gnnggggtttgatgaacgcggttcccggggagactggtacggttgctgtgtgctatggagccgagggtcgtcaagccaccggggcaggatttagtagtggagagtctcaaaagccgctacggactcgggggcagctgccccgacgagtatgatttttcaaatttttatcagtctaagtataagagaagaactctaacctccccaggtgatttggatatctactctggagataaagttggttcatcgttaaaatattctgatgaaagcaagcattgtagaacaccattgggcagcttattcaagcacgtaaatgtgaattgcctagatgatgaactggattctttccatgatttgaagaaacaggaaacagaagaagagttaattgaaaatgattatagagttagtacctcgaaaataaccaagcagtcttttaaagaaatagaaaaagttgccttgccaactaatacgacctcatcgagacctcggactgagtgttgtagtgatgcaggtgactctcctttgaaacctgtcagctgtccaaaatctaaagcatcagacaagcggagtttacttccacatcagatcagtcagatatatgacgaattatttcagatacatctgaaattgcagtgtgaaactgcagcacaacagaaatttgctgaagaacttcaaaagcgagaacgttttttacttgaaagagaacaactgcttttcagacatgaaaatgccttgagtaaaattaaaggtgttgaagaagaggttcttacaagatttcaaattataaaagagcagcatgatgcagaagttgaacacttaaccgaagttcttaaggaaaagaataaagaaaccaagagactgaggtcctcttttgatgcattgaaagaattgaatgataccttaaaaaaacagttaaatgaagcaagtgaagaaaacaggaagatagacattcaggctaaaagagttcaagcacgtttagataatttacagaggaagtacgagtttatgacaatacagagattgaaaggaagttcccatgctgttc

SEQ ID NO: 22038 - DNA, 1183 bp, Homo sapiens
gcactgttgatttgttttgcagaatccttgcagcctttcctggaagcctgtagcaactctttattttttcgtacttgctctgtgctgcttcgagcccctaagcttgatcttcaaatactagaaaaactcagtattattttacagaaactttccaaaatcaagagtaataagaagctctttgaactttttacgattcatctgatgcttcaagaaatacaaaggacaacaaacccagagcatgcatttctctgtattaatctaaattcaactctgttcaatctgggtttaacaaaatgtaactccctggtctccagtgcaagcccttagactggctaattttttaatatagtatatgtggtgcttatttataaacatgtagaaattaccaaagtaactacaattctaccaagtaaagttatcagtagcatcatttatcatgaaaaataaataatttttttgaactgtaaaaatgaaatctgtagaaggtattggaacttttggaatgtttcagttcaggtaaggtagtactaatatacaagatggcgtttctagaatgtatgacactgaagtgactttttgtaaaaatatattaggaaaattatttcttaaaattatgtgaatatttggaataaaattggtgcttatgtgagaacagggttaaataatactgtctttctattttcctaatatattagaatccttgcttttgaaagcaaaaatgtatatctttaaactatcatcttgataccataacttttctatatactgtatcctagattaacagatgttgattttttttttattgtgctctttgtgggatagaaaaagttttttattatgctgttcacaggtttaaaaacttttgttttcaaaataattattactggagcatgtatatacaaggcaagacattttttaaacattgaaaggtaaacaaaaataatcgtcctgttaccagagatatctcttggtatagccaaagatgagtaaagtggccacaggtctgggtgaagtaaaggtggtaaaacttgggacttaggacaggatactgagaaacattgttttaaagagtcataaaatcatatatgatcagtgtataatctcagtttcaggagttagaagaaattttcaagaaactattgggcctcttcaaaaaaataccagaaaatgtgccatttttgaa

SEQ ID NO: 22039 - DNA, 1830 bp, Homo sapiens
  misc_feature (2)..(3): n is a, c, g, or t
gnnggggtttgatgaacgcggttcccggggagactggtacggttgctgtgtgctatggagccgagggtcgtcaagccaccggggcaggatttagtagtggagagtctcaaaagccgctacggactcgggggcagctgccccgacgaggtgatttggatatctactctggagataaagttggttcatcgttaaaatattctgatgaaagcaagcattgtagaacaccattgggcagcttattcaagcacgtaaatgtgaattgcctagatgatgaactggattctttccatgatttgaagaaacaggaaacagaagaagagttaattgaaaatgattatagagttagtacctcgaaaataaccaagcagtcttttaaagaaatagaaaaagttgccttgccaactaatacgacctcatcgagacctcggactgagtgttgtagtgatgcaggtgactctcctttgaaacctgtcagctgtccaaaatctaaagcatcagacaagcggagtttacttccacatcagatcagtcagatatatgacgaattatttcagatacatctgaaattgcagtgtgaaactgcagcacaacagaaatttgctgaagaacttcaaaagcgagaacgttttttacttgaaagagaacaactgcttttcagacatgaaaatgccttgagtaaaattaaaggtgttgaagaagaggttcttacaagatttcaaattataaaagagcagcatgatgcagaagttgaacacttaaccgaagttcttaaggaaaagaataaagaaaccaagagactgaggtcctcttttgatgcattgaaagaattgaatgataccttaaaaaaacagttaaatgaagcaagtgaagaaaacaggaagatagacattcaggctaaaagagttcaagcacgtttagataatttacagaggaagtacgagtttatgacaatacagagattgaaaggaagttcccatgctgttcatgaaatgaaaagtttaaaacaagaaaaagcaccagtttcaaaaacttacaaggtaccacttaatgggcaagtttatgaacttttaactgtcttcatggactggatttcggatcatcatcttagcaaagtgaaacatgaagaatctggaatggatggtaaaaaaccacaactcaaatttgcttcccagagaaatgatattcaggagaagtgtgtaaagaatccttgcagcctttcctggaagcctgtagcaactctttattttttcgtacttgctctgtgctgcttcgagcccctaagcttgatcttcaaatactagaaaaactcagtattattttacagaaactttccaaaatcaagagtaataagaagctctttgaactttttacgattcatctgatgcttcaagaaatacaaaggacaacaaacccagagcatgcatttctctgtattaatctaaattcaactctgttcaatctgggtttaacaaaatgtaactccctggtctccagtgcaagcccttagactggctaattttttaatatagtatatgtggtgcttatttataaacatgtagaaattaccaaagtaactacaattctaccaagtaaagttatcagtagcatcatttatcatgaaaaataaataatttttttgaactgtaaaaatgaaatctgtagaaggtattggaacttttggaatgtttcagttcaggtaaggtagtactaatatacaagatggcgtttctagaatgtatgacactgaagtgactttttgtaaaaatatattaggaaaattatttcttaaaattatgtgaatatttggaataaaattggtgcttatgtgag

SEQ ID NO: 22040 - DNA, 1943 bp, Homo sapiens
  misc_feature (2)..(3): n is a, c, g, or t
gnnggggtttgatgaacgcggttcccggggagactggtacggttgctgtgtgctatggagccgagggtcgtcaagccaccggggcaggatttagtagtggagagtctcaaaagccgctacggactcgggggcagctgccccgacgagtatgatttttcaaatttttatcagtctaagtataagagaagaactctaacctccccaggtgatttggatatctactctggagataaagttggttcatcgttaaaatattctgatgaaagcaagcattgtagaacaccattgggcagcttattcaagcacgtaaatgtgaattgcctagatgatgaactggattctttccatgatttgaagaaacaggaaacagaagaagagttaattgaaaatgattatagagttagtacctcgaaaataaccaagcagtcttttaaagaaatagaaaaagttgccttgccaactaatacgacctcatcgagacctcggactgagtgttgtagtgatgcaggtgactctcctttgaaacctgtcagctgtccaaaatctaaagcatcagacaagcggagtttacttccacatcagatcagtcagatatatgacgaattatttcagatacatctgaaattgcagtgtgaaactgcagcacaacagaaatttgctgaagaacttcaaaagcgagaacgttttttacttgaaagagaacaactgcttttcagacatgaaaatgccttgagtaaaattaaaggtgttgaagaagaggttcttacaagatttcaaattataaaagagcagcatgatgcagaagttgaacacttaaccgaagttcttaaggaaaagaataaagaaaccaagagactgaggtcctcttttgatgcattgaaagaattgaatgataccttaaaaaaacagttaaatgaagcaagtgaagaaaacaggaagatagacattcaggctaaaagagttcaagcacgtttagataatttacagaggaagtacgagtttatgacaatacagagattgaaaggaagttcccatgctgttcatgaaatgaaaagtttaaaacaagaaaaagcaccagtttcaaaaacttacaaggtaccacttaatgggcaagtttatgaacttttaactgtcttcatggactggatttcggatcatcatcttagcaaagtgaaacatgaagaatctggaatggatggtaaaaaaccacaactcaaatttgcttcccagagaaatgatattcaggagaagtgtgtaaaggtttgttttttaatttgaaatatgtgattcagaatatatgaagattaaaaaaggaaaagccagggccaggcacagtggctcacgtctataatcccatcactttgggagttcgagctgggcagatcacctgaggtcaggagtttaagaccagcctgggcaacgtggtgcaaccccgtctctaccagaagaaataaaaaagaaaataagaaaaaagttgttgtgggcggtaggacgaagaaaagtttactacgacctggtgtggggggcgcggccccgtgaagtctattaagaatggctgtaaggtgtccaaaggaaacgggtgccgacgaagcggggctgcggttccaccccaggaaaaaaccgcgcgcgtggaccaccggcttgttgggtacaactgcagttgtggggtcgggaagggccagcaggagcgctcaacaaaggagggagcacggggaaagcgataatacggcgccgcgggggaagagaagttccacagcgtaagcctgcgataaaccaacgggtgcaacgcagtcccgactcataaaaaaaccaactcacgacacacaccagcttagaaaacacacaacagagccttggaggaacagcaatcaacaacgagaacacagaataccaacccgctcttagagaaaacggccaaaaaaagcatcggagacagttaacac

SEQ ID NO: 22041 - DNA, 809 bp, Homo sapiens
gatccccggccactctagtcagtggaatggaccctatttgtactcttaaaggggagtcattttcttataataagtatcagtagtagctctattgtttgctgtgatcaatggtgacaccttgactttatgtattgccatttatcaatcatttattcagtgaagatttattgaccattgactttattatggttggtgaaataatcgcaagaaaatttattcagttaggtatttataaaaatacctaggtattaaatgaagattgttctagttgatataagcaataaagcctgactatatggctcctaccctcaagaatcttacggtatagtagggatgatgaaatagtgtaagaatgatttatatgtgccagagtacatgacagagtttttactgtcttgaagagctacagagttcagaagagaaggggcttagtgaggaaaagttttgtgggagaagtagaattcaagttgaatactaaagaacttcagtaagtacagataaaatggagtgtattctaggcagtggaatggacaaaaaaatgaaaacatggacatataatgaacttgacatactcataaattggtgaagaaagtattagattatagatctacattttgaggaatgctgagtatgaggcagggagctttgagtttcatgtaagagaaggtaagatataaacaggaatacaatgataaattgggctgaaatgtagatttcctgactcccaattcttctccttagtgtagacagagatatacagtcatgcactgtataagaacgttttggtgaatgacagattgcatatacaa

SEQ ID NO: 22042 - DNA, 454 bp, Homo sapiens
agactatagagttgaccttaagatcatactatggaatgagttaagattttgggggctgttaggatgtaattaatatattttgcatgtgagaaggacatgaatttgctgtggccaggggtggaatgctatagcctgaatgtttgtttcctccgacccaccgaattcaaatgttaaaattctaaccctcagtgtgagggttattaggaggtgggacttcgaggggatgattaggtcaagagggttgtatcctaatgaatgtgattagtgcccttataaaagagaccctggagagctcccttgtcgctttcattatgcgagaacacaggaagaaggtggccatctatgaaccaggaaatgggtcctcaccagacaccaaatctgctagtgacttgatcctagacttcccagcctccagaactgtgagaataaatatctattgtttgtaagccatcca

SEQ ID NO: 22043 - DNA, 297 bp, Homo sapiens
gagctatcctcagaagggtaacagtgtctgatattgaacaaaggactaaaaaagaccaggtgatagatacctgcaggtctgaggcaagtacttgtctgttatggcaggatggaaagcaggggttactcacctggagagcttgctaatacactggtcctaatcctaatccccaaggtaaaggcaaactctccaggatgggctgttgggagaaagagtgtgtgtttaaacttcttaagcgattttacggagcactcagtggtttaaagaccattggagtagagaactgaaaactcaaat

SEQ ID NO: 22044 - DNA, 237 bp, Homo sapiens
tcctaatctcatccacttgagtcattgaatgagatgaacttagtttgccacttacctaaagtcagcctcttccttttctacatttacctacatttctttctagcactctcctagtctctaatctctccctctaccaaactctgtaaacatagctggatttgataaactcatttaaactaaagtaaaaagggtcggtaaaactgccacatctattctttaagtagcctttccacttca

SEQ ID NO: 22045 - DNA, 952 bp, Homo sapiens
cactctggtggcaaatcctgtcagttctggtcctgtctctgcctctgccatggccttcattgaggagggttaggggatttggtggcagcaggagcacactgctgatcccagaagcatagggttaagaactaactgccttgaatacgatcttagtgattttcagtggagccaaggagtttgaaatgcataggcaatgtaacttcatcaaacttcaaagagccaagcttgataatctttcagggttgtgagaaaaggatgagaaaggattgtagaggacatgggttagagagagcgagctggtttagcagaattgttgtgaggattaaagataaatattggtgggcatgtttgtatctatctctagaagaaactagagtccattctctgtttaccatattgtcaggcctaactaacatttttcactttttggtatcagttactagtaaagtgcctcatggttagtgtaaaccttcagcagcctgccgtgcttactcacctccacttgcaggaggcaggtgtgtctttattttgcttgctgagtccctgctattaaattgtcacttgcgcttggttctttatatgtgttacttttaactctttattccttctagatgagtgtgaggtagtcatcttgagatgaagcagctgggaagcagggaggcagtctggccatagcggttaggaagagggtcattaaggtggtcagaagtgggatagaaccttggtttgaccactgactagctgtctgaccttgggcaaattatctcacctttctaagctccagtttcttcacatgtaaaatgagaatcatactaaaattatcccggccgggtgcagtggctcatgcctgtagtcccagcatttatcactttgggaggccgaggcaagcagatcacctgaggtcaggagttcaagaccagccttgccaacatggtgaaaccccatctctcca

SEQ ID NO: 22046 - DNA, 526 bp, Homo sapiens
aggggagttttgtagtcctttgttgtaaaatcttggaatgttaaacctccaggtccaccgtcttacctgacagctaaggaaattaagctcagactagagaaatgatttactcaagaccacatgggaagtaaattagtggattgacactcctggctccagtgtcactccttgaagttttaaagcctacctgatctgaaaatcactccctttccctgccctccttgtcctttggtgaaaatgtaaaaaaccagggcactcaggcaaggagggataaagtgaggagcttgatcatgtcataaccaagctttggtgcctgcaaagctcatttattgggcagcaggacctactcatgtccctctgccagctgctgttctggtagaatataaaacaaatgtgtttggctgggcacagtggctcacgcctgtaatcctagcactttgagaggccaaggcagtggatcacttgaggccaggagttcaagaccagcctggccaacatagcaaaaccccatctctacttcaaaaaa

SEQ ID NO: 22047 - DNA, 481 bp, Homo sapiens
gttattcattgttgaaggttgaattgtgttcccctaaaagatgtgttgaagtcttaacccctggtacctgtgaatgtagctttatttggaaataaggtttgtgcagatgtaagcaagttaagatgaggtcatattgaattagggtgaaccctagagccaatgactaatgtccttataaggagagatttgcagacacagaagcggcacagagaaggccattgtgaagatcaaggcagaaaccggagttatggcatcataagccaaggaatgccaaggattgctggcaaccacctgatgttagaagagtcgaggacatgttcttctccagagcttttggatggtgtgtggccctgccaacctttacattttggacttccagcctccgaaatggtgagagattaaatttctgttgttttaagctacccagtttatggttatttgttacaacagccctaggtagctactacaccagtgaaaccat

SEQ ID NO: 22048 - DNA, 510 bp, Homo sapiens
tagtgatctcacctggcatcgaccttgctgatagggatcttaagccgggcagcgacttcctctgccgtctcagtgccttctgagatgatgcccacacccttggcaatggccttagctgtaatgggatgatctcctgttaccatgatcacctgggttgggaaggagagggaagaggagcagaatcatcttcagagcccggatccttcatttttctcctctgagaactgacagaccactgcttttttcaacaagggttttagtcgctcattcccaagaacttgtggtgtagaccaaaaaccatgctactgtgatttcaacccttgggagtgggtcaagaccatgagaccataaaacaggacaatttgggtcctagatttaccaggaataagccagagatttgactatattcagaatttcatttaattgctccagaagctattctgcttccttaagtgcaaagacagaaacacctacacatagaacaagtggtaataaaggaatgtctggaat

SEQ ID NO: 22049 - DNA, 3861 bp, Homo sapiens
gggggtgggcggagtcctctcgcaacatccgccaggtagcttcttagttgctgcccctagctctaggagctcctgagtgcacacgccgtacccgtcccttgtcgggaatcctgtcgcaggtttttaagcaacagtcctcaggagggccaagggagtctgacggtgatgtcttcccccaggctcattcccctgtggaaagatttaaaactcctcctaaatgacaccataaataaaagcaagcaaccttcggaagacccaaagaactgcctgattgtgctgagtgaccggtcccaggcactgttcaaagagtctcgctatcctcaaaatatgccgtgtgtatgctattacttcagtgatgcccacttcttcgcctccctctcttgggtgacatcaaacacaaaagaaatacaagctgtagcatggatgaagagcaaaactgaggacatggttgagaaaagaacattctccatgactgaacgattgccacccatccagtccatggtccatgcaggctcctttcatatcctcgtggtctactgtggtgacctgatcctgcgactctttggggaccactttcgggcattcaaacccctgggtaaagtgccctgccgcttcaacatcagctgcctctgctatgacccggaaatgaagatgcttcttgtctggcatcctgggggcagtggtgtcctgggtcattgagctaggtggcacgggcctccaaatagcccacatggtctccatgccaggtgatgagcttgtccaggacatcgtgctgaatggtcccagtggctccctcctggccctgtgtgagacggtggtgagggtccttatgcaccagggcaagggccagctgggagaggtaaagaggttcacgtccaccagcagcggctcctccatcacctgctgcttcacctgttttgatcagggctttctctatgctggaaaccaagctggggaaacccaagtttggagcctccagcagggccatccactccacagtttccaggcccatcaatcaggagtgatctgtatccgcagccgaccagaggcccacaccctgctaacagctggtagtgacagcctaatcaaggagtggaacctgacttcagggagcctgcttcggcggctagagcttggtgaggagctataccggctccagtttattgacagcattactttcttctgccaaactgcccatagtttttccttgcaccgcctgccctgcttctacagcctcttcaatgtctgtggctctgctccccagcagttgcgtcgggtctgctgtggaaataactggttccggatcctgtgtaccactgaggatggcttgttgcgctttgtgtccccagtaacaggggaccttctggttatcacctggcccttctcaatcctggaccaggctgtggattgggcctacgacccaggtaaagaggagctctttgtagcaacaggcagctcagaggttctggtatttgacacaacccgctgcccttgcccagccaagtatctcttaggcacctcaccaaattctcaggactttgtacaatgcctggcttatgggcatttcaacttggggcggggtctagagggactgatattctctgggcaccagagtggtgtgataagagtgctctcccagcacagctgtgctcgattagaaaaattcatgcactttggcgctgtactggcactctccacgctgtctggagggatttttggtggccaaggaaactctctgctctgttcctatggaatggatgactatgtgcacctgtcagaagctgtgcttgatggggtcaaagtacaactgcggcctctcgccagcattctcagcagctgtcacctaacacatctgatactcttgccccagtctgtaggtgccatcacagagacaaactgcctgcgtctctggaagttccatgattttctgtcctctgggtcacagaatggcttgaaattcatagaaacactgcccctgcacctgtgtgccatcacatcctttgatgtctgcctctccttgagtctttttgtcacaggttctgccgatggctctgttcggatctgggacttccatggcagactcatagccattctggactcatcactgcactttggcccagtctgttttgcaaatgaccggggtgacctgcttgtgacttttaaccagagtctttacctagtgtcctgtttaaaattgcttcccccagccctgctgactcgcctttcctttatgagcatatcagatgaagtactggaagtccctaagcctttcataccaagcttcttcttctcctttgagaccatgtttgtgcccaagtacatctaccctggacaagcgcaacagaaattagtgggtctggagaaacttgtcaacaaccgggccattgcctttgaccattctgtgccacatgtgatagaagaagatgaggaagggagcccagtgttactgcgttcctccatgcattattctttgcaggacatggaagattggatgcaggtgagcaaacgttaccaatgccattatgtgcttcctccccagctacaactgactagctgggatggactcaacccctatcagatattgcgatactactttggtcatgggcgggaatggctttttgcccctgactgctatatccccaattcagtgattcgtgcccgtctttggccagagggcaccccaatatacctacagtgcaacctgcatgcaccccagcgggagctggaatggaacagttctcaggattctttttctgacacagcagggtaagagctataagtaatacagaatatccaaagaataaggaggaggatgaacacttcctagaaatgagactttccaaggatgtaacctacagtgtccttacagatggagcaaaccgaagttggctgggaagaaagatgagtgaaataaccattaatagcatgattgagacaatgctcaatattatggtccatgcttccttgctgaagtaccagtgctgtgttggtgcactagggcaaatctttgcctcttaccaggtgtccccagccctacgctctgagacagcccgtcggctactgaatgatacaaccaattccaacccgctgatccgaggactagcttgggaagggctgaagcgtctaggaatgattactcatctttttgccatgcctctggctcaaggattaatggacaaggatgaaagagtgaggatcaagaccctaagcctcatggctgagattggaatccactctaggacctcactcttacagctgacccaaaaacaagagacttttcgggagatgcagcagcagatgatcggggaggaacccctggaccatctactggggatgcgggccacagatctccaaatcctttccactcaagtggagcagagattgaatgaaaacctgaccctgtcacatagagatgaaaagccggctttttctttagatgtctcaatgccttctgaacttaaatcctccctgaaacctcctacagtttctgaagaatctgaagtggccatcaagcccagcaaaggccaaagacgaggccaagcaggggtcaaaaagcatagccaaaaatggttgcggggtctcaagaagacgaaagagagagactctaaacagatgagcacagagccaggcctcttagaggatgaaagtgggactgaggccgcaccattgagatggaggaagcatccgtctattcccaagtggtcttcaagcaccagtgtaataaagctctcaaaagatgttgattctcaagagaaagatatctcgaaggatcacattgcattgaccctgaagaggctgcagaaaatacgtgacaaaagagacaagaaagcaacagctcagaaactcaaaaagaagcacaaa

SEQ ID NO: 22050 - DNA, 293 bp, Homo sapiens
tctaaacggccagatagtaaatattttagcctttgcctaaaatacagtctctaacttctatttagctctgcccttctagggaaagcagccatagataatatgtaaatgaatggacacagctctcccaggttggagtgcagtgacgagatctcagctcactgcaacctccacctcccaggagaatcgcttgaacctgggaggtggtggaggttgtagtgacccaggatcatgccattgtactccagcctaggtgacaagagcgaggctccatctcaaaaaaaaaaaaaaaaaaa

SEQ ID NO: 22051 - DNA, 391 bp, Homo sapiens
ctggagtagaaaatctttcacacataaaacttcaccattagctaagataaattcctttttgtgtggaataacatgattgtaaatataaactgcatttcacaaataacatggatttgaaatacttctcaatgtttgagtcatttacaaactgtgtaaactgagacctggagaccatctaaatcaaaatcctgagtggaacagtattcaaggtaggctttggggacagttcccccaaatgttacactgtttcagtagtgttggtacccatctataatacaaattgttttaaaaataagttttattgtgtatatatcaggtatattacatgatgttatgggacacatatagatagtcaaaatggttactatagtgaagcaaataaacatttcca

SEQ ID NO: 22052 - DNA, 228 bp, Homo sapiens
caacaggcttttcctagaagatggaattagctgaacagcccctgcagtctactgtttgcacctaaggaagctgctttacattttgattttgttgtatatcagaagactggctgacacaaaacaagaaggcttatcttatagcctctgatatgtcctgttacttcctgctgccaggaaaatgcttaagacagcatgttaatttaggagggattttcaaaactatacggt

SEQ ID NO: 22053 - DNA, 418 bp, Homo sapiens
tcgtctatagattcaatgcagtcccaatccaaatcccagtaagttgttttgtgggtattgacaaacattttaaagtttatatggagaggcaaaaagacccagaatagccaactcaatattgattgagaacaacaaagtcacaggattgacactacctttcttcaaggcatactataaagctacagtaatcaagaaagtgtgatattagcaaaagaacagacttacagcaactgttcttattagcaaaggaacagtttacagcaaaactgtaaaacttagaggataacatgggagaaaatgtagatgaccttctgtttggcgatgacttcttagttgcaacaccaaaggcatgaaccatagacgaaataattgataatctttacttcattaaaattaaaaattttgctttgtgaaagac

SEQ ID NO: 22054 - DNA, 526 bp, Homo sapiens
taaaaaattatttgttgattttctgaaatttaaatttaactgggcgtgctggttcattggtttgtttgttgctaaatctggcaactttactcccaccacatccactagtcattttttggcagaacactttgctgaggatttgactactccaaaaccccacaaatcagctggaccactggttaaagattagttctgtcttctggtcttttcttggcatcccatatccataagggagaaccaccctactcatgactccaagatcatttgtgaatcccaggagacatctatgttggtaccaatttattaggtaccaatactgaactcatctataaatgtaaattggcctacatggtatccccaaaagacaaggaaaactgaaaacgatcagcagattgaacaaaagagacctgacagaaaagaaagaaaaatggaatcactgagattcaaaggcaactacattgctaaaataaggccaggattccaagcaatgaaagaaatttgagaggaaaaatatgtattagaagta

SEQ ID NO: 22055 - DNA, 364 bp, Homo sapiens
tataggttcctctacaccttaaaagtagttaagagattcacctttccataatttggaatcactaagcatcagtctgtccactagagaagagttttcaccatctggcccttcttgtaaaccaacttgacataaaatccggcgaaggccatctttaaatagaaggaaaggtagaatgagatagcaacttcaaatattaaaatagtgacattttagtagatgttcaaatggatctgtagagttttaaatgttttcttaaagttcaaatttattcagaaaaggcaaacatattaactgttttattaatattttaacaaaaaggaaataaatttcaaatctcacatcacacaccattactcctgaaagt

SEQ ID NO: 22056 - DNA, 436 bp, Homo sapiens
ttataataggcagtcttcctcttattcaccaggggattccatccctctgattcaggaccatggtatatggaatcgccctgccttctcatcttcagcctctcgctgtacaggatccatcctcttagcactttttttcctcttagtaaactattgctgtgtaacacagagaaatactcatagctctgatcacaaatctgagtcagatgcctcttgaagaatggacttctgaggagcaccgtactcgccccagcacagctctcacacaggagtttgctgaaagtctcctgcctgtgtgcctcccagtatgagctctgtgagggccgtaaccccagggtataagtaactcaactagaatatgtgcaatacacttctctgtgtcctgatgttaaacttaaaatgaaatagttttcagaataaaaataaatttgtatatatt

SEQ ID NO: 22057 - DNA, 518 bp, Homo sapiens
cataatcatgaatatatgaaaaaaccttttttatgtgagaacatataacttatttaaactacttcaaatgcttttgaaaaatttcaggagatttttattcaaatataaaaatacagaaattgataaatgccagagcattaaagatatattaaatagtgaaagaaaaatattgtttttaacaatacctgagataaattacatgtttgtagaactatgttctatgatcaattataaatttttactgaatcttaaatgccagaattgagatataaattgctcctactacaatttcaaatttcgaagacatgttatttattgtcttatatcttacatgatccttttttctcaaatggtaatgaatggccagacacaggtatttcatttacaaagcaagcaggataatcataacgcaggatattacacttccactcttgattgtttcttcaaggcaagcttttctaggttatgagaagtgcactttcaaattaagtcaattacactgtagcttctagttaagc

SEQ ID NO: 22058 - DNA, 411 bp, Homo sapiens
cccggatgatggagagcagtcctgtctgggtggaaacgtttactgggttaacacatttttcctgccgcggtctttctgagggctgtaatattcctgcctgtctgtgtaggccccataccagcttggccactgtggggtcacttggaaagggagcctttcggcaggcctcccctcccactgggaggatgcttcagtccctctgcactcagacgtgttggaagcacattccacacgcagagtgtgtctcttctcccggctgctcctgctgctggcctgggacagaggagcctgttccatggcagggggtcctgagtgctgccacttgtagtatcgtggggaggctgctcggctcccagcctctctcatgcccactgcccatgggctgcactgacagatgtgtctcctcacttc

SEQ ID NO: 22059 - DNA, 170 bp, Homo sapiens
cttgacttgccttagcgtgagctgcagacagtctgcgaagaatctcccacctgtgctcatctcttgctccgggattcccctgagcaactgttctagggcctatgagggccacatggaaagatggtctggggtattaagattacaggccagaggccaactgtctagcatca

SEQ ID NO: 22060 - DNA, 235 bp, Homo sapiens
cactgggagagtcccactaaggggagccccatccctgtaaacaaacttgttcaagtccctatcactgaggccccctccctttggctggggagtgcttcctgcttcctctcccacaaatgccaaaggatgcagcagattgaggcactggggagaaagtgcccagcctgggagattgtgaagtggagtgcaaagccttacctgctagtagaggaccatgggaccttggtcagtttca

SEQ ID NO: 22061 - DNA, 824 bp, Homo sapiens
ctcctaatctgacacttctttcatgtggaccagggatctgaactgtgtttcttccaaacttttggagcttgcttccttggtggtaagctaaatagtggcccccaaaatatacccctttataacccctgtaacctgtgaatattatatgacataatggactttgcacatgtaattaaattaaggatcttgagatgaggggattatcctagattatctgggtggacccctaaatgcaatcccaagtgtccttatgagtgggggccagagagagagattggacacaggagaaggaggcaatgtgactactgcagcaagatgctacactgctggctttggaggtggaagagaaggccaaaaatgcaacgaacgtagctttggaagctggaaaaggcaaggaaactgttttcccttagaacctctggaggaagtgtgccctgccaacacactgattttagcccagtgaaactaattttgaatttctgacctctagaactgtaagagaataaatgtgttttgttttaagtcgctaagtttgtggtaatgtggtaatttgttacagtgcagtaggaaactaatacagggctcatctgcctccaggtacaagtggtggcttggctgatccctgttcttattttaaggcgtccctctcatggcacaaggagagcataggcccagcattttcctgaaccagtatttgaaacaatctgcactttgggggaacctgttggggagttcttggaagcaagagagaaagcctcatatggtacccgatccttgctttggaactctcccagcaccttcagtgatatcatgaacaaagagtt

SEQ ID NO: 22062 - DNA, 434 bp, Homo sapiens
aaatgccacttcatacccaccaggacggctataataaaaaagatggaaaataacaagtttgggccaggatgtagaaaattggaaccctcaaatattactagtgggaatgcaaaataatatagccacttttgaaaataatacagcagttcctcaaaaagtaagtatagttaccatataatccagcaattccacttctaggtataacccacaaaaactgaaaacaattttcagttcttttatgtccacacaaaaacttgtatatgaatggtattcataatggccaaaaaatgggaaacccaaatgtctatcgattaatggatggataaatgaaatgaaatggaatattattcaaccataaaaaaagtactgaaatatgttactatactgataaacttgagtatggattatgctaagtgacagatgctatacactaa

SEQ ID NO: 22063 - DNA, 393 bp, Homo sapiens
tggattacatcacacattgaacagcaaaacttaattcaaagccttgccattacaaggctatgagctgagctgtgtcctccaaattcacatgttgaagccctatcttccaatgtgatggtatttggaggtgggacctttgtaaggtaattaagtttggatgaggtcatgagggtggccctcatgatgggatgattgtcctcataagaagaaacatgagagagcttgcttcttcactttctaatatgtgaggacacagagaggaggcagctgtctccaaacaagaaggaaaacttttattggggaactgaatttgctggcaccttgatcttgaacttggccaattccagagccaagagaaataaatttctgttgtttaagccacctagactatgg

SEQ ID NO: 22064 - DNA, 377 bp, Homo sapiens
gggttgtgagagactcagctccccagtcttgctttaaaaccttgctgtgaaactttttgctgggaattcaaggccaagtgtctgaccctggaaacgtcctttgatggagtgccccaagtgaatgacttctcatggctcagtcacatttgccacgcagctgagctgggcacgtggccagaagtccctgcagtttcctttggggatgactggtgtctttccctgggggttgaatttcctgggcctttgcttattaattttattttaaaatacggaattataggcaaagcagtcatttaaaatgcaaatcccctaaacacttcctggaacaaagaaccacaccatcttctccatggtgtctccgtccttctttgtaccct

SEQ ID NO: 22065 - DNA, 499 bp, Homo sapiens
agaccttcttcagaagggtctttgtcttagctgtgtgtagggagggtttttagacctagaatctcacaactagacttgagaaaatcgattaatgaacaatgcaccggaggacgtgtccctgtacctaggagtattcctgctactgacaccgcgtgacgctggctctggttttccttggagtctcctcccatgttggaggtgtgtcccatcttgtgataagaacctgggcttctgccaaggaggggtgtggtcccaatgaagccacccaggaaagcaccttgcttagtcagtctggggcttatttgccagaagcatatcagtcctgacattgctccctggggtggccctaggacccgagagcagaagcaggaaggaggatagaaagaggccatgccgacccccttcccctttgtccctcttttcctcagcctccatagagagggtgccccctcttccagcccttgactggtgctggtccatgattcagaggaattctgga

SEQ ID NO: 22066 - DNA, 446 bp, Homo sapiens
ctgccccccagtattgcaggcctgacccctggcctttgtgagaacccttgttcagtaatggaggaaaagctgaggccagatgttgaggggccttcccgcatctgatatgtgccccctaaattggtgtgatacccacagccagcaaagaccctctctggattacagggttgatgctggtcccacactaccaaggacagaggtcacctgcaattgagcctttgatccacaggagagggctggttgcattggcctttgacctctccccaggcttggctcaaaatggtcaaactttgagccttttggtgtgaaggtcccctggtcgttactgcccttttattaagactcataactgggggccggacgcggtggctcacgcttgtaatcccagcactttgggaggccaaggcgggcagatcacttgaggccaggtgtttgagaccagcctg

SEQ ID NO: 22067 - DNA, 774 bp, Homo sapiens
ctgaaggacatgatactggccgagactgggttccctttttcactgaattagcttggacttcaaagcaatatcttaacaaagaatatgggccctagtacaacttctgactgtagcttagcctttttacttatttttaggtaataaggtgcatttttagagcttcaaatcttaggcaacatgtaaaaataatgaaaaacctttttttttcttaaatgaggactttgtctatatctgagctgtgaagaatatttacagtaaaaagaaacagtaagtgcaatttttaagaaaattttttaagtgaatttctgattagtgatttaaattgtatatttaatttgattaatgtcatattacctcaggggtcatattttttgtttctttgttgtatattctgaggactgtgctttggtgcacccgagatagatgtggctcttgattgtcagaggaagaagacttaatatgtcaataccactaaattgaaatggcagtgtctgtcttttcatgttcatatcagcttcagtgtcattccatcggtgttgtttcagaaacttcttcctctgttttcctgacatatcacatgttcaggttactatctttagggtatgagaatagttttagtggcaaggataaaaatgatttcaagaatactacccaaaataaaacctggtatttgggcatacacagttgtcttccctgttttccctgtactttctccttcccccgtctcctttgtctccttacccctcctttccctctatctcagatgtatgcaca

SEQ ID NO: 22068 - DNA, 563 bp, Homo sapiens
aggggagctcagggtaatggagtatcctcaagaacctgcagatattacctccctccagaaccgtggtctcagccctggctgcatattccttcaacgggagggctttagaaatgctgtgccagagctgcaccccagaccaacaaaatcagactctccaggatgcggccaaggcatcagtatgtggaaagctttcaggaaaactgagcaaaatgaaagccaattcaaagaagaaggaattaagtacataattgtgcagatgatacatggaaatggtaagaatggtgacaatgggacgtaagtgactgaaatttgggatacattggattagaagaaaataagcccccaagaaaccggaataagtctggagggcagcaagagtgactgtccagctaagaacctcatcagcaatacaaaacattgtcacagatgttgaaacagaccctgaggttaatgcattctttccaacattaggtcctaaaacttctcctgaaaagctaccttaaatctaacttttgaaagtgcacaataaaggtgaattaaataaaagcaacttgaaattttta

SEQ ID NO: 22069 - DNA, 651 bp, Homo sapiens
aggggagctcagggtaatggagtatcctcaagaacctgcagatattacctccctccagaaccgtggtctcagccctggctgcatattccttcaacgggagggctttagaaatgctgtgccagagctgcaccccagaccaacaaaatcagactctccaggatgcggccaaggcatcagtatgtggaaagctttcaggaaaactgagcaaaatgaaagccaattcaaagaagaaggaattaagtacataattgtgcagatgatacatggaaatggtaagaatggtgacaatgggacgtaagtgactgaaatttgggatacattggattagaagaaaataagcccccaagaaaccggtaagaaggatattgcaacagcacgagagattttaaactccttgatatcagaaagacttatcttctattaattttgttttcctctcaggaataagtctggagggcagcaagagtgactgtccagctaagaacctcatcagcaatacaaaacattgtcacagatgttgaaacagaccctgaggttaatgcattctttccaacattaggtcctaaaacttctcctgaaaagctaccttaaatctaacttttgaaagtgcacaataaaggtgaattaaataaaagcaacttgaaattttta

SEQ ID NO: 22070 - DNA, 393 bp, Homo sapiens
ccaaggcagggacaggacgcagccgtcctcatgcatatggggctgtggccgggccagctcctgcagccccagtgggaggcagggcagccctgaggttagagcccgggcccaaagcgcaccttcaaggccatgcctcttcctgctgtgtgactctggacactcacataacctctctgagtgcaccttcaaggacatgccccttcttgctatgtgaccctggacactcaacctccctgggccacacttcctctgctggaaactaggggctcttatgatgaaggagggatcacctcgcccctcccccgggactagtggcatagtggacactcgacagctatcgcctttgctattctgtcttccccggacgggtgttcgagagcaagtgagttctga

SEQ ID NO: 22071 - DNA, 622 bp, Homo sapiens
accatatatgggacaggtgctcataaaacattgaattggttgacactgatcttgtacttcccagcccctagaactgtgaggaataaatttctgttttttataaattacccagtctcaggtattttgatatagcagcaggaatggactaagacacgttttttattcacaataaacatttagttatacttctgaattttaagaagaatgttttatatgttccacattaacattttattttaaaatatgtacaatgttttctgatttattcattactgaatctcaactgttaaatcaagtttaacttaaagctgcctccttaaatattttaagttcagcctaaaggtttctctgtacatagtgaactataacctaaatggagttgtcaacagactgagtctactcttgtgccgatcaccaagttttggccaattaaaggggtcagttcaaactgttcaaataaggtaaattctgtgctgtaaccagtctggctgtttctgttactcatttccgttttctgtatgtcactttcctttttctgtctgtaactcttcatccatcacgtggctgcactggagtctctctgagtctatcattctttgctcaattaaagtctgttaaatat

SEQ ID NO: 22072 - DNA, 498 bp, Homo sapiens
tctacttttttgcactagcgcgccttgtgttggtccccgaattcggccattatggccgggacttctgaattttaagaagaatgttttatatgttccacattaacattttattttaaaatatgtacaatgttttctgatttattcattactgaatctcaactgttaaatcaagtttaacttaaagctgcctccttaaatattttaagttcagcctaaaggtttctctgtacatagtgaactataacctaaatggagttgtcaacagactgagtctactcttgtgccgatcaccaagttttggccaattaaaggggtcagttcaaactgttcaaataaggtaaattctgtgctgtaaccagtctggctgtttctgttactcatttccgttttctgtatgtcactttcctttttctgtctgtaactcttcatccatcacgtggctgcactggagtctctctgagtctatcattctttgctcaattaaagtctgttaaatat

SEQ ID NO: 22073 - DNA, 535 bp, Homo sapiens
acgtaattgaagggagaagtacaattctacattaatagttggagactttaatatcccaatctcagtagtggatagaaccatcaaaatctaagcaaggaaatataggactttcacaacacaataaaccaactagatctaacaaccatatacagaacactctacccaacaatgaaatacacattcttctcaagtatacataggataaattccaagataggtcataaattaagtctgaattgattttaaaagacagcaaaatatcttccctgaccacaatgggatgaacttagaaatcaaaaacaaaaagaaaactggaaaatttaaaaatcatagaaattaacacactcttaaccattagatcaaaaaagaaaccacccggcattggttgaaaatcaccccccggctttggccatggcagcgggtgagattcggcgcccagagcctccaggggcctcagctcaccgcgcgctgacacatgtgcggcggtgaaacccagccccaacaggccccgcggcctctccctgggtgcggccgc

SEQ ID NO: 22074 - DNA, 1315 bp, Homo sapiens
tagcttcttcatcccttactcagccaccttctatcttctcaactcttgttctaccattaattgacttattctctcaatatttcttaagttcttaagagacactgtagtccattcatgtttttcatgtcagcacttagattggcttcccttgaattagggagcccagccctggttcccttggttatggttggaagaaaggggcgaagcatagtacatgatagcatagtccttggaggagggcctgcggaatggttgaattctgtatttgtcagcttgggctgccataacaaattgtttagaaaggtgtaaaccatagaaatttattttcatggtattggaggttgaaaggtctaagatcaaggtctggtagggttctgcttctgatgagggttttgtctgtggctcgcaggtggctaccttcttgtgtgctcatgtggcctttcctcagtgcttgcacatagacagtgagacagattttcctctcttcctctttctagaagaccaccaattctattggatcagaaccccacccttatatcctcatttaacattaactgtttcctaaaagacctgtttccaaaatcagtcacactggagttagggcttcaacataggaattttgggcaacacagttcattccatagcaacatcgtaaggtactatactcagctattcaaactctattagggcagacatttctagaatagtcacaacactgacatgttccttgtagtattaccatccatcagtaaccaaagcccggaaaggtgggatttatcctaaacccatcttccttacctccatattaccatgtcacagtacttacatctcttaactaatcttaatctagctcccattttcctttattttccttttcttctctagttttgaaaatgcctcttacctggcttctttatccatagcttctcttgatttttgtatgtcctccataccattgccagagtgatctttctaaagatcactttgccaaaataaacttctaattaaatctaaactctttaatggctgggtgcagtggccacacctataatcccagctctttgggaggcctaggtgggtggatcacttgaggtcaggagttcaagaccagcctgaccaacatggcaaaactgtgtctctactaaaattacaaaaaaaaaaaaattagccgggcgtggtggcaggtgcctgtaatctcagctactcaggaggctgaggcacgagaatagcttgaacctgggaggcggaggttgcagtgagccgagattgtgccactgtactccagcctgagtgacaaagtgagactccatctcaa

SEQ ID NO: 22075 - DNA, 446 bp, Homo sapiens
aacctgggaggcggaggatgcagtgagccaagatcatgccactgtactccagcctgtgtgacagagccagattgctggaccctgtctgaaaaacaaaaacaaaaaaaaccagtcacctaattattacatgtaattctaagtacattcgtcaaaatgaacacagcagtgctataaaaataatactccaggccaagcacggtggctcatgcctgtaatcccagcactttgggaggctgaggtgggcggatcatctgaagtcaggagttcaagaccagcctggccaacatggtgaaaccctctctctactaaaaatacaaaaattagctgggggtgatggcgggtgcctgtaataccagctacttgggaggctgaggcaggagaatggcttgaacctgggaggcagaggttgcagtgagccaagatcgtgccactgcactcgagcctgg

SEQ ID NO: 22076 - DNA, 365 bp, Homo sapiens
taaagaaaatgcatactaattttcttatcttgctcaagggaaggatatgcttattgattcagtctagatacaaggaaaaagtaagtttctgtaaatgttaaaaatttaagggtagctagtagaagaatagaaactgaattcatgacttccaaactactggagaaaaaaataatgtaaatctgatcaagaaaatatatgaaaagagggtttaaaaaatgaaacaacctagaattttggcaaaataagtgcataaaatatcaggtagttcaaatagattaataatctcagtaaatgtgactaattttgactaacaagactaacttcaacccaactctaaaggacagagcctttcaggtaatgttaaa

SEQ ID NO: 22077 - DNA, 409 bp, Homo sapiens
gtagtatcagccctacaacttgtttttctccttcaatattgtcatattctttcttcaataaatacttattgagtacttgtatttactcttctatgagaaatagcagtgattgtgacagacaacagttctgcattcatgaaatttatcatctagtggggtttattagttctacatgcacacattgacttttagtatttaataaatacaagcatgaaaataagtagaggtacattgcatattataaatctcctggttgaatgttagtgtatagtaacatattcatgtacatgtaagcatgtgtacatgaaagtgaaataaactaagtgccttgattttttaaaatgaactctaatgatattttctataatcttgtctccccttgctttctcagtattttatttaaaaaaaa

SEQ ID NO: 22078 - DNA, 631 bp, Homo sapiens
  misc_feature (619)..(619): n is a, c, g, or t
  misc_feature (625)..(625): n is a, c, g, or t
  misc_feature (628)..(628): n is a, c, g, or t
tctgtgatcttgcaacttttacattgaaaaatccgcctgcgtcaaggcatgagccaccgcgcccggccctcatatgccctggagctcacttataataaggtaaagagaaaaagggcctgggaaggcttccatcagaaaggtcacatgaccactccaggtggtgttgccttactgaagttaagcaaaagagagtttcagaaaggcagtcatggtgtcaactgttattgatttatatctgccaggattgctgcttcattaaagtagtatgaatggaaatctggtcacaaggtaaagatgggtaatggggaagtagaagtatggagtatggaacatgcatttgaaaggctggtagccaggtgcagtgactcacgcctgtaatcccagcactttgggaggccgaggcgggtcgatcatctgaggtcaggagttggagaccagcctggccaaaatggtgaaacctctctctactaaaaacacaaaaattagccgggcatggtggtgcacgcctgtgatcccagcttctcatgaggctgagacaggagaatcgcttgaacccaggacatggaggttgcagtgagctgagatcacgccactgcactccagcctgggcaacagagcncccccncgncaa

SEQ ID NO: 22079 - DNA, 242 bp, Homo sapiens
cacctgcatttgttattgctatttttttatacagtatttttaaaactgcatgtttcccagcctgggcaacatggcaaaaccttatctctacaaaaaatacaaaaattagccaggggtggtggcacgcacctgtagtcctagctatgcaggaggctgaagtgggaggatcgcttgaacctgggaagcagaggttgcagtgagctgagatcttgtctaggcgacagagcgagaccctgtttcag

SEQ ID NO: 22080 - DNA, 547 bp, Homo sapiens
ccagctaagaaaagctgatgttcacaacaaaatgaagagacttgactacccaggaaggtagacataagaggaaacagccacaaacagcacaggcatacaagtgtcttgcttcccaagcacaggcaggtttttgtgcccacacttcagggctcgtctgactgcactggctctgccaggcgctgcccagcttcctgcttcccctcccagtcctgcttcttctgtcagtaaaacaaaattttagagtgatgctttgcttgatgctttgggggctgcatttttatcacaagtgtggaaattgtactttgctctggtttctacagatgcctaaacatgtctaggttgctgttgccttggcaactggctgagctgttggttgtgtgtgtggtgaaggttctggcaggggcttcatggaagcctctggtcatccttagagcttttcagctaagctggcggttactcccaagcccagaaccatatgctcttagctcccctttgtcgtttggagcttcccattttatttccctgagaaatccctgctcagctgccc

SEQ ID NO: 22081 - DNA, 208 bp, Homo sapiens
cattcgttaaattttatcccacaacaatcctacaggtgggtcttattatttccattctacacgtgaagagtctgaggctcagaggtcagcctgccaaagtcacacacacagctggggagcttgctggactccacaggccacacatcttccatgagagcacactgcctctttgaaaataaagctgcagagcaaaaacactaacatttta

SEQ ID NO: 22082 - DNA, 545 bp, Homo sapiens
gtttctatcacattctgactccatctgcggcctcattaaggtgatagaaacatactaggaatgaggccgcagatggagtcagaatgtgaaattacaaataatcactggatccatctactgttttccatcaccttccccactgatgctctgggcgagagagtgatgtgtcacttcaactgtgtgtaatatgtcagacacgtcctacaataacaggcgtcatatttgtattatttttagtttactgtagaaaataatgtcaccgccaaaggtgatgagagtcacgttttgtaggatctgttttcttatacttaaagacagacttctgctacggtaattgccagtattcatggcttcctttctgtgtcagaagagaagggatctgctttctcttggctgatttcacatagcattggtaatagacatgcatttctctttctaaaggggagtaactttttaaacccttcctgattttagcctggcaatgtaagtgtccttaatgtgactgttttgataattaaaaaaaggtatataatttaaaaaaaaaa

SEQ ID NO: 22083 - DNA, 1307 bp, Homo sapiens
cggtgggcgcctgtaatcccagctacttgggaggctgaggcaggagaatctcttgaacctggaaggtggaggttgcaataagccgagatagtgccactgcactccagcctagataacagagcaagactctgtctcaaaaaacaacaacaacaacaacaaaacaattctatgactgaaagtgactaaaaagctggctttatgccattaacactctgtactttgcagccaatcagaactgacgcagtctgggtgctagctgcttcaaaagcaacccacaccacacttttaccatttccatacatcaactgctgagaatatgaaaatgcacagtgacaggttttaggatcctgcttcaggatttccttttcctggtttggtcactagagttggctatttatctgtttctaaacaatagctattttatcgaatagtttagagaccactattaaatattgtgactgatgaaggatctgtgaatttttttatatatgttctaagagttaccattttgataccttttaaaaaccagcagctttctactatattcatgtaagacagcatgaataaaaccattttttgatacagggttttatttggctttaaactcaggaaccaagttaattatgccagattgaactttgatttttactaccttttcaaagatattttaaaaagtggattactacatatgatttctttggagcttacatttctttacttcacgaattctatgtcactgttacaagtttccattctgatggcttctgggcctttgtacctttgtttttggtgccttattcctagtatgtttctatcaccttaatgaggccgcagatggagtcagaatgtgaaattacaaataatcactggatccatctactgttttccatcaccttccccactgatgctctgggcgagagagtgatgtgtcacttcaactgtgtgtaatatgtcagacacgtcctacaataacaggcgtcatatttgtattatttttagtttactgtagaaaataatgtcaccgccaaaggtgatgagagtcacgttttgtaggatctgttttcttatacttaaagacagacttctgctacggtaattgccagtattcatggcttcctttctgtgtcagaagagaagggatctgctttctcttggctgatttcacatagcattggtaatagacatgcatttctctttctaaaggggagtaactttttaaacccttcctgattttagcctggcaatgtaagtgtccttaatgtgactgttttgataattaaaaaaaggtatataatttaaaaaaaaaa

SEQ ID NO: 22084 - DNA, 385 bp, Homo sapiens
ggggctgcttttttccttagaaaaatagttttttataagtattagaattttgtacatttgaaccctgcttgcttatcaataatttcttggtaagccattatgaattaaccttgcaccaaggattaaagtctaaggactatactttatatctgtatttaagagacagagtccattcacttctctttcaatgcctcagaaatacataagtatcatgacctgtttaagattatttctgcctgctattcaaatttcaaagaattgtaatttaagcctctgtgctacattttatttaattactatttagtatgagcttcttttgagttcctgcaaagtagacatgtatcaagacatccaattactattggactggaaaatgctgtgactt

SEQ ID NO: 22085 - DNA, 252 bp, Homo sapiens
atctgctgttgtattgttgataaacaccattataccagtgatttaacttatgccctggaggaagaagtgccttctagaatctcttaatggccataaaacattggcgttgatagattttagaggcaggcagccttcaaggcattcaatgatgaaaataaagaaacatttgtgaaaattcagtgaagatttcagaggccctacaggaactaggagcttcataccaagttcacatttgagtctgagttcagtttt

SEQ ID NO: 22086 - DNA, 567 bp, Homo sapiens
accataccaaatgttggaaatgtagtaatgagtaggacatgtgtatatggtccgtacctgaaaggaagttattctagtaggagaggtgatctatcaacacataattacaacatgtgatatgagctgtgaacacttatgaacaaacagggtgctgtgtaaaagaataaaggaacaaagatctatgtataggagttttctggaaaatgtttggattcggcagtcattttcaaaggcagagggcattgatagcagtatcttaacatggaaaacattaaaactaactagatattagtattctatttccaattcaaaaataaccagaagatagtgatgttgttttgaatataggatgtcaatctttgtgttaataatgtgttttgaaaaagcaagacttaattgaaaatatacatcaaattataatttcagtgtattaaaaaactgcctgtttaaatatgtcctttctttgctgtaaattttggttaaaatctattggagttatgtccttgtggtgaagtacaccctacccccaagagagcaaatgatgaataaatcagtagatgttccatg

SEQ ID NO: 22087 - DNA, 394 bp, Homo sapiens
gtcatctgtatggtccattgaccctttatgctgctgggtgtttatctgcccagtgttctgaggtctgacatgctaacaaatctcagcatagtaacagtcacttgggctggcgcggggcgcacgcctgcaaccccagcaccttgggaggaagaggcaggaggaggatcacttgagcccaggagtttgcgaccagcctgagaagcatggtgaaaccccatctctactaaaaaatacaaaaatcagccagatgtggtggtgcatgcctgtagtcccagctactcaggaggctgaagtgggaggatcgcttgagcccaggaaccagaggttgcagtgagccaagatagcaacactgcactccagcctgaatgacaaagcaagacccagtctcttaaaa

SEQ ID NO: 22088 - DNA, 202 bp, Homo sapiens
gaacatggtgctgaggatatagaaacaaataaaacgcattcttgctttcaagatttattattgattaagacagttaaaaacataaatgctggtcctgtttgatcaatgctttccagaagatatgggggaagaaagggcggggaatttttcaaacatgggtttatgaggtgaacaggaggggtgtaaccattttgtaaacacc

SEQ ID NO: 22089 - DNA, 474 bp, Homo sapiens
tcctccatatgtatattattaatttccaatggtaatattaatggccactgctttagaggaaacattcatgttcctacaatctgctaatctgtagactgagaagatatatcaccttgaaatttatcaaaacttactttcttcttgatcttttaaaattatcctaattacctcattgtattagtccattttcacactgctataaagaaatacccaagactgggttatttataaaggaaagagaactcactcactatcaggagagcagcatggggaaaaccgccccccatgatctaatcacttcccttcctccacatggagggattacaatgtgaggtgagatttgggtgtggacagaaagccaaaccatatcaccaattatttgatttcttttaactttgttttggcagaggttgcagtgtgccaagatcgcaccattgcactctagcctgggcaacaagtgcgaaactccgtctc

SEQ ID NO: 22090 - DNA, 421 bp, Homo sapiens
  misc_feature (2)..(2): n is a, c, g, or t
anttcggccgcgtcgacaagctatcggcccataccccgaaaatgttgttatacccttcccgtactaattattcccctagcccgtgaggattgtccagtcccatccagcaggacacatgcccctgccagagcttggatgtcagaagaggccaacgtcctgtttgggagctggcagctcagcccagccacatagcctgaggcccccaacagtggagctgctcagggtggatgtcccctctggtcacttgggaatgtcccctgtgacggcagaagctgcacagtgccctctgggaccaaagtgggatgtttgcccgctcctggctccatcagcctgtagaccctaccagtggatcccatagctgacaggagacttgcccagggccagccctggggccttggctgtccagcttttaacgagaggt

SEQ ID NO: 22091 - DNA, 2477 bp, Homo sapiens
gttaaactcgtcatttcctccagctagaggagctcaactgatctgttttctttcgcccagccaaaatcacagaatgaaggcggtgaagagcgaacgggagcgagggagccggcgaagacaccgggacggggacgtggtgctgccggcgggggtggtggtgaagcaggagcgtctcagcccagaagtcgcacctcccgcccaccgccgtccggaccactccggtggtagcccgtctccgccgaccagcgagccggcccgctcgggccaccgcgggaaccgagcccgaggagttagccggtccccacccaaaaagaaaaacaaggcctcagggagaagaagcaagtctcctcgcagtaagagaaaccgaagtcctcaccactcaacagtcaaagtgaagcaggagcgtgaggatcatccccggagaggacgggaggatcggcagcacagggaaccatcagaacaggaacacaggagagctaggaacagtgaccgggacagacaccggggccattcccaccaaaggagaacgtctaacgagaggcctgggagtgggcagggtcagggacgggatcgagacactcagaacctgcaggctcaggaagaagagcgggagttttataatgccaggcgacgggagcatcgccagaggaatgacgttggtggtggcggcagtgagtctcaggagttggttcctcggcctggtggcaacaacaaagaaaaagaggtgcccgctaaagaaaaaccaagctttgaactttctggggcacttcttgaggacaccaacactttccggggtgtagtcattaaatatagtgagcccccagaagcacgtatccccaaaaaacggtggcgtctctacccatttaaaaatgatgaggtgcttccagtcatgtacatacatcgacagagtgcgtacctactgggtcgacaccgccgcattgcagacattccaattgatcacccgtcttgttcaaagcagcatgcggtctttcaatatcggcttgtggaatatacccgtgctgatggcacagttggccgaagagtgaagccctacatcattgaccttggctcaggcaatggaaccttcttaaacaacaaacgtattgagccacagagatactatgaactaaaagaaaaggatgtactcaaatttggattcagtagcagagaatacgtcttgctccatgagtcgtcggacacttctgaaatagacaggaaagatgacgaggatgaggaggaggaggaagaagtgtctgacagctagcaaactaagaacccaaactattgatacacggtttccttcttggaagtctttgattgactcagagagcactatggtggtgggtccagcactatggtgctctctgtaatgcctcttactgccttaagtctttcctctgttgctgaccagattgtgttaccatttgaatacactgactaatgtttgttaaactttttctgtggcaccttggccacatgcctgcaggcatttgttttcagaacagtctcaccaattacaacacaccgtgttttagtagaagtgttgtggttttagttggtgctttcagaactgctgcctaggaaactataaacccttggttaaggggaaatcatggcttgttctctttgtacagttactttatttatataggtgttaagctttgtggaccaggtgtttttcttttggggcgaacccctgagcagagaatcttactaggctttggttatcaccaaaacaacctccagtatataccaaagctttgacttgtttgagctcttgagcttagaagttgattttgcacttatttttttggggggtgggaatgtactgcagtcagtaaacattattgactgtttaacttaaacagatgctttatggcacctgctcaagcccgtgactgtacagaaggatcctggttgctaccagtgggtgctgattcagcatcacaagtgactgaaattggctgtggatctgttctttgtgaaagaattcctgatttctccatggagcatgtacacaacaattttgatcatattaactgtacttcagttttgcatttttattcaaatgttatctctttttttctttgagaaataaactgtcactgatgtgacagcgttctttctttattctaataacatgtatagatctaaagcaggttgtgttgtttacatgtttctacacatttcatcctttaaaaagttgttgagagaggttgtatttaccttcccaaggttggaaagcaggggaatttcccagtgtcctagttttccaccagaggaatatgtgtaagtagcaaagtatttgctgcttacatatagtgtgtatgtatgtatatatgtaaattgtgtgttaaagagctgatactgattttcatatgacaatgttaggcaaaggcctccctgcatttgaagagcaggttttcatttatatgtatttttgggataaaaaaataaaatttgtaaatatagcccca

SEQ ID NO: 22092 - DNA, 2707 bp, Homo sapiens
gttaaactcgtcatttcctccagctagaggagctcaactgatctgttttctttcgcccagccaaaatcacagaatgaaggcggtgaagagcgaacgggagcgagggagccggcgaagacaccgggacggggacgtggtgctgccggcgggggtggtggtgaagcaggagcgtctcagcccagaagtcgcacctcccgcccaccgccgtccggaccactccggtggtagcccgtctccgccgaccagcgagccggcccgctcgggccaccgcgggaaccgagcccgaggagttagccggtccccacccaaaaagaaaaacaaggcctcagggagaagaagcaagtctcctcgcagtaagagaaaccgaagtcctcaccactcaacagtcaaagtgaagcaggagcgtgaggatcatccccggagaggacgggaggatcggcagcacagggaaccatcagaacaggaacacaggagagctaggaacagtgaccgggacagacaccggggccattcccaccaaaggagaacgtctaacgagaggcctgggagtgggcagggtcagggacgggatcgagacactcagaacctgcaggctcaggaagaagagcgggagttttataatgccaggcgacgggagcatcgccagaggaatgacgttggtggtggcggcagtgagtctcaggagttggttcctcggcctggtggcaacaacaaagaaaaagaggtgcccgctaaagaaaaaccaagctttgaactttctggggcacttcttgaggacaccaacactttccggggtgtagtcattaaatatagtgagcccccagaagcacgtatccccaaaaaacggtggcgtctctacccatttaaaaatgatgaggtgcttccagtcatgtacatacatcgacagagtgcgtacctactgggtcgacaccgccgcattgcagacattccaattgatcacccgtcttgttcaaagcagcatgcggtctttcaatatcggcttgtggaatatacccgtgctgatggcacagttggccgaagagtgaagccctacatcattgaccttggctcaggcaatggaaccttcttaaacaacaaacgtattgagccacagagatactatgaactaaaagaaaaggatgtactcaaatttggattcagtagcagagaatacgtcttgctccatgagtcgtcggacacttctgaaatagacaggaaagatgacgaggatgaggaggaggaggaagaagtgtctgacagctagcaaactaagaacccaaactattgatacacggtttccttcttggaagtctttgattgactcagagagcactatggtggtgggtccagcactatggtgctctctgtaatgcctcttactgccttaagtctttcctctgttgctgaccagattgtgttaccatttgaatacactgactaatgtttgttaaactttttctgtggcaccttggccacatgcctgcaggcatttgttttcagaacagtctcaccaattacaacacaccgtgttttagtagaagtgttgtggttttagttggtgctttcagaactgctgcctaggaaactataaacccttggttaaggggaaatcatggcttgttctctttgtacagttactttatttatataggtgttaagctttgtggaccaggtgtttttcttttggggcgaacccctgagcagagaatcttactaggctttggttatcaccaaaacaacctccagtatataccaaagctttgacttgtttgagctcttgagcttagaagttgattttgcacttatttttttggggggtgggaatgtactgcagtcagtaaacattattgactgtttaacttaaacagatgctttatggcacctgctcaagcccgtgactgtacagaaggatcctggttgctaccagtgggtgctgattcagcatcacaagtgactgaaattggctgtggatctgttctttgtgaaagaattcctgatttctccatggagcatgtacacaacaattttgatcatattaactgtacttcagttttgcatttttattcaaatgttatctctttttttctttgagaaataaactgtcactgatgtgacagcgttctttctttattctaataacatgtatagatctaaagcaggttgtgttgtttacatgtttctacacatttcatcctttaaaaagttgttgagagaggttgtatttaccttcccaaggttggaaagcaggggaatttcccagtgtcctagttttccaccagaggaatatgtgtaagtagcaaagtatttgctgcttacatatagtgtgtatgtatgtatatatgtaaattgtgtgttaaagagctgatactgattttcatatgacaatgttaggcaaaggcctccctgcatttgaagagcaggttttcatttatatgtatttttgggataaaaaaataaaatttgtaaatatagccccatttcaaagagtaatgctttcctagcgtagaggaccttgtgttcataggtctgtttgctgctaatggagccttctgtcagtacttttgagataaaagtaggtagctgttttagagtgttgtggggcaggttatatcgttggcctccaagtcagtggaatagcagatggtgacatggaggtgggttgtggggaaaggtggtgaagcagctcaatcagtgttactactaattg

SEQ ID NO: 22093 - DNA, 2576 bp, Homo sapiens
gttaaactcgtcatttcctccagctagaggagctcaactgatctgttttctttcgcccagccaaaatcacagaatgaaggcggtgaagagcgaacgggagcgagggagccggcgaagacaccgggacggggacgtggtgctgccggcgggggtggtggtgaagcaggagcgtctcagcccagaagtcgcacctcccgcccaccgccgtccggaccactccggtggtagcccgtctccgccgaccagcgagccggcccgctcgggccaccgcgggaaccgagcccgaggagttagccggtccccacccaaaaagaaaaacaaggcctcagggagaagaagcaagtctcctcgcagtaagagaaaccgaagtcctcaccactcaacagtcaaagtgaagcaggagcgtgaggatcatccccggagaggacgggaggatcggcagcacagggaaccatcagaacaggaacacaggagagctaggaacagtgaccgggacagacaccggggccattcccaccaaaggagaacgtctaacgagaggcctgggagtgggcagggtcagggacgggatcgagacactcagaacctgcaggctcaggaagaagagcgggagttttataatgccaggcgacgggagcatcgccagaggaatgacgttggtggtggcggcagtgagtctcaggagttggttcctcggcctggtggcaacaacaaagaaaaagaggtgcccgctaaagaaaaaccaagctttgaactttctggggcacttcttgaggacaccaacactttccggggtgtagtcattaaatatagtgagcccccagaagcacgtatccccaaaaaacggtggcgtctctacccatttaaaaatgatgaggtgcttccagtcatgtacatacatcgacagagtgcgtacctactgggtcgacaccgccgcattgcagacattccaattgatcacccgtcttgttcaaagcagcatgcggtctttcaatatcggcttgtggaatatacccgtgctgatggcacagttggccgaagagtgaagccctacatcattgaccttggctcaggcaatggaaccttcttaaacaacaaacgtattgagccacagagatactatgaactaaaagaaaaggatgtactcaaatttggattcagtagcagagaatacgtcttgctccatgagtcgtcggacacttctgaaatagacaggaaagatgacgaggatgaggaggaggaggaagaagtgtctgacagctagcaaactaagaacccaaactattgatacacggtttccttcttggaagtctttgattgactcagagagcactatggtggtgggtccagcactatggtgctctctgtaatgcctcttactgccttaagtctttcctctgttgctgaccagattgtgttaccatttgaatacactgactaatgtttgttaaactttttctgtggcaccttggccacatgcctgcaggcatttgttttcagaacagtctcaccaattacaacacaccgtgttttagtagaagtgttgtggttttagttggtgctttcagaactgctgcctaggaaactataaacccttggttaaggggaaatcatggcttgttctctttgtacagttactttatttatataggtgttaagctttgtggaccaggtgtttttcttttggggcgaacccctgagcagagaatcttactaggctttggttatcaccaaaacaacctccagtatataccaaagctttgacttgtttgagctcttgagcttagaagttgattttgcacttatttttttggggggtgggaatgtactgcagtcagtaaacattattgactgtttaacttaaacagatgctttatggcacctgctcaagcccgtgactgtacagaaggatcctggttgctaccagtgggtgctgattcagcatcacaagtgactgaaattggctgtggatctgttctttgtgaaagaattcctgatttctccatggagcatgtacacaacaattttgatcatattaactgtacttcagttttgcatttttattcaaatgttatctctttttttctttgagaaataaactgtcactgatgtgacagcgttctttctttattctaataacatgtatagatctaaagcaggttgtgttgtttacatgtttctacacatttcatcctttaaaaagttgttgagagaggttgtatttaccttcccaaggttggaaagcaggggaatttcccagtgtcctagttttccaccagaggaatatgtgtaagtagcaaagtatttgctgcttacatatagtgtgtatgtatgtatatatgtaaattgtgtgttaaagagctgatactgattttcatatgacaatgttaggtctacctgggacctaactagaagtgtgaaaacgtaggcttggattaaggcgacagcgatttctaggatagtcagtagaattagaattgtgaagatgataagtgtagaaggaaggttaatggttgatattgctagggtggcgcttcccattacgtgcatgagtatggtgcctgcatcatcgtacc

SEQ ID NO: 22094 - DNA, 2458 bp, Homo sapiens
gttaaactcgtcatttcctccagctagaggagctcaactgatctgttttctttcgcccagccaaaatcacagaatgaaggcggtgaagagcgaacgggagcgagggagccggtccccacccaaaaagaaaaacaaggcctcagggagaagaagcaagtctcctcgcagtaagagaaaccgaagtcctcaccactcaacagtcaaagtgaagcagtccgttttcatgctgttgataaagacatacccgagacccggcgatttacaaaagaaagaggtttaatggacttacagttccacatggctggagaggcctcacaatcatggtgggaagcaaggaggagcaaatcacacggatggcgtcaggcaaggagagataaaagagagcgtgaggatcatccccggagaggacgggaggatcggcagcacagggaaccatcagaacaggaacacaggagagctaggaacagtgaccgggacagacaccggggccattcccaccaaaggagaacgtctaacgagaggcctgggagtgggcagggtcagggacgggatcgagacactcagaacctgcaggctcaggaagaagagcgggagttttataatgccaggcgacgggagcatcgccagaggaatgacgttggtggtggcggcagtgagtctcaggagttggttcctcggcctggtggcaacaacaaagaaaaagaggtgcccgctaaagaaaaaccaagctttgaactttctggggcacttcttgaggacaccaacactttccggggtgtagtcattaaatatagtgagcccccagaagcacgtatccccaaaaaacggtggcgtctctacccatttaaaaatgatgaggtgcttccagtcatgtacatacatcgacagagtgcgtacctactgggtcgacaccgccgcattgcagacattccaattgatcacccgtcttgttcaaagcagcatgcggtctttcaatatcggcttgtggaatatacccgtgctgatggcacagttggccgaagagtgaagccctacatcattgaccttggctcaggcaatggaaccttcttaaacaacaaacgtattgagccacagagatactatgaactaaaagaaaaggatgtactcaaatttggattcagtagcagagaatacgtcttgctccatgagtcgtcggacacttctgaaatagacaggaaagatgacgaggatgaggaggaggaggaagaagtgtctgacagctagcaaactaagaacccaaactattgatacacggtttccttcttggaagtctttgattgactcagagagcactatggtggtgggtccagcactatggtgctctctgtaatgcctcttactgccttaagtctttcctctgttgctgaccagattgtgttaccatttgaatacactgactaatgtttgttaaactttttctgtggcaccttggccacatgcctgcaggcatttgttttcagaacagtctcaccaattacaacacaccgtgttttagtagaagtgttgtggttttagttggtgctttcagaactgctgcctaggaaactataaacccttggttaaggggaaatcatggcttgttctctttgtacagttactttatttatataggtgttaagctttgtggaccaggtgtttttcttttggggcgaacccctgagcagagaatcttactaggctttggttatcaccaaaacaacctccagtatataccaaagctttgacttgtttgagctcttgagcttagaagttgattttgcacttatttttttggggggtgggaatgtactgcagtcagtaaacattattgactgtttaacttaaacagatgctttatggcacctgctcaagcccgtgactgtacagaaggatcctggttgctaccagtgggtgctgattcagcatcacaagtgactgaaattggctgtggatctgttctttgtgaaagaattcctgatttctccatggagcatgtacacaacaattttgatcatattaactgtacttcagttttgcatttttattcaaatgttatctctttttttctttgagaaataaactgtcactgatgtgacagcgttctttctttattctaataacatgtatagatctaaagcaggttgtgttgtttacatgtttctacacatttcatcctttaaaaagttgttgagagaggttgtatttaccttcccaaggttggaaagcaggggaatttcccagtgtcctagttttccaccagaggaatatgtgtaagtagcaaagtatttgctgcttacatatagtgtgtatgtatgtatatatgtaaattgtgtgttaaagagctgatactgattttcatatgacaatgttaggcaaaggcctccctgcatttgaagagcaggttttcatttatatgtatttttgggataaaaaaataaaatttgtaaatatagcccca

SEQ ID NO: 22095 - DNA, 309 bp, Homo sapiens
cagtgagatcaccttgctgaccacgagcggtggctcccagcactgcaaagatatgtgtggggccggcctgcttttgtgactgcagcattcacccttcaggggacagacagcggctcttgctgtctcaatgccactggaagaactccaaagggtgcctggaggaccagcttggactttcagttctgttgcttacgagtgtgtgaccttggacatgttgtgcgtctctctgcctctcggttctgtgacctgggcatagttaacacctgcttttgaggtcttgtgaggaataaatgagacattttattgaaa

SEQ ID NO: 22096 - DNA, 481 bp, Homo sapiens
gaaattatctcctcgaattggccaacatatgcataaatcctttgttttgatctttataaccatttctaagatgagtaaaatggttactcttatttccaatttatagaatcagaaacggaggtttagctgagtcaagtggtatgtctcatataataaatggtaaatgaagatctgttacgtgtactatgtcaaaaataaagtcacctaaaagaaaacttaagcatgacaccaatacttgggaaaaaatggtttcaaatatactggttaactggtgtttttattaaaatattcctttatgcaacgtttgtatatatttttaaagaaattatgtcaagccagattttacatcaaattcttttcctaaatattaagatactgctccacagcattcctcatcccccaaaattttaagactactcaagtacagggtgggaggcagatgaagtcggccccagccactctgggtgtcatggtgccacag

SEQ ID NO: 22097 - DNA, 407 bp, Homo sapiens
atcctcaatatacgatatgatctactcttagtccagtattattataactagtatttctaaatagcatcagtaggccagtggcatgtacctttattgagttatgaacatctttgagaacctctctagcaaaatttccatgcataaatgccatacttaattgcagttattgccacccactgatgcccatatagacatacctagaccaaactaccccagatgaagaagtgctgcattagaaactgaaggaaagtatactcatttgtacatatagtccatctccatattgtgtaatgaaatttcaacacaggaaaacaacaaagtacagacagcaggggtatccaatcttttggcttccctgggccacagtggaagaggaagaactgtcttgtgtgacacataaaatacac

SEQ ID NO: 22098 - DNA, 740 bp, Homo sapiens
catggcacgtgcctgtaatcccagctactcaggaggctacagcaggacggtcacctgcacccaggagtttgaggttacagtaagctctgatcacaccacagcattccaacctgggtgacagaggccctattcatttaaaaaaaaaaaaaaaagaaagaaaaagaaaaaaatgaatgggactttccatttgtaaagtgagagtatttatttctacaactgtctccaattagctttttattagtagctgacttacctaaacgtgcccagtagcttttcaacttttgacttttttggttcagatcccagaagcttctaattaggttatttgggctaagaactcttttccaatcttttccaatctcacattcctatcttacacctctgaaatgacatggcaagtaaaggcactttcatcgtcaaaagaccccagcaaaagaggcagtaacaggctcactttttgtaagttactaaactgaagctcagaaggccaatgacttgaccaaaggccacacaacactgaggctgtgagaggcgggatttgggaagaggcccaactccaaggcttattcgcttcccaccaacaccataacatgcacccacacctgcagcacggcagccagggcaagccttcacgctcccatacataggccaccaatattttaataccaatcaggactaggcaagcaaacagttaaggcatttttttttttttttttttttttaagacagagtcttgaaaa

SEQ ID NO: 22099 - DNA, 3352 bp, Homo sapiens
cacgtcctgacgcagcttgggcccgcggcggcggcaagggcgggagggagcggtcgccgcgggatttggagctgcctagcctcgcggtcgtcagggaaccaagaaatgcaacaggactagccgcggacaagaacacctcagacaccaagttgtagaaggaaagggctttattcagctgggagcatcagtggactcacgtcttcaaaaaccgagctccccgactttggcagcatgtaagcagctgtttgccaagaacccaggtcactgctaagaaagggtgccttcgggagaagagtgtccagaggataccaatgccagatgcatctggagttacactcagcactcgcagtatgagacattgtgtgccagcatctctttccttctggcaaagactgtagctctccaggtaggaggatcctggaagctgtgagcaccaggagccttgccagaggaggatggggccagatatgaactctctaccatgaacatggttctcggcttatgaaggaattttaagtaaaacagttatttaatttccacatattcaagtcaaaagccttctgtgtgaagtgccagtgattacccctccacaggagttatcaggatttttctggcaccaagtttaattcttcttcgtacttctggtagtgacagatctgcaggacagatttatctgttgaatgctcttgggcaggaaaaccatgtaaaacctctggaagcagcatcaggacagcagagcagagcccccgtcctcactgctcacttgcacagaaactccatctggactcggatgcttttactgaagacccatctagcttcaatcatctttagagtccatccattctggagagacctggcgtttgcagttgcctcctgtggccgtgtttttctgtcattctgttcccaggccttctattcaggcggttgaagggtgtggactttggaatggggtttgctgttcttcgggaacttgcttcctttccctggctggtgctgtcaggaaggaccatctgaaggctgcaatttgttcttagggaggcaggtgctggcctggcctggatcttccaccatgttcctgttgctgccttttgatagcctgattgtcaaccttctgggcatctccctgactgtcctcttcaccctccttctcgttttcatcatagtgccagccatttttggagtctcctttggtatccgcaaactctacatgaaaagtctgttaaaaatctttgcgtgggctaccttgagaatggagcgaggagccaaggagaagaaccaccagctttacaagccctacaccaacggaatcattgcaaaggatcccacttcactagaagaagagatcaaagagattcgtcgaagtggtagtagtaaggctctggacaacactccagagttcgagctctctgacattttctacttttgccggaaaggaatggagaccattatggatgatgaggtgacaaagagattctcagcagaagaactggagtcctggaacctgctgagcagaaccaattataacttccagtacatcagccttcggctcacggtcctgtgggggttaggagtgctgattcggtactgctttctgctgccgctcaggatagcactggctttcacagggattagccttctggtggtgggcacaactgtggtgggatacttgccaaatgggaggtttaaggagttcatgagtaaacatgttcacttaatgtgttaccggatctgcgtgcgagcgctgacagccatcatcacctaccatgacagggaaaacagaccaagaaatggtggcatctgtgtggccaatcatacctcaccgatcgatgtgatcatcttggccagcgatggctattatgccatggtgggtcaagtgcacgggggactcatgggtgtgattcagagagccatggtgaaggcctgcccacacgtctggtttgagcgctcggaagtgaaggatcgccacctggtggctaagagactgactgaacatgtgcaagataaaagcaagctgcctatcctcatcttcccagaaggaacctgcatcaataatacatcggtgatgatgttcaaaaagggaagttttgaaattggagccacagtttaccctgttgctatcaagtatgaccctcaatttggcgatgccttctggaacagcagcaaatacgggatggtgacgtacctgctgcgaatgatgaccagctgggccattgtctgcagcgtgtggtacctgcctcccatgactagagaggcagatgaagatgctgtccagtttgcgaatagggtgaaatctgccattgccaggcagggaggacttgtggacctgctgtgggatgggggcctgaagagggagaaggtgaaggacacgttcaaggaggagcagcagaagctgtacagcaagatgatcgtggggaaccacaaggacaggagccgctcctgagcctgcctccagctggctggggccaccgtgcggggtgccaacgggctcagagctggagttgccgccgccgcccccactgctgtgtcctttccagactccagggctccccgggctgctctggatcccaggactccggctttcgccgagccgcagcgggatccctgtgcacccggcgcagcctacccttggtggtctaaacggatgctgctgggtgttgcgacccaggacgagatgccttgtttcttttacaataagtcgttggaggaatgccattaaagtgaactccccacctttgcacgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacatcgcccccagccttggagctctgcagacatgataggaaggaaactgtcatctgcaggggctttcagcaaaatgaagggttagatttttatgctgctgctgatggggttactaaagggaggggaagaggccaggtgggccgctgactgggccatggggagaacgtgtgttcgtactccaggctaaccctgaactccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatga

SEQ ID NO: 22100 - DNA, 3176 bp, Homo sapiens
cgggggggggaaactataggctaggtacgaggctgggtggtggcgctttggcagcatgtaagcagctgtttgccaagaacccaggtcactgctaagaaagggtgccttcgggagaagagtgtccagaggataccaatgccagatgcatctggagttacactcagcactcgcagtatgagacattgtgtgccagcatctctttccttctggcaaagactgtagctctccaggtaggaggatcctggaagctgtgagcaccaggagccttgccagaggaggatggggccagatatgaactctctaccatgaacatggttctcggcttatgaaggaattttaagtaaaacagttatttaatttccacatattcaagtcaaaagccttctgtgtgaagtgccagtgattacccctccacaggagttatcaggatttttctggcaccaagtttaattcttcttcgtacttctggtagtgacagatctgcaggacagatttatctgttgaatgctcttgggcaggaaaaccatgtaaaacctctggaagcagcatcaggacagcagagcagagcccccgtcctcactgctcacttgcacagaaactccatctggactcggatgcttttactgaagacccatctagcttcaatcatctttagagtccatccattctggagagacctggcgtttgcagttgcctcctgtggccgtgtttttctgtcattctgttcccaggccttctattcaggcggttgaagggtgtggactttggaatggggtttgctgttcttcgggaacttgcttcctttccctggctggtgctgtcaggaaggaccatctgaaggctgcaatttgttcttagggaggcaggtgctggcctggcctggatcttccaccatgttcctgttgctgccttttgatagcctgattgtcaaccttctgggcatctccctgactgtcctcttcaccctccttctcgttttcatcatagtgccagccatttttggagtctcctttggtatccgcaaactctacatgaaaagtctgttaaaaatctttgcgtgggctaccttgagaatggagcgaggagccaaggagaagaaccaccagctttacaagccctacaccaacggaatcattgcaaaggatcccacttcactagaagaagagatcaaagagattcgtcgaagtggtagtagtaaggctctggacaacactccagagttcgagctctctgacattttctacttttgccggaaaggaatggagaccattatggatgatgaggtgacaaagagattctcagcagaagaactggagtcctggaacctgctgagcagaaccaattataacttccagtacatcagccttcggctcacggtcctgtgggggttaggagtgctgattcggtactgctttctgctgccgctcaggatagcactggctttcacagggattagccttctggtggtgggcacaactgtggtgggatacttgccaaatgggaggtttaaggagttcatgagtaaacatgttcacttaatgtgttaccggatctgcgtgcgagcgctgacagccatcatcacctaccatgacagggaaaacagaccaagaaatggtggcatctgtgtggccaatcatacctcaccgatcgatgtgatcatcttggccagcgatggctattatgccatggtgggtcaagtgcacgggggactcatgggtgtgattcagagagccatggtgaaggcctgcccacacgtctggtttgagcgctcggaagtgaaggatcgccacctggtggctaagagactgactgaacatgtgcaagataaaagcaagctgcctatcctcatcttcccagaaggaacctgcatcaataatacatcggtgatgatgttcaaaaagggaagttttgaaattggagccacagtttaccctgttgctatcaagtatgaccctcaatttggcgatgccttctggaacagcagcaaatacgggatggtgacgtacctgctgcgaatgatgaccagctgggccattgtctgcagcgtgtggtacctgcctcccatgactagagaggcagatgaagatgctgtccagtttgcgaatagggtgaaatctgccattgccaggcagggaggacttgtggacctgctgtgggatgggggcctgaagagggagaaggtgaaggacacgttcaaggaggagcagcagaagctgtacagcaagatgatcgtggggaaccacaaggacaggagccgctcctgagcctgcctccagctggctggggccaccgtgcggggtgccaacgggctcagagctggagttgccgccgccgcccccactgctgtgtcctttccagactccagggctccccgggctgctctggatcccaggactccggctttcgccgagccgcagcgggatccctgtgcacccggcgcagcctacccttggtggtctaaacggatgctgctgggtgttgcgacccaggacgagatgccttgtttcttttacaataagtcgttggaggaatgccattaaagtgaactccccacctttgcacgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacatcgcccccagccttggagctctgcagacatgataggaaggaaactgtcatctgcaggggctttcagcaaaatgaagggttagatttttatgctgctgctgatggggttactaaagggaggggaagaggccaggtgggccgctgactgggccatggggagaacgtgtgttcgtactccaggctaaccctgaactccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatga

SEQ ID NO: 22101 - DNA, 3173 bp, Homo sapiens
cacgtcctgacgcagcttgggcccgcggcggcggcaagggcgggagggagcggtcgccgcgggatttggagctgcctagcctcgcggtcgctttggcagcatgtaagcagctgtttgccaagaacccaggtcactgctaagaaagggtgccttcgggagaagagtgtccagaggataccaatgccagatgcatctggagttacactcagcactcgcagtatgagacattgtgtgccagcatctctttccttctggcaaagactgtagctctccaggtaggaggatcctggaagctgtgagcaccaggagccttgccagaggaggatggggccagatatgaactctctaccatgaacatggttctcggcttatgaaggaattttaagtaaaacagttatttaatttccacatattcaagtcaaaagccttctgtgtgaagtgccagtgattacccctccacaggagttatcaggatttttctggcaccaagtttaattcttcttcgtacttctggtagtgacagatctgcaggacagatttatctgttgaatgctcttgggcaggaaaaccatgtaaaacctctggaagcagcatcaggacagcagagcagagcccccgtcctcactgctcacttgcacagaaactccatctggactcggatgcttttactgaagacccatctagcttcaatcatctttagagtccatccattctggagagacctggcgtttgcagttgcctcctgtggccgtgtttttctgtcattctgttcccaggccttctattcaggcggttgaagggtgtggactttggaatggggtttgctgttcttcgggaacttgcttcctttccctggctggtgctgtcaggaaggaccatctgaaggctgcaatttgttcttagggaggcaggtgctggcctggcctggatcttccaccatgttcctgttgctgccttttgatagcctgattgtcaaccttctgggcatctccctgactgtcctcttcaccctccttctcgttttcatcatagtgccagccatttttggagtctcctttggtatccgcaaactctacatgaaaagtctgttaaaaatctttgcgtgggctaccttgagaatggagcgaggagccaaggagaagaaccaccagctttacaagccctacaccaacggaatcattgcaaaggatcccacttcactagaagaagagatcaaagagattcgtcgaagtggtagtagtaaggctctggacaacactccagagttcgagctctctgacattttctacttttgccggaaaggaatggagaccattatggatgatgaggtgacaaagagattctcagcagaagaactggagtcctggaacctgctgagcagaaccaattataacttccagtacatcagccttcggctcacggtcctgtgggggttaggagtgctgattcggtactgctttctgctgccgctcaggatagcactggctttcacagggattagccttctggtggtgggcacaactgtggtgggatacttgccaaatgggaggtttaaggagttcatgagtaaacatgttcacttaatgtgttaccggatctgcgtgcgagcgctgacagccatcatcacctaccatgacagggaaaacagaccaagaaatggtggcatctgtgtggccaatcatacctcaccgatcgatgtgatcatcttggccagcgatggctattatgccatggtgggtcaagtgcacgggggactcatgggtgtgattcagagagccatggtgaaggcctgcccacacgtctggtttgagcgctcggaagtgaaggatcgccacctggtggctaagagactgactgaacatgtgcaagataaaagcaagctgcctatcctcatcttcccagaaggaacctgcatcaataatacatcggtgatgatgttcaaaaagggaagttttgaaattggagccacagtttaccctgttgctatcaagtatgaccctcaatttggcgatgccttctggaacagcagcaaatacgggatggtgacgtacctgctgcgaatgatgaccagctgggccattgtctgcagcgtgtggtacctgcctcccatgactagagaggcagatgaagatgctgtccagtttgcgaatagggtgaaatctgccattgccaggcagggaggacttgtggacctgctgtgggatgggggcctgaagagggagaaggtgaaggacacgttcaaggaggagcagcagaagctgtacagcaagatgatcgtggggaaccacaaggacaggagccgctcctgagcctgcctccagctggctggggccaccgtgcggggtgccaacgggctcagagctggagttgccgccgccgcccccactgctgtgtcctttccagactccagggctccccgggctgctctggatcccaggactccggctttcgccgagccgcagcgggatccctgtgttgcgacccaggacgagatgccttgtttcttttacaataagtcgttggaggaatgccattaaagtgaactccccacctttgcacgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacatcgcccccagccttggagctctgcagacatgataggaaggaaactgtcatctgcaggggctttcagcaaaatgaagggttagatttttatgctgctgctgatggggttactaaagggaggggaagaggccaggtgggccgctgactgggccatggggagaacgtgtgttcgtactccaggctaaccctgaactccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatga

SEQ ID NO: 22102 - DNA, 3408 bp, Homo sapiens
cacgtcctgacgcagcttgggcccgcggcggcggcaagggcgggagggagcggtcgccgcgggatttggagctgcctagcctcgcggtcgctttggcagcatgtaagcagctgtttgccaagaacccaggtcactgctaagaaagggtgccttcgggagaagagtgtccagaggataccaatgccagatgcatctggagttacactcagcactcgcagtatgagacattgtgtgccagcatctctttccttctggcaaagactgtagctctccaggtaggaggatcctggaagctgtgagcaccaggagccttgccagaggaggatggggccagatatgaactctctaccatgaacatggttctcggcttatgaaggaattttaagtaaaacagttatttaatttccacatattcaagtcaaaagccttctgtgtgaagtgccagtgattacccctccacaggagttatcaggatttttctggcaccaagtttaattcttcttcgtacttctggtagtgacagatctgcaggacagatttatctgttgaatgctcttgggcaggaaaaccatgtaaaacctctggaagcagcatcaggacagcagagcagagcccccgtcctcactgctcacttgcacagaaactccatctggactcggatgcttttactgaagacccatctagcttcaatcatctttagagtccatccattctggagagacctggcgtttgcagttgcctcctgtggccgtgtttttctgtcattctgttcccaggccttctattcaggcggttgaagggtgtggactttggaatggggtttgctgttcttcgggaacttgcttcctttccctggctggtgctgtcaggaaggaccatctgaaggctgcaatttgttcttagggaggcaggtgctggcctggcctggatcttccaccatgttcctgttgctgccttttgatagcctgattgtcaaccttctgggcatctccctgactgtcctcttcaccctccttctcgttttcatcatagtgccagccatttttggagtctcctttggtatccgcaaactctacatgaaaagtctgttaaaaatctttgcgtgggctaccttgagaatggagcgaggagccaaggagaagaaccaccagctttacaagccctacaccaacggaatcattgcaaaggatcccacttcactagaagaagagatcaaagagattcgtcgaagtggtagtagtaaggctctggacaacactccagagttcgagctctctgacattttctacttttgccggaaaggaatggagaccattatggatgatgaggtgacaaagagattctcagcagaagaactggagtcctggaacctgctgagcagaaccaattataacttccagtacatcagccttcggctcacggtcctgtgggggttaggagtgctgattcggtactgctttctgctgccgctcaggatagcactggctttcacagggattagccttctggtggtgggcacaactgtggtgggatacttgccaaatgggaggtttaaggagttcatgagtaaacatgttcacttaatgtgttaccggatctgcgtgcgagcgctgacagccatcatcacctaccatgacaggtgagagcgctttgtattgataggaagggagatggcgctgcaggaaacaccacccacctatacttagccaaatgggaagacacttctgagcttttagttagagcagatgaagcatgtgaggtgagaggtgtgttacatgaactgtttcacactaattttggttgctttgcatacattttaaacccagggaaaacagaccaagaaatggtggcatctgtgtggccaatcatacctcaccgatcgatgtgatcatcttggccagcgatggctattatgccatggtgggtcaagtgcacgggggactcatgggtgtgattcagagagccatggtgaaggcctgcccacacgtctggtttgagcgctcggaagtgaaggatcgccacctggtggctaagagactgactgaacatgtgcaagataaaagcaagctgcctatcctcatcttcccagaaggaacctgcatcaataatacatcggtgatgatgttcaaaaagggaagttttgaaattggagccacagtttaccctgttgctatcaagtatgaccctcaatttggcgatgccttctggaacagcagcaaatacgggatggtgacgtacctgctgcgaatgatgaccagctgggccattgtctgcagcgtgtggtacctgcctcccatgactagagaggcagatgaagatgctgtccagtttgcgaatagggtgaaatctgccattgccaggcagggaggacttgtggacctgctgtgggatgggggcctgaagagggagaaggtgaaggacacgttcaaggaggagcagcagaagctgtacagcaagatgatcgtggggaaccacaaggacaggagccgctcctgagcctgcctccagctggctggggccaccgtgcggggtgccaacgggctcagagctggagttgccgccgccgcccccactgctgtgtcctttccagactccagggctccccgggctgctctggatcccaggactccggctttcgccgagccgcagcgggatccctgtgcacccggcgcagcctacccttggtggtctaaacggatgctgctgggtgttgcgacccaggacgagatgccttgtttcttttacaataagtcgttggaggaatgccattaaagtgaactccccacctttgcacgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacatcgcccccagccttggagctctgcagacatgataggaaggaaactgtcatctgcaggggctttcagcaaaatgaagggttagatttttatgctgctgctgatggggttactaaagggaggggaagaggccaggtgggccgctgactgggccatggggagaacgtgtgttcgtactccaggctaaccctgaactccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatga

SEQ ID NO: 22103 - DNA, 1932 bp, Homo sapiens
tggaatcaaaaggatctctggttctgataggcctgcttacatttctaggtgaactctggtccaggtcccaggtgagcaggtcttgggggtggtttttgtgatgccccctttgattttcacaccttcagttctgtacttggtagaatgatttgctggctgtgctctaacttttcttcttcttacaggatagcactggctttcacagggattagccttctggtggtgggcacaactgtggtgggatacttgccaaatgggaggtttaaggagttcatgagtaaacatgttcacttaatgtgttaccggatctgcgtgcgagcgctgacagccatcatcacctaccatgacagggaaaacagaccaagaaatggtggcatctgtgtggccaatcatacctcaccgatcgatgtgatcatcttggccagcgatggctattatgccatggtgggtcaagtgcacgggggactcatgggtgtgattcagagagccatggtgaaggcctgcccacacgtctggtttgagcgctcggaagtgaaggatcgccacctggtggctaagagactgactgaacatgtgcaagataaaagcaagctgcctatcctcatcttcccagaaggaacctgcatcaataatacatcggtgatgatgttcaaaaagggaagttttgaaattggagccacagtttaccctgttgctatcaagtatgaccctcaatttggcgatgccttctggaacagcagcaaatacgggatggtgacgtacctgctgcgaatgatgaccagctgggccattgtctgcagcgtgtggtacctgcctcccatgactagagaggcagatgaagatgctgtccagtttgcgaatagggtgaaatctgccattgccaggcagggaggacttgtggacctgctgtgggatgggggcctgaagagggagaaggtgaaggacacgttcaaggaggagcagcagaagctgtacagcaagatgatcgtggggaaccacaaggacaggagccgctcctgagcctgcctccagctggctggggccaccgtgcggggtgccaacgggctcagagctggagttgccgccgccgcccccactgctgtgtcctttccagactccagggctccccgggctgctctggatcccaggactccggctttcgccgagccgcagcgggatccctgtgcacccggcgcagcctacccttggtggtctaaacggatgctgctgggtgttgcgacccaggacgagatgccttgtttcttttacaataagtcgttggaggaatgccattaaagtgaactccccacctttgcacgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacatcgcccccagccttggagctctgcagacatgataggaaggaaactgtcatctgcaggggctttcagcaaaatgaagggttagatttttatgctgctgctgatggggttactaaagggaggggaagaggccaggtgggccgctgactgggccatggggagaacgtgtgttcgtactccaggctaaccctgaactccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatga

SEQ ID NO: 22104 - DNA, 2346 bp, Homo sapiens
cacgtcctgacgcagcttgggcccgcggcggcggcaagggcgggagggagcggtcgccgcgggatttggagctgcctagcctcgcggtcgctttggcagcatgtaagcagctgtttgccaagaacccaggtcactgctaagaaagggtgccttcgggagaagagtgtccagaggataccaatgccagatgcatctggagttacactcagcactcgcagtatgagacattgtgtgccagcatctctttccttctggcaaagactgtagctctccaggtaggaggatcctggaagctgtgagcaccaggagccttgccagaggaggatggggccagatatgaactctctaccatgaacatggttctcggcttatgaaggaattttaagtaaaacagttatttaatttccacatattcaagtcaaaagccttctgtgtgaagtgccagtgattacccctccacaggagttatcaggatttttctggcaccaagtttaattcttcttcgtacttctggtagtgacagatctgcaggacagatttatctgttgaatgctcttgggcaggaaaaccatgtaaaacctctggaagcagcatcaggacagcagagcagagcccccgtcctcactgctcacttgcacagaaactccatctggactcggatgcttttactgaagacccatctagcttcaatcatctttagagtccatccattctggagagacctggcgtttgcagttgcctcctgtggccgtgtttttctgtcattctgttcccaggccttctattcaggcggttgaagggtgtggactttggaatggggtttgctgttcttcgggaacttgcttcctttccctggctggtgctgtcaggaaggaccatctgaaggctgcaatttgttcttagggaggcaggtgctggcctggcctggatcttccaccatgttcctgttgctgccttttgatagcctgattgtcaaccttctgggcatctccctgactgtcctcttcaccctccttctcgttttcatcatagtgccagccatttttggagtctcctttggtatccgcaaactctacatgaaaagtctgttaaaaatctttgcgtgggctaccttgagaatggagcgaggagccaaggagaagaaccaccagctttacaagccctacaccaacggaatcattgcaaaggatcccacttcactagaagaagagatcaaagagattcgtcgaagtggtagtagtaaggctctggacaacactccagagttcgagctctctgacattttctacttttgccggaaaggaatggagaccattatggatgatgaggtgacaaagagattctcagcagaagaactggagtcctggaacctgctgacagaagctgtacagcaagatgatcgtggggaaccacaaggacaggagccgctcctgagcctgcctccagctggctggggccaccgtgcggggtgccaacgggctcagagctggagttgccgccgccgcccccactgctgtgtcctttccagactccagggctccccgggctgctctggatcccaggactccggctttcgccgagccgcagcgggatccctgtgcacccggcgcagcctacccttggtggtctaaacggatgctgctgggtgttgcgacccaggacgagatgccttgtttcttttacaataagtcgttggaggaatgccattaaagtgaactccccacctttgcacgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacatcgcccccagccttggagctctgcagacatgataggaaggaaactgtcatctgcaggggctttcagcaaaatgaagggttagatttttatgctgctgctgatggggttactaaagggaggggaagaggccaggtgggccgctgactgggccatggggagaacgtgtgttcgtactccaggctaaccctgaactccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatga

SEQ ID NO: 22105 - DNA, 1692 bp, Homo sapiens
atcggacgcgagtcctggcaacatgaggtgaatggtgagagacaggtcggcggtggcccccaggttgagtggcatcattggtgctccgatgttcgcacagaattgaacagttctgtgaattaaatggtaacctgatttttctctatccatatacattttttcttgatgagcattagattatgggtttaaaaggatacagttatgcttgttaactttttataatcgaaactagtgtcacaaataaataggttatttataaacatattttgacgatgtgtataaggttgtctgaccctttattttattttcttctttgaaagactgactgaacatgtgcaagataaaagcaagctgcctatcctcatcttcccagaaggaacctgcatcaataatacatcggtgatgatgttcaaaaagggaagttttgaaattggagccacagtttaccctgttgctatcaagtatgaccctcaatttggcgatgccttctggaacagcagcaaatacgggatggtgacgtacctgctgcgaatgatgaccagctgggccattgtctgcagcgtgtggtacctgcctcccatgactagagaggcagatgaagatgctgtccagtttgcgaatagggtgaaatctgccattgccaggcagggaggacttgtggacctgctgtgggatgggggcctgaagagggagaaggtgaaggacacgttcaaggaggagcagcagaagctgtacagcaagatgatcgtggggaaccacaaggacaggagccgctcctgagcctgcctccagctggctggggccaccgtgcggggtgccaacgggctcagagctggagttgccgccgccgcccccactgctgtgtcctttccagactccagggctccccgggctgctctggatcccaggactccggctttcgccgagccgcagcgggatccctgtgcacccggcgcagcctacccttggtggtctaaacggatgctgctgggtgttgcgacccaggacgagatgccttgtttcttttacaataagtcgttggaggaatgccattaaagtgaactccccacctttgcacgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacatcgcccccagccttggagctctgcagacatgataggaaggaaactgtcatctgcaggggctttcagcaaaatgaagggttagatttttatgctgctgctgatggggttactaaagggaggggaagaggccaggtgggccgctgactgggccatggggagaacgtgtgttcgtactccaggctaaccctgaactccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatga

SEQ ID NO: 22106 - DNA, 1382 bp, Homo sapiens
tggagaggggcttccacagtactcatgcaaggtcagggagcagcaccccagtaccagcacggcccagtggagtcactcacagcagtcactgtggactcgcaaacgttgtgagaactactcatgtcttacctccagctttccattgttttcagtatgaccctcaatttggcgatgccttctggaacagcagcaaatacgggatggtgacgtacctgctgcgaatgatgaccagctgggccattgtctgcagcgtgtggtacctgcctcccatgactagagaggcagatgaagatgctgtccagtttgcgaatagggtgaaatctgccattgccaggcagggaggacttgtggacctgctgtgggatgggggcctgaagagggagaaggtgaaggacacgttcaaggaggagcagcagaagctgtacagcaagatgatcgtggggaaccacaaggacaggagccgctcctgagcctgcctccagctggctggggccaccgtgcggggtgccaacgggctcagagctggagttgccgccgccgcccccactgctgtgtcctttccagactccagggctccccgggctgctctggatcccaggactccggctttcgccgagccgcagcgggatccctgtgcacccggcgcagcctacccttggtggtctaaacggatgctgctgggtgttgcgacccaggacgagatgccttgtttcttttacaataagtcgttggaggaatgccattaaagtgaactccccacctttgcacgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacatcgcccccagccttggagctctgcagacatgataggaaggaaactgtcatctgcaggggctttcagcaaaatgaagggttagatttttatgctgctgctgatggggttactaaagggaggggaagaggccaggtgggccgctgactgggccatggggagaacgtgtgttcgtactccaggctaaccctgaactccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatga

SEQ ID NO: 22107 - DNA, 2701 bp, Homo sapiens
cacgtcctgacgcagcttgggcccgcggcggcggcaagggcgggagggagcggtcgccgcgggatttggagctgcctagcctcgcggtcgctttggcagcatgtaagcagctgtttgccaagaacccaggtcactgctaagaaagggtgccttcgggagaagagtgtccagaggataccaatgccagatgcatctggagttacactcagcactcgcagtatgagacattgtgtgccagcatctctttccttctggcaaagactgtagctctccaggtaggaggatcctggaagctgtgagcaccaggagccttgccagaggaggatggggccagatatgaactctctaccatgaacatggttctcggcttatgaaggaattttaagtaaaacagttatttaatttccacatattcaagtcaaaagccttctgtgtgaagtgccagtgattacccctccacaggagttatcaggatttttctggcaccaagtttaattcttcttcgtacttctggtagtgacagatctgcaggacagatttatctgttgaatgctcttgggcaggaaaaccatgtaaaacctctggaagcagcatcaggacagcagagcagagcccccgtcctcactgctcacttgcacagaaactccatctggactcggatgcttttactgaagacccatctagcttcaatcatctttagagtccatccattctggagagacctggcgtttgcagttgcctcctgtggccgtgtttttctgtcattctgttcccaggccttctattcaggcggttgaagggtgtggactttggaatggggtttgctgttcttcgggaacttgcttcctttccctggctggtgctgtcaggaaggaccatctgaaggctgcaatttgttcttagggaggcaggtgctggcctggcctggatcttccaccatgttcctgttgctgccttttgatagcctgattgtcaaccttctgggcatctccctgactgtcctcttcaccctccttctcgttttcatcatagtgccagccatttttggagtctcctttggtatccgcaaactctacatgaaaagtctgttaaaaatctttgcgtgggctaccttgagaatggagcgaggagccaaggagaagaaccaccagctttacaagccctacaccaacggaatcattgcaaaggatcccacttcactagaagaagagatcaaagagattcgtcgaagtggtagtagtaaggctctggacaacactccagagttcgagctctctgacattttctacttttgccggaaaggaatggagaccattatggatgatgaggtgacaaagagattctcagcagaagaactggagtcctggaacctgctgagcagaaccaattataacttccagtacatcagcggccgctgactgggccatggggagaacgtgtgttcgtactccaggctaaccctgaactccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatgaaacaaggggacttctccctttactttctcccctggctgtggccctgagtagcaggcttctcgtgaggattcccgttctcttctgggagcatggccctggggctgcggagaagccaactgactgctggagcgaggaaccctgcagctcagaaggtgaacagctcgtctcagatgcttgcagatctttggttaatttagaatttccagcacagacgtggatttctccagagacggggtgtgtgcgggtcgctgatgtgaggcctaggggaagcaatgagtaaactccagggtgggggaggagcaagggcccggggagggctgcagaggggccggggcggggcagggcctgtgctgcatggtggcttctgcaggggagggacaggggagggctgcagaggggcagggtgggcagggcatgtgctgcatggcagcttctgcacagccagagcaggcaccacaggaaacgagtcggccactggtgcctgctgtacagtcacagtggaggcagagccaaggccaagcagcccctgtgggttctggggtttcaccagtttcatgctcctcagctccccattcatgccccaccagccctcacttgggacccatgctccctcgtggcacagtcatgatgcctctcaggattttgtgcctgtggtgctgagtgtcacgtccccaaggtcgccctctggcctgcagttcagggagtgggtgggagtgaagctgtgctcctggggctgcagacagatccactttgcatgtggtacctgctgggttggccctgcaatctccttttctctgcacctacctgtgacctccctgggagagcctcccatttcctcacctgccctgttgccagcccgggggaaatctttttgctctcaaatgaagactgaaaaaataaagtcagtgttatgactaataagtctcttaggaactgttttacaaaatgcttaagaataaaaagtgattttcagctttta

SEQ ID NO: 22108 - DNA, 809 bp, Homo sapiens
gagcatcagtggactcacgtcttcaaaaaccgagctccccgagtaagcaattcctgtcccttttaacggcttacaactccaagggggtccgcatgagaaggtcatgatcgattgaacaagcagggagtacgtgactgggagctgcatgcaccggtaatcagaatggaacagaacttgacaggggttttcactatgcttttccatacagtgtctgacatctatagataacacccagggtttcgtcaggggttgacttttaactactaggcccatggcaccatgctgggctatctgcctgtggattccagtactgccttttaaattttatgtcttctttctttggaggcagaaattgggcataagacaatatgaagggtggtctcctccctttaaaacattgcgctgattttaaggcgaagtcagtacttgttcatttgttcaatttcttgtacttctaagtgtttggaatagcctgaaggtgattagtgtgaagccaaaatatttgccagagagacttgataggatactcccaagttcagggatttggaatgtgcgatgtaaaattggaatacttttgtgagatatttgaaatagtggaatttcacaatgagtggccagtgtggggagaggctggaggagtttaatctctatgtggaaaatatggcaaggtcttgcaaatttaaaaatgtgtattttcttttcctctgcaattccatttctaggaatttaccccgaaaatatatttgctaagcacattttgtgtactaagtcatgcatgtacctggttattcgttacaacattatacaaa

SEQ ID NO: 22109 - DNA, 442 bp, Homo sapiens
aatcggaggcaccatcttgcctgtctctgttaagtgtttgtttttaagttagggagatgacagatgtatcttactggaggaaccattagaagaattttgactattatacttagtctttaagaaacgcctaatatctggggtaaagggccaacagaaatagcattttattgtctcctgcattttaggaacctgcatcaataatacatcggtgatgatgttcaaaaagggaagttttgaaattggagccacagtttaccctgttgctatcaaggtataagacctccgatggtacacactgtcattactggagctgctgtgagtggggtgcagcaggaggaggtagaggaaggagctggggtcaccagtctgtggtcgatgccctcagcagagtggcgtggggctgggttgacgtgggtcaagtgctgccggaggaggatggtga

SEQ ID NO: 22110 - DNA, 3221 bp, Homo sapiens
cacgtcctgacgcagcttgggcccgcggcggcggcaagggcgggagggagcggtcgccgcgggatttggagctgcctagcctcgcggtcgctttggcagcatgtaagcagctgtttgccaagaacccaggtcactgctaagaaagggtgccttcgggagaagagtgtccagaggataccaatgccagatgcatctggagttacactcagcactcgcagtatgagacattgtgtgccagcatctctttccttctggcaaagactgtagctctccaggtaggaggatcctggaagctgtgagcaccaggagccttgccagaggaggatggggccagatatgaactctctaccatgaacatggttctcggcttatgaaggaattttaagtaaaacagttatttaatttccacatattcaagtcaaaagccttctgtgtgaagtgccagtgattacccctccacaggagttatcaggatttttctggcaccaagtttaattcttcttcgtacttctggtagtgacagatctgcaggacagatttatctgttgaatgctcttgggcaggaaaaccatgtaaaacctctggaagcagcatcaggacagcagagcagagcccccgtcctcactgctcacttgcacagaaactccatctggactcggatgcttttactgaagacccatctagcttcaatcatctttagagtccatccattctggagagacctggcgtttgcagttgcctcctgtggccgtgtttttctgtcattctgttcccaggccttctattcaggcggttgaagggtgtggactttggaatggggtttgctgttcttcgggaacttgcttcctttccctggctggtgctgtcaggaaggaccatctgaaggctgcaatttgttcttagggaggcaggtgctggcctggcctggatcttccaccatgttcctgttgctgccttttgatagcctgattgtcaaccttctgggcatctccctgactgtcctcttcaccctccttctcgttttcatcatagtgccagccatttttggagtctcctttggtatccgcaaactctacatgaaaagtctgttaaaaatctttgcgtgggctaccttgagaatggagcgaggagccaaggagaagaaccaccagctttacaagccctacaccaacggaatcattgcaaaggatcccacttcactagaagaagagatcaaagagattcgtcgaagtggtagtagtaaggctctggacaacactccagagttcgagctctctgacattttctacttttgccggaaaggaatggagaccattatggatgatgaggtgacaaagagattctcagcagaagaactggagtcctggaacctgctgagcagaaccaattataacttccagtacatcagccttcggctcacggtcctgtgggggttaggagtgctgattcggtactgctttctgctgccgctcaggatagcactggctttcacagggattagccttctggtggtgggcacaactgtggtgggatacttgccaaatgggaggtttaaggagttcatgagtaaacatgttcacttaatgtgttaccggatctgcgtgcgagcgctgacagccatcatcacctaccatgacagggaaaacagaccaagaaatggtggcatctgtgtggccaatcatacctcaccgatcgatgtgatcatcttggccagcgatggctattatgccatggtgggtcaagtgcacgggggactcatgggtgtgattcagagagccatggtgaaggcctgcccacacgtctggtttgagcgctcggaagtgaaggatcgccacctggtggctaagagactgactgaacatgtgcaagataaaagcaagctgcctatcctcatcttcccagaaggaacctgcatcaataatacatcggtgatgatgttcaaaaagggaagttttgaaattggagccacagtttaccctgttgctatcaagtatgaccctcaatttggcgatgccttctggaacagcagcaaatacgggatggtgacgtacctgctgcgaatgatgaccagctgggccattgtctgcagcgtgtggtacctgcctcccatgactagagaggcagatgaagatgctgtccagtttgcgaatagggtgaaatctgccattgccaggcagggaggacttgtggacctgctgtgggatgggggcctgaagagggagaaggtgaaggacacgttcaaggaggagcagcagaagctgtacagcaagatgatcgtggggaaccacaaggacaggagccgctcctgagcctgcctccagctggctggggccaccgtgcggggtgccaacgggctcagagctggagttgccgccgccgcccccactgctgtgtcctttccagactccagggctccccgggctgctctggatcccaggactccggctttcgccgagccgcagcgggatccctgtgcacccggcgcagcctacccttggtggtctaaacggatgctgctgggtgttgcgacccaggacgagatgccttgtttcttttacaataagtcgttggaggaatgccattaaagtgaactccccacctttgcacgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacatcgcccccagccttggagctctgcagacatgataggaaggaaactgtcatctgcaggggctttcagcaaaatgaagggttagatttttatgctgctgctgatggggttactaaagggaggggaagaggccaggtgggccgctgactgggccatggggagaacgtgtgttcgtactccaggctaaccctgaactccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatga

SEQ ID NO: 22111 - DNA, 3366 bp, Homo sapiens
cacgtcctgacgcagcttgggcccgcggcggcggcaagggcgggagggagcggtcgccgcgggatttggagctgcctagcctcgcggtcgcttcaagagatggttccgttgctttggggtgaacttggtaccagtgccgtgttacttatccagttctaactcaagaaagttctggagggcataatgatcttagataagaccaaggccccgaacctgaccatgttctgtcttctctctttggcagcatgtaagcagctgtttgccaagaacccaggtcactgctaagaaagggtgccttcgggagaagagtgtccagaggataccaatgccagatgcatctggagttacactcagcactcgcagtatgagacattgtgtgccagcatctctttccttctggcaaagactgtagctctccaggtaggaggatcctggaagctgtgagcaccaggagccttgccagaggaggatggggccagatatgaactctctaccatgaacatggttctcggcttatgaaggaattttaagtaaaacagttatttaatttccacatattcaagtcaaaagccttctgtgtgaagtgccagtgattacccctccacaggagttatcaggatttttctggcaccaagtttaattcttcttcgtacttctggtagtgacagatctgcaggacagatttatctgttgaatgctcttgggcaggaaaaccatgtaaaacctctggaagcagcatcaggacagcagagcagagcccccgtcctcactgctcacttgcacagaaactccatctggactcggatgcttttactgaagacccatctagcttcaatcatctttagagtccatccattctggagagacctggcgtttgcagttgcctcctgtggccgtgtttttctgtcattctgttcccaggccttctattcaggcggttgaagggtgtggactttggaatggggtttgctgttcttcgggaacttgcttcctttccctggctggtgctgtcaggaaggaccatctgaaggctgcaatttgttcttagggaggcaggtgctggcctggcctggatcttccaccatgttcctgttgctgccttttgatagcctgattgtcaaccttctgggcatctccctgactgtcctcttcaccctccttctcgttttcatcatagtgccagccatttttggagtctcctttggtatccgcaaactctacatgaaaagtctgttaaaaatctttgcgtgggctaccttgagaatggagcgaggagccaaggagaagaaccaccagctttacaagccctacaccaacggaatcattgcaaaggatcccacttcactagaagaagagatcaaagagattcgtcgaagtggtagtagtaaggctctggacaacactccagagttcgagctctctgacattttctacttttgccggaaaggaatggagaccattatggatgatgaggtgacaaagagattctcagcagaagaactggagtcctggaacctgctgagcagaaccaattataacttccagtacatcagccttcggctcacggtcctgtgggggttaggagtgctgattcggtactgctttctgctgccgctcaggatagcactggctttcacagggattagccttctggtggtgggcacaactgtggtgggatacttgccaaatgggaggtttaaggagttcatgagtaaacatgttcacttaatgtgttaccggatctgcgtgcgagcgctgacagccatcatcacctaccatgacagggaaaacagaccaagaaatggtggcatctgtgtggccaatcatacctcaccgatcgatgtgatcatcttggccagcgatggctattatgccatggtgggtcaagtgcacgggggactcatgggtgtgattcagagagccatggtgaaggcctgcccacacgtctggtttgagcgctcggaagtgaaggatcgccacctggtggctaagagactgactgaacatgtgcaagataaaagcaagctgcctatcctcatcttcccagaaggaacctgcatcaataatacatcggtgatgatgttcaaaaagggaagttttgaaattggagccacagtttaccctgttgctatcaagtatgaccctcaatttggcgatgccttctggaacagcagcaaatacgggatggtgacgtacctgctgcgaatgatgaccagctgggccattgtctgcagcgtgtggtacctgcctcccatgactagagaggcagatgaagatgctgtccagtttgcgaatagggtgaaatctgccattgccaggcagggaggacttgtggacctgctgtgggatgggggcctgaagagggagaaggtgaaggacacgttcaaggaggagcagcagaagctgtacagcaagatgatcgtggggaaccacaaggacaggagccgctcctgagcctgcctccagctggctggggccaccgtgcggggtgccaacgggctcagagctggagttgccgccgccgcccccactgctgtgtcctttccagactccagggctccccgggctgctctggatcccaggactccggctttcgccgagccgcagcgggatccctgtgcacccggcgcagcctacccttggtggtctaaacggatgctgctgggtgttgcgacccaggacgagatgccttgtttcttttacaataagtcgttggaggaatgccattaaagtgaactccccacctttgcacgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacatcgcccccagccttggagctctgcagacatgataggaaggaaactgtcatctgcaggggctttcagcaaaatgaagggttagatttttatgctgctgctgatggggttactaaagggaggggaagaggccaggtgggccgctgactgggccatggggagaacgtgtgttcgtactccaggctaaccctgaactccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatga

SEQ ID NO: 22112 - DNA, 4200 bp, Homo sapiens
cacgtcctgacgcagcttgggcccgcggcggcggcaagggcgggagggagcggtcgccgcgggatttggagctgcctagcctcgcggtcgctttggcagcatgtaagcagctgtttgccaagaacccaggtcactgctaagaaagggtgccttcgggagaagagtgtccagaggataccaatgccagatgcatctggagttacactcagcactcgcagtatgagacattgtgtgccagcatctctttccttctggcaaagactgtagctctccaggtaggaggatcctggaagctgtgagcaccaggagccttgccagaggaggatggggccagatatgaactctctaccatgaacatggttctcggcttatgaaggaattttaagtaaaacagttatttaatttccacatattcaagtcaaaagccttctgtgtgaagtgccagtgattacccctccacaggagttatcaggatttttctggcaccaagtttaattcttcttcgtacttctggtagtgacagatctgcaggacagatttatctgttgaatgctcttgggcaggaaaaccatgtaaaacctctggaagcagcatcaggacagcagagcagagcccccgtcctcactgctcacttgcacagaaactccatctggactcggatgcttttactgaagacccatctagcttcaatcatctttagagtccatccattctggagagacctggcgtttgcagttgcctcctgtggccgtgtttttctgtcattctgttcccaggccttctattcaggcggttgaagggtgtggactttggaatggggtttgctgttcttcgggaacttgcttcctttccctggctggtgctgtcaggaaggaccatctgaaggctgcaatttgttcttagggaggcaggtgctggcctggcctggatcttccaccatgttcctgttgctgccttttgatagcctgattgtcaaccttctgggcatctccctgactgtcctcttcaccctccttctcgttttcatcatagtgccagccatttttggagtctcctttggtatccgcaaactctacatgaaaagtctgttaaaaatctttgcgtgggctaccttgagaatggagcgaggagccaaggagaagaaccaccagctttacaagccctacaccaacggaatcattgcaaaggatcccacttcactagaagaagagatcaaagagattcgtcgaagtggtagtagtaaggctctggacaacactccagagttcgagctctctgacattttctacttttgccggaaaggaatggagaccattatggatgatgaggtgacaaagagattctcagcagaagaactggagtcctggaacctgctgagcagaaccaattataacttccagtacatcagccttcggctcacggtcctgtgggggttaggagtgctgattcggtactgctttctgctgccgctcaggatagcactggctttcacagggattagccttctggtggtgggcacaactgtggtgggatacttgccaaatgggaggtttaaggagttcatgagtaaacatgttcacttaatgtgttaccggatctgcgtgcgagcgctgacagccatcatcacctaccatgacagggaaaacagaccaagaaatggtggcatctgtgtggccaatcatacctcaccgatcgatgtgatcatcttggccagcgatggctattatgccatggtgggtcaagtgcacgggggactcatgggtgtgattcagagagccatggtgaaggcctgcccacacgtctggtttgagcgctcggaagtgaaggatcgccacctggtggctaagagactgactgaacatgtgcaagataaaagcaagctgcctatcctcatcttcccagaaggaacctgcatcaataatacatcggtgatgatgttcaaaaagggaagttttgaaattggagccacagtttaccctgttgctatcaagtatgaccctcaatttggcgatgccttctggaacagcagcaaatacgggatggtgacgtacctgctgcgaatgatgaccagctgggccattgtctgcagcgtgtggtacctgcctcccatgactagagaggcagatgaagatgctgtccagtttgcgaatagggtgaaatctgccattgccaggcagggaggacttgtggacctgctgtgggatgggggcctgaagagggagaaggtgaaggacacgttcaaggaggagcagcagaagctgtacagcaagatgatcgtggggaaccacaaggacaggagccgctcctgagcctgcctccagctggctggggccaccgtgcggggtgccaacgggctcagagctggagttgccgccgccgcccccactgctgtgtcctttccagactccagggctccccgggctgctctggatcccaggactccggctttcgccgagccgcagcgggatccctgtgcacccggcgcagcctacccttggtggtctaaacggatgctgctgggtgttgcgacccaggacgagatgccttgtttcttttacaataagtcgttggaggaatgccattaaagtgaactccccacctttgcacgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacatcgcccccagccttggagctctgcagacatgataggaaggaaactgtcatctgcaggggctttcagcaaaatgaagggttagatttttatgctgctgctgatggggttactaaagggaggggaagaggccaggtgggccgctgactgggccatggggagaacgtgtgttcgtactccaggctaaccctgaactccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatgaaacaaggggacttctccctttactttctcccctggctgtggccctgagtagcaggcttctcgtgaggattcccgttctcttctgggagcatggccctggggctgcggagaagccaactgactgctggagcgaggaaccctgcagctcagaaggtgaacagctcgtctcagatgcttgcagatctttggttaatttagaatttccagcacagacgtggatttctccagagacggggtgtgtgcgggtcgctgatgtgaggcctaggggaagcaatgagtaaactccagggtgggggaggagcaagggcccggggagggctgcagaggggccggggcggggcagggcctgtgctgcatggtggcttctgcaggggagggacaggggagggctgcagaggggcagggtgggcagggcatgtgctgcatggcagcttctgcacagccagagcaggcaccacaggaaacgagtcggccactggtgcctgctgtacagtcacagtggaggcagagccaaggccaagcagcccctgtgggttctggggtttcaccagtttcatgctcctcagctccccattcatgccccaccagccctcacttgggacccatgctccctcgtggcacagtcatgatgcctctcaggattttgtgcctgtggtgctgagtgtcacgtccccaaggtcgccctctggcctgcagttcagggagtgggtgggagtgaagctgtgctcctggggctgcagacagatccactttgcatgtggtacctgctgggttggccctgcaatctccttttctctgcacctacctgtgacctccctgggagagcctcccatttcctcacctgccctgttgccagcccgggggaaatctttttgctctcaaatgaagactgaaaaaataaagtcagtgttatgactaataagtctcttaggaactgttttacaaaatgcttaagaataaaaagtgattttcagctttta

SEQ ID NO: 22113 - DNA, 3202 bp, Homo sapiens
cacgtcctgacgcagcttgggcccgcggcggcggcaagggcgggagggagcggtcgccgcgggatttggagctgcctagcctcgcggtcgctttggcagcatgtaagcagctgtttgccaagaacccaggtcactgctaagaaagggtgccttcgggagaagagtgtccagaggataccaatgccagatgcatctggagttacactcagcactcgcagtatgagacattgtgtgccagcatctctttccttctggcaaagactgtagctctccaggtaggaggatcctggaagctgtgagcaccaggagccttgccagaggaggatggggccagatatgaactctctaccatgaacatggttctcggcttatgaaggaattttaagtaaaacagttatttaatttccacatattcaagtcaaaagccttctgtgtgaagtgccagtgattacccctccacaggagttatcaggatttttctggcaccaagtttaattcttcttcgtacttctggtagtgacagatctgcaggacagatttatctgttgaatgctcttgggcaggaaaaccatgtaaaacctctggaagcagcatcaggacagcagagcagagcccccgtcctcactgctcacttgcacagaaactccatctggactcggatgcttttactgaagacccatctagcttcaatcatctttagagtccatccattctggagagacctggcgtttgcagttgcctcctgtggccgtgtttttctgtcattctgttcccaggccttctattcaggcggttgaagggtgtggactttggaatggggtttgctgttcttcgggaacttgcttcctttccctggctggtgctgtcaggaaggaccatctgaaggctgcaatttgttcttagggaggcaggtgctggcctggcctggatcttccaccatgttcctgttgctgccttttgatagcctgattgtcaaccttctgggcatctccctgactgtcctcttcaccctccttctcgttttcatcatagtgccagccatttttggagtctcctttggtatccgcaaactctacatgaaaagtctgttaaaaatctttgcgtgggctaccttgagaatggagcgaggagccaaggagaagaaccaccagctttacaagccctacaccaacggaatcattgcaaaggatcccacttcactagaagaagagatcaaagagattcgtcgaagtggtagtagtaaggctctggacaacactccagagttcgagctctctgacattttctacttttgccggaaaggaatggagaccattatggatgatgaggtgacaaagagattctcagcagaagaactggagtcctggaacctgctgagcagaaccaattataacttccagtacatcagccttcggctcacggtcctgtgggggttaggagtgctgattcggtactgctttctgctgccgctcaggatagcactggctttcacagggattagccttctggtggtgggcacaactgtggtgggatacttgccaaatgggaggtttaaggagttcatgagtaaacatgttcacttaatgtgttaccggatctgcgtgcgagcgctgacagccatcatcacctaccatgacagggaaaacagaccaagaaatggtggcatctgtgtggccaatcatacctcaccgatcgatgtgatcatcttggccagcgatggctattatgccatggtgggtcaagtgcacgggggactcatgggtgtgattcagagagccatggtgaaggcctgcccacacgtctggtttgagcgctcggaagtgaaggatcgccacctggtggctaagagactgactgaacatgtgcaagataaaagcaagctgcctatcctcatcttcccagaaggaacctgcatcaataatacatcggtgatgatgttcaaaaagggaagttttgaaattggagccacagtttaccctgttgctatcaagtatgaccctcaatttggcgatgccttctggaacagcagcaaatacgggatggtgacgtacctgctgcgaatgatgaccagctgggccattgtctgcagcgtgtggtacctgcctcccatgactagagaggcagatgaagatgctgtccagtttgcgaatagggtgaaatctgccattgccaggcagggaggacttgtggacctgctgtgggatgggggcctgaagagggagaaggtgaaggacacgttcaaggaggagcagcagaagctgtacagcaagatgatcgtggggaaccacaaggacaggagccgctcctgagcctgcctccagctggctggggccaccgtgcggggtgccaacgggctcagagctggagttgccgccgccgcccccactgctgtgtcctttccagactccagggctccccgggctgctctggatcccaggactccggctttcgccgagccgcagcgggatccctgtgcacccggcgcagcctacccttggtggtctaaacggatgctgctgggtgttgcgacccaggacgagatgccttgtttcttttacaataagtcgttggaggaatgccattaaagtgaactccccacctttgcacgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacatcgcccccagccttggagctctgcagacatgataggaaggaaactgtcatctgcaggggctttcagcaaaatgaagggttagatttttatgctgctgctgatggggttactaaagggaggggaagaggccaggtgggccgctgactgggccatggggagaacgtgtgttcgtatccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatga

SEQ ID NO: 22114 - DNA, 2589 bp, Homo sapiens
cacgtcctgacgcagcttgggcccgcggcggcggcaagggcgggagggagcggtcgccgcgggatttggagctgcctagcctcgcggtcgctttggcagcatgtaagcagctgtttgccaagaacccaggtcactgctaagaaagggtgccttcgggagaagagtgtccagaggataccaatgccagatgcatctggagttacactcagcactcgcagtatgagacattgtgtgccagcatctctttccttctggcaaagactgtagctctccaggtaggaggatcctggaagctgtgagcaccaggagccttgccagaggaggatggggccagatatgaactctctaccatgaacatggttctcggcttatgaaggaattttaagtaaaacagttatttaatttccacatattcaagtcaaaagccttctgtgtgaagtgccagtgattacccctccacaggagttatcaggatttttctggcaccaagtttaattcttcttcgtacttctggtagtgacagatctgcaggacagatttatctgttgaatgctcttgggcaggaaaaccatgtaaaacctctggaagcagcatcaggacagcagagcagagcccccgtcctcactgctcacttgcacagaaactccatctggactcggatgcttttactgaagacccatctagcttcaatcatctttagagtccatccattctggagagacctggcgtttgcagttgcctcctgtggccgtgtttttctgtcattctgttcccaggccttctattcaggcggttgaagggtgtggactttggaatggggtttgctgttcttcgggaacttgcttcctttccctggctggtgctgtcaggaaggaccatctgaaggctgcaatttgttcttagggaggcaggtgctggcctggcctggatcttccaccatgttcctgttgctgccttttgatagcctgattgtcaaccttctgggcatctccctgactgtcctcttcaccctccttctcgttttcatcatagtgccagccatttttggagtctcctttggtatccgcaaactctacatgaaaagtctgttaaaaatctttgcgtgggctaccttgagaatggagcgaggagccaaggagaagaaccaccagctttacaagccctacaccaacggaatcattgcaaaggatcccacttcactagaagaagagatcaaagagattcgtcgaagtggtagtagtaaggctctggacaacactccagagttcgagctctctgacattttctacttttgccggaaaggaatggagaccattatggatgatgaggtgacaaagagattctcagcagaagaactggagtcctggaacctgctgagcagaaccaattataacttccagtacatcagccttcggctcacggtcctgtgggggttaggagtgctgattcggtactgctttctgctgccgctcaggatagcactggctttcacagggattagccttctggtggtgggcacaactgtggtgggatacttgccaaatgggaggtttaaggagttcatgagtaaacatgttcacttaatgtgttaccggatctgcgtgcgagcgctgacagccatcatcacctaccatgacagggaaaacagaccaagaaatggtggcatctgtgtggccaatcatacctcaccgatcgatgtgatcatcttggccagcgatggctattatgccatggtgggtcaagtgcacgggggactcatgggtgtgattcagagagccatggtgaaggcctgcccacacgtctggtttgagcgctcggaagtgaaggatcgccacctggtggctaagagactgactgaacatgtgcaagataaaagcaagctgcctatcctcatcttcccagaaggaacctgcatcaataatacatcggtgatgatgttcaaaaagggaagttttgaaattggagccacagtttaccctgttgctatcaagtatgaccctcaatttggcgatgccttctggaacagcagcaaatacgggatggtgacgtacctgctgcgaatgatgaccagctgggccattgtctgcagcgtgtggtacctgcctcccatgactagagaggcagatgaagatgctgtccagtttgcgaatagggtgaaatctgccattgccaggcagggaggacttgtggacctgctgtgggatgggggcctgaagagggagaaggtgaaggacacgttcaaggaggagcagcagaagctgtacagcaagatgatcggccgctgactgggccatggggagaacgtgtgttcgtactccaggctaaccctgaactccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatga

SEQ ID NO: 22115 - DNA, 1517 bp, Homo sapiens
ctactaatgagtcctgtgcctgcgcttaggtgggtcaagtgcacgggggactcatgggtgtgattcagagagccatggtgaaggcctgcccacacgtctggtttgagcgctcggaagtgaaggatcgccacctggtggctaagagactgactgaacatgtgcaagataaaagcaagctgcctatcctcatcttcccagaaggaacctgcatcaataatacatcggtgatgatgttcaaaaagggaagttttgaaattggagccacagtttaccctgttgctatcaagtatgaccctcaatttggcgatgccttctggaacagcagcaaatacgggatggtgacgtacctgctgcgaatgatgaccagctgggccattgtctgcagcgtgtggtacctgcctcccatgactagagaggcagatgaagatgctgtccagtttgcgaatagggtgaaatctgccattgccaggcagggaggacttgtggacctgctgtgggatgggggcctgaagagggagaaggtgaaggacacgttcaaggaggagcagcagaagctgtacagcaagatgatcgtggggaaccacaaggacaggagccgctcctgagcctgcctccagctggctggggccaccgtgcggggtgccaacgggctcagagctggagttgccgccgccgcccccactgctgtgtcctttccagactccagggctccccgggctgctctggatcccaggactccggctttcgccgagccgcagcgggatccctgtgcacccggcgcagcctacccttggtggtctaaacggatgctgctgggtgttgcgacccaggacgagatgccttgtttcttttacaataagtcgttggaggaatgccattaaagtgaactccccacctttgcacgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacatcgcccccagccttggagctctgcagacatgataggaaggaaactgtcatctgcaggggctttcagcaaaatgaagggttagatttttatgctgctgctgatggggttactaaagggaggggaagaggccaggtgggccgctgactgggccatggggagaacgtgtgttcgtactccaggctaaccctgaactccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatga

SEQ ID NO: 22116 - DNA, 1722 bp, Homo sapiens
cacgtcctgacgcagcttgggcccgcggcggcggcaagggcgggagggagcggtcgccgcgggatttggagctgcctagcctcgcggtcgctttggcagcatgtaagcagctgtttgccaagaacccaggtcactgctaagaaagggtgccttcgggagaagagtgtccagaggataccaatgccagatgcatctggagttacactcagcactcgcagtatgagacattgtgtgccagcatctctttccttctggcaaagactgtagctctccaggtaggaggatcctggaagctgtgagcaccaggagccttgccagaggaggatggggccagatatgaactctctaccatgaacatggttctcggcttatgaaggaattttaagtaaaacagttatttaatttccacatattcaagtcaaaagccttctgtgtgaagtgccagtgattacccctccacaggagttatcaggatttttctggcaccaagtttaattcttcttcgtacttctggtagtgacagatctgcaggacagatttatctgttgaatgctcttgggcaggaaaaccatgtaaaacctctggaagcagcatcaggacagcagagcagagcccccgtcctcactgctcacttgcacagaaactccatctggactcggatgcttttactgaagacccatctagcttcaatcatctttagagtccatccattctggagagacctggcgtttgcagttgcctcctgtggccgtgtttttctgtcattctgttcccaggccttctattcaggcggttgaagggtgtggactttggaatggggtttgctgttcttcgggaacttgcttcctttccctggctggtgctgtcaggaaggaccatctgaaggctgcaatttgttcttagggaggcaggtgctggcctggcctggatcttccaccatgttcctgttgctgccttttgatagcctgattgtcaaccttctgggcatctccctgactgtcctcttcaccctccttctcgttttcatcatagtgccagccatttttggagtctcctttggtatccgcaaactctacatgaaaagtctgttaaaaatctttgcgtgggctaccttgagaatggagcgaggagccaaggagaagaaccaccagctttacaagccctacaccaacggaatcattgcaaaggatcccacttcactagaagaagagatcaaagagattcgtcgaagtggtagtagtaaggctctggacaacactccagagttcgagctctctgacattttctacttttgccggaaaggaatggagaccattatggatgatgaggtgacaaagagattctcagcagaagaactggagtcctggaacctgctgagcagaaccaattataacttccagtacatcagcggccgctgactgggccatggggagaacgtgtgttcgtactccaggctaaccctgaactccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatga

SEQ ID NO: 22117 - DNA, 868 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagacagggattcttgcggagctcggatcacatcgcagggagggcttggggcgatacattggcgtgaatcggatggggttgtgaaaccggctcaaggggcatccgtggaaaactcgcggaacagccgaccaaaggggggggtcccccccccacgagactggcgaacctccactgcggacccccacgatggctg

SEQ ID NO: 22118 - DNA, 614 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatccggagctgggggacctgtacacgcccgcccccgggagagctgagtcaggccctgaaaagcctcacctgaacctgtggctggaagcccccgacctcctcttggccgaaattgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22119 - DNA, 1233 bp, Homo sapiens
tcccaagcagctgggattacaggtgtgctccaccacacccagctaatttttgtatttttaatagagacggggtttcgccacgttggcctggctggtctcagactcctgacctcaggtgatccaccgcctcagcctccgaaagtgctgggattacaggtgtgagccactgcacccagcctgcggctctctctttcatcctgttttctcctctgcccttctccctttctccatctctgtcttgcctcacctctgtccctgtttctgcctctatatccttttttcaatatgtctcttgaagctttctgggaccaagctctaggcagtgccccggggaataaggacctatgaaatgcacattccacgttccagaaactcgctgtcatgggtggggctcaaggagatggatgcagtatcaatagggtgtgattcacgctgctttggaggggggcacccagcacagccttgagagggctcgtcacccacatgaaggggtcagggaaggcttcctggaggagggggtgtgggataagatttgaaggaacaggaggagttcagcaggcagacagaagaaggttctaggtagagcggcccagagctgggagagaatgattggattggatcagccagtaatggagagtgactgaaagaaattcagtgggccgaggttgctagaagaatgaggtcttctccagaggtgggaggggcagaccacacagggtctccaacgccaggcttgtggggctcagaccttcacttgggagcactggggagccagagaagagctgtgagcagggaagggatagggtcaactctagtgacatcacactgatggacaggagataagaggccagggaggaggctgggcggagagtccagagcggaaagtgagtgcccagctctcacttccttatgtctctctctgcttcttacggccgctgtccctgaatgtttcttccctgtctgggtctgggctgtgggcttcctgcagagggctggggggtcctcaccccctttttctccccgcagaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggatgggctggtgagaacggcattaggggccattcgcgaaaaaaacgcgtggaaaggccggcacg

SEQ ID NO: 22120 - DNA, 450 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgaggagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22121 - DNA, 388 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcgtgctggagctccttcgaggcctgcagcagcagaaactcaaatcgcg

SEQ ID NO: 22122 - DNA, 751 bp, Homo sapiens
tgctagtcgcgcgattgagggctgctccgcctctcatgcataagaattgctccatttgaggaacaaatgaggggtctgatggcacagactccgagcctggaggtagttttcctttatacaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaagtcagtgccctcagaggacccaggagtctggcccgctaggccccttcttccctagaacccaagaatcctgggcccaggaccctcctccctcagctcctggagatctggcccctcgatctgattcttttccctatggtagatctctagtgccctggacatcccacacccgggcagtcctggttctgccacctggccaggctggcacttttccatgccccactccagggccgggaggcctgggcagagtgctcttcgtgcattagcggatctcctggctttagtcctgagcctgctgtctccttcttttttctttctttctttttttttttcttgtgatggagtttcgctcttgttgcccaggttcagacgattctcctgtctca

SEQ ID NO: 22123 - DNA, 1257 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcaggccctgaaaagcctcacctgaacctgtggctggaagcccccgacctcctcttggccgaaattgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgcctttaaaaaaaaaacacaaaaaacac

SEQ ID NO: 22124 - DNA, 1259 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcaggccctgaaaagcctcacctgaacctgtggctggaagcccccgacctcctcttggccgaaattgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgcctttaaaaacaaaaaaaacaaaaacaag

SEQ ID NO: 22125 - DNA, 1564 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcaggccctgaaaagcctcacctgaacctgtggctggaagcccccgacctcctcttggccgaaattgacctccccaaactggtgagttttgcgcgctggaccagagcaggggaatgaggtctggaaaggtcagggactgtctctgagtgtgagtgacaaggggttgttgctggacttgtcagttgcgtcctctctgccaggaggcccacaggccaccttctggtgctgtcctgagggcgcccaagggattgtaagtgctcggtcgttgagacttgtaattgctgtcttctgtctcttcctgggagattagacccttcaaatatagtttcccagcgtgtgaggctaccatgcctggtccaggtgatcatcctgttgctggggagggtgacctgattccgccacctctccaggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22126 - DNA, 1335 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcaggccctgaaaagcctcacctgaacctgtggctggaagcccccgacctcctcttggccgaaattgacctccccaaactgacccttcaaatatagtttcccagcgtgtgaggctaccatgcctggtccaggtgatcatcctgttgctggggagggtgacctgattccgccacctctccaggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22127 - DNA, 1186 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccgggaacatccgctcggagcagcgtcctcggatccaggagctgggggacctgtacacgcccgcccccgggagagctgagtcaggccctgaaaagcctcacctgaacctgtggctggaagcccccgacctcctcttggccgaaattgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22128 - DNA, 965 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22129 - DNA, 1105 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggccctgaaaagcctcacctgaacctgtggctggaagcccccgacctcctcttggccgaaattgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22130 - DNA, 1326 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcagctctcatgcataagaattgctccatttgaggaacaaatgaggggtctgatggcacagactccgagcctggaggtagttttcctttatacaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcaggccctgaaaagcctcacctgaacctgtggctggaagcccccgacctcctcttggccgaaattgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22131 - DNA, 1251 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccgggaacatccgctcggagcagcgtcctcggatccaggagctgggggacctgtacacgcccgcccccgggagagctgagtcaggccctgaaaagcctcacctgaacctgtggctggaagcccccgacctcctcttggccgaaattgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgcctttaaacaacaatacacaggaaaacaacaaacaccaccacacaggccagagcacaccacagcacaaag

SEQ ID NO: 22132 - DNA, 1419 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcagctctcatgcataagaattgctccatttgaggaacaaatgaggggtctgatggcacagactccgagcctggaggtagttttcctttatacaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcaggttggggggcggggctgcggttgaggcctgggcaggggtctctacccctaccctccccgccaccgcctgtcttttccctctctgtcaccccagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcaggccctgaaaagcctcacctgaacctgtggctggaagcccccgacctcctcttggccgaaattgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22133 - DNA, 1645 bp, Homo sapiens
tcccaagcagctgggattacaggtgtgctccaccacacccagctaatttttgtatttttaatagagacggggtttcgccacgttggcctggctggtctcagactcctgacctcaggtgatccaccgcctcagcctccgaaagtgctgggattacaggtgtgagccactgcacccagcctgcggctctctctttcatcctgttttctcctctgcccttctccctttctccatctctgtcttgcctcacctctgtccctgtttctgcctctatatccttttttcaatatgtctcttgaagctttctgggaccaagctctaggcagtgccccggggaataaggacctatgaaatgcacattccacgttccagaaactcgctgtcatgggtggggctcaaggagatggatgcagtatcaatagggtgtgattcacgctgctttggaggggggcacccagcacagccttgagagggctcgtcacccacatgaaggggtcagggaaggcttcctggaggagggggtgtgggataagatttgaaggaacaggaggagttcagcaggcagacagaagaaggttctaggtagagcggcccagagctgggagagaatgattggattggatcagccagtaatggagagtgactgaaagaaattcagtgggccgaggttgctagaagaatgaggtcttctccagaggtgggaggggcagaccacacagggtctccaacgccaggcttgtggggctcagaccttcacttgggagcactggggagccagagaagagctgtgagcagggaagggatagggtcaactctagtgacatcacactgatggacaggagataagaggccagggaggaggctgggcggagagtccagagcggaaagtgagtgcccagctctcacttccttatgtctctctctgcttcttacggccgctgtccctgaatgtttcttccctgtctgggtctgggctgtgggcttcctgcagagggctggggggtcctcaccccctttttctccccgcagaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcaggccctgaaaagcctcacctgaacctgtggctggaagcccccgacctcctcttggccgaaattgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22134 - DNA, 1232 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgaggatcaccgcctattagtcgtctttctccagcggacactggtgaaacccgtaaagcttgcggggacctggaagcgtaaggacgagtgccggccgcgtggacatcgagtgcatgagattcgggcgccgaccctcgatggatgctgctgggtggcagggtctcaaaggaaggctccggtcatatgggccaaaaaaaaagcatgaaccatgaattggagcacaaatccgagcctccggtctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccgggaacatccgctcggagcagcgtcctcggatccaggagctgggggacctgtacacgcccgcccccgggagagctgagtcaggccctgaaaagcctcacctgaacctgtggctggaagcccccgacctcctcttggccgaaattgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22135 - DNA, 804 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggcctcgaaggagctccagcaagcccagacaaccagaccagaatcgacacaaatccagcctcagcctgccctggaccttgttcctcctcagccctgaaaagcctcacctgaacctgtggctggaagcccccgacctcctcttggccgaaattgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22136 - DNA, 317 bp, Homo sapiens
gtttgacggcgctcctgaccctcagaatggcgcatgatgaagaaccggccattcatgggctccatctcgcagcagaacatccgctcggagcagcgtcctcggatccaggagctgggggacctgtacacgcccgcccccgggagagctgagtcagggtgggccttcggtagatccccggtctgatgtttcctcaacgctcttgggaatccctccctccatcctcccacactgggtgatgtcctggggccctgggcactgagagagggaggagagagaactcctgactgggaaggcgtcctgaggccaatagggctggt

SEQ ID NO: 22137 - DNA, 926 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22138 - DNA, 1235 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcaggccctgaaaagcctcacctgaacctgtggctggaagcccccgacctcctcttggccgaaattgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22139 - DNA, 999 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaagtcagtgccctcagaggacccaggagtctggcccgctaggccccttcttccctagaacccaagaatcctgggcccaggaccctcctccctcagctcctggagatctggcccctcgatctgattcttttccctatggtagatctctagtgccctggacatcccacacccgggcagtcctggttctgccacctggccaggctggcacttttccatgccccactccagggccgggaggcctgggcagagtgctcttcgtgcattagcggatctcctggctttagtcctgagcctgctgtctccttcttttttctttctttctttttttttttcttgtgatggagtttcgctcttgttgcccaggttcagacgattctcctgtctca

SEQ ID NO: 22140 - DNA, 423 bp, Homo sapiens
gttggagggagaaaagggacagcacgccaggcaaagacctggcagctgtgctcagccctggaccttgttcctcctcagccctgaaaagcctcacctgaacctgtggctggaagcccccgacctcctcttggccgaaattgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22141 - DNA, 416 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggtattaaagctccgttgcagccatgcaaggagctgcaccgagccgcggggggattctctagaaacggcctgcag

SEQ ID NO: 22142 - DNA, 1362 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcaggccctgaaaagcctcacctgaacctgtggctggaagcccccgacctcctcttggccgaaattgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaaggtgcctgggggaggggcttggggaagctgggacattggcggggcctggactctgtctcccagggaggggggctgggagctggacttctgggtcctggatcctcattctctttgctctgtctcctcagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22143 - DNA, 1136 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcaggccctgaaaagcctcacctgaacctgtggctggaagcccccgacctcctcttggccgaaattgacctccccaaactgatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22144 - DNA, 1014 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggaatggcgcatgatgaagaaccggccattcatgggctccatctcgcagcaagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22145 - DNA, 1220 bp, Homo sapiens
agtacatccacgattctcaccggtatcgttcaagctggttgagcacacaattatacgcactacggaatttggagatagtgtgcgtgtctagacatgagaaactagtgcgtactagaagtcgcaggtgctccagggtatgtctcgaaccaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcaggccctgaaaagcctcacctgaacctgtggctggaagcccccgacctcctcttggccgaaattgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22146 - DNA, 1328 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcaggttggggggcggggctgcggttgaggcctgggcaggggtctctacccctaccctccccgccaccgcctgtcttttccctctctgtcaccccagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcaggccctgaaaagcctcacctgaacctgtggctggaagcccccgacctcctcttggccgaaattgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22147 - DNA, 1087 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccgggaacatccgctcggagcagcgtcctcggatccaggagctgggggacctgtacacgcccgcccccgggagagctgagtcaggccctgaaaagcctcacctgaacctgtggctggaagcccccgacctcctcttggccgaaattgacctccccaaactgatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22148 - DNA, 1738 bp, Homo sapiens
tcccaagcagctgggattacaggtgtgctccaccacacccagctaatttttgtatttttaatagagacggggtttcgccacgttggcctggctggtctcagactcctgacctcaggtgatccaccgcctcagcctccgaaagtgctgggattacaggtgtgagccactgcacccagcctgcggctctctctttcatcctgttttctcctctgcccttctccctttctccatctctgtcttgcctcacctctgtccctgtttctgcctctatatccttttttcaatatgtctcttgaagctttctgggaccaagctctaggcagtgccccggggaataaggacctatgaaatgcacattccacgttccagaaactcgctgtcatgggtggggctcaaggagatggatgcagtatcaatagggtgtgattcacgctgctttggaggggggcacccagcacagccttgagagggctcgtcacccacatgaaggggtcagggaaggcttcctggaggagggggtgtgggataagatttgaaggaacaggaggagttcagcaggcagacagaagaaggttctaggtagagcggcccagagctgggagagaatgattggattggatcagccagtaatggagagtgactgaaagaaattcagtgggccgaggttgctagaagaatgaggtcttctccagaggtgggaggggcagaccacacagggtctccaacgccaggcttgtggggctcagaccttcacttgggagcactggggagccagagaagagctgtgagcagggaagggatagggtcaactctagtgacatcacactgatggacaggagataagaggccagggaggaggctgggcggagagtccagagcggaaagtgagtgcccagctctcacttccttatgtctctctctgcttcttacggccgctgtccctgaatgtttcttccctgtctgggtctgggctgtgggcttcctgcagagggctggggggtcctcaccccctttttctccccgcagaaggccagggatgtaccgcctacgacgtagctgtcaacagcgacttctaccggaggatgcaggttggggggcggggctgcggttgaggcctgggcaggggtctctacccctaccctccccgccaccgcctgtcttttccctctctgtcaccccagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcaggccctgaaaagcctcacctgaacctgtggctggaagcccccgacctcctcttggccgaaattgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22149 - DNA, 1107 bp, Homo sapiens
ccagtcctgtgtttaccgatagaccggaagtgtggcttcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggactggagctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcaggttggggggcggggctgcggttgaggcctgggcaggggtctctacccctaccctccccgccaccgcctgtcttttccctctctgtcaccccagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcagggtgggccttcggtagatccccggtctgatgtttcctcaacgctcttgggaatccctccctccatcctcccacactgggtgatgtcctggggccctgggcactgagagagggaggagagagaact

SEQ ID NO: 22150 - DNA, 1017 bp, Homo sapiens
  misc_feature (13)..(13): n is a, c, g, or t
acttagaggatcntcccccgactagccgacagcaacctgggtgctgggccctgtgtctcctggagccaagggttagggcctgagcagctgtcactctctgggaagcccagtgagtggggctgactgagcaggtgccatagagcctagtaagggaagagggagctggcaaggagcccaggtagggaggctctgtgaattgtctctgattcctttcctggagcccctgcctcgtcacctcctgggatgcgtctcaaggtcatggaggttgtagtggaggagccctggggctgtcgctggagctgggggacctgtacacgcccgcccccgggagagctgagtcaggccctgaaaagcctcacctgaacctgtggctggaagcccccgacctcctcttggccgaaattgacctccccaaactggtgagttttgcgcgctggaccagagcaggggaatgaggtctggaaaggtcagggactgtctctgagtgtgagtgacaaggggttgttgctggacttgtcagttgcgtcctctctgccaggaggcccacaggccaccttctggtgctgtcctgagggcgcccaagggattgtaagtgctcggtcgttgagacttgtaattgctgtcttctgtctcttcctgggagattagacccttcaaatatagtttcccagcgtgtgaggctaccatgcctggtccaggtgatcatcctgttgctggggagggtgacctgattccgccacctctccaggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggctaccctaaaagttgaaataaaagatttttgccttt

SEQ ID NO: 22151 - DNA, 150 bp, Homo sapiens
gtcgacgcagatggttatacatgtctcaaacagcaggcacaattcagaactagaagtaacagagtctatgggaggaaccagttggaatgacgggatggggaaaagcatgtgttctacttcggataagttgttttaactgcctactcatca

SEQ ID NO: 22152 - DNA, 386 bp, Homo sapiens
gaagcacaaacaggaagaacaaagctgctagttggtctttttcgctgtccctttaatctgtaatctgacaagatttggtagagagataacttagtcaccaactctgttttcttttttgggagaccaaatccagatatacagcttgagacttaatcccatatgaggtgttcattctacctaatacagcacccattaatttgtcatgagctgggtggtttgtcaagaaaacctaatacacatgtgcatggaaaaacacacatcaatgtgtactttatcctttggtttactttaacttatttgcttagagaaacatgctatggttattaggttaaccatgcatacattgcgttagtctggaaaagaggttttaatgtcttaaccagtga

SEQ ID NO: 22153 - DNA, 415 bp, Homo sapiens
gtcttttataattttaaaaatactaatattggatacttttataatttagaaaaaaaaattgatgtttaaaagcctgaaaatgtgtacagaaatgtttctaccaaagctttaatttaaaggactaaatatcatctatatagaaataatatatttaggctgggcactgttgtcacgcctgtaatcccagcactttgggaggccgaggtgggcagatcacctgaggtgaagagtttgagaccagcctggccaacatggtaaaaccccgtctctactaaaaatacagaaattagccaggcatggtgacaggtgcctgtagtgccagctacttgggaggctgaggtaggagaatcgcttgatcctgggagacagaggttgcagtgagccaagatcgcaccactgcactccagcctaggca

SEQ ID NO: 22154 - DNA, 449 bp, Homo sapiens
cccatggccagcaggtccctccatttggcctgcacacacagcctcttgagaagcagaagaaaggacccccgcttcctcccctcagtggggggcagatacagcagctggccaggtgccagttgatgcacatgcttaagtggaacaaaggggtacacaccaagtctgatcgggggaaagatactcccacacaaggaggtgagtccagcacaggctgtgatgactccttatctctcaggaaggaagtgctccaggcccaaggcccattcctacgtggcagagtggaggtggaaagacccctggcaccagattgcctttcctcacactttgctgttggcatacaaacttggtgacgggcacagagacaagccattgtaggccacaacaaagagtttggagtttaaagtcattaaaagcttcttgtcgtttcgtgtgtaacagccccagtgact

SEQ ID NO: 22155 - DNA, 175 bp, Homo sapiens
ggaggttgcagtgagccgagatcaggccactgcactccagcctgggtgacagagtgagactccgtctcaaaaaaaataataataatcattgtgtagagaaaaggataaggcagaaggggaaggagattcaaaataaaatcactgtatctaaataccctgaatttatactcttaaa

SEQ ID NO: 22156 - DNA, 179 bp, Homo sapiens
tgattccttttatattttctccctttccttcacccatccccaggcaactattgatccgttgtcactgtagatttgtttgtatttcctagaattctacagagatagagtaatttaatatgtattctaatgtttttggcttcttaaactctgaaattaaggctcatggtggtgttctgtgt

SEQ ID NO: 22157 - DNA, 405 bp, Homo sapiens
tattaagacaggtttaattggtcctgcctggaaaactgaaacataaaacaaagtcactgatttctctgactgtgcagatctcttggatgtgctctttaaattcctctgcttctgtatctcattgctgaggacatttgcaagaaaacataatatttattgtgtttgagtacatctagtcttgctgctttttcttttcctacatcataattgtctcttttcaggcagaggtggacagttaagcaagttctgcacgtacccaaataaactctgaacagattgattccctctgcaccccagtaagggtgtgctccactgtgttcccttgtccccaggcccagattcttcctaaagtaaactgggccactgaactgtgcccattagtgagccaaaagattggcatctgct

SEQ ID NO: 22158 - DNA, 304 bp, Homo sapiens
aacggaagatgaggtgtttgcagcaggcgtctgtcttgcagctcagcaggtgaggggacctcgagcaggctctcgcattttccggctgatccttccgagtctgctactgcagggccctcgtaggtgggagcagcctcatcgtcgcctttcacactgtgagcttttcctttccacggtcagatggacttagtgagttaccagcgatggatgttaagacctaagacaccgcagaaagttacagagtggaaaatgaggggcagagaaaagagggtctgagaggaacgcaagcattccggaatacagt

SEQ ID NO: 22159 - DNA, 1048 bp, Homo sapiens
tagcctccaaactgtgagacaatacatttctgttgcttaagccactcagttagtgtgctttattttggcagtcttagcaaactaatacatcccccaatccagaactgtcctcctttggataataaaaacagcaataattatagtgtcattaccctgagtgactggtcccactgttggtcattctttgtagatgtgagttattgccctattgagatcagaagtcctctcacttagaggcatatctaagacttttttcttgtggagggagctcactcaactgtaggtaaggtttgactcatctgggttagtagtaagaacaaacttccaagtgggcaccatcttaaaggtgcaagcccatgtgggcgatgaccaggtctggtatattaagaggctcttggtagcacattagaaacacctggagagattttaaaatttacaaagcctagccaaaccccagacccattaaccctgactctctgagaataggaccctggcacctgtgttttaaggattctaggtgatttcaatgtgtagccaaggttcactgccatagcctgtcctggaatgcaggtaactaaaacttcagcagattatgaaaaacaaaagttactttcttggatgcatatattcttatagcctcaaaactgaaactgcaaactgaacaatgctgcagtcagatacacacacatatttcaactgcataacttcctttaataatacttttatttttccaaatttgaagactgtccctaagtcatttcttctaaaagttagtaataatcccaccaactcacatttacatagaagttacagtttaaagtttgcatctcgtaataacttggtgagatagggcaagcattatttctaatttgcatatgagaaaaaactaaggctcggatgagttatgtgacttccctgagtcatgttagagtaactaactcctgatttgtaaactgaagtcccaaatcctgggaactccctcagctctgggcaagccaggacaggtaggtcaccctgcacctacacaaggactgagctgagttctagt

SEQ ID NO: 22160 - DNA, 309 bp, Homo sapiens
gaataaggaatgtgtagttttatagaaaggattttcatttttggttcagtttgtgacctgtgaggaatatccttagagctgctgatgtaaatttggagaatcctcgagttagaaaagtagggataagaaaacttgtctaccttctccatgtcctttgatggggccaaaaaggaaaaagaagagtggtggtggttggtgtagtttgtcttttcagtcttacgggaaacaatgttccatgggtggtcctttgtaagcctatggaggattttctgattggctttcaagacttgatcctgcatctgtgagctg

SEQ ID NO: 22161 - DNA, 397 bp, Homo sapiens
tacaaactgctttgctccaccttccctctcccagcctccctgcactgccccttggggccaccatcggctgctccatgctgagaaatgcggctgtgacacccagcgctgtggaatgggactctccatgttgccaaattcaagccaaacaaactttctcatttctcatcagttgttctcagcattaaatagcgtgcacagctcctgtaaaagctctgagagtcactggcaccaccccataggtccctggcagaggagatagtggagcaagcacaccctcggccagctctgttcctccagagagccaagctgattcctccggagagccaagcagatttggatactctaggactattccatacatttcaaatgccgtaataaaagtataccaaatgcgcct

SEQ ID NO: 22162 - DNA, 649 bp, Homo sapiens
taatgggatgtcttttataaaatggggtaattttacctgatgacagtattgaagactttacttggaaaaattaagaagttgacagctctactttagacctcagaattatttttgaaatactgttttcccagataacaaaagaattatctagagaatgttaaatgtatgactttgtttttctcaataaatgtcagcataataagcaaaggtgtccagttagtccactgagaaacaaacattttgaacttgcagttccctccttttgccacttgatggaaggttcttagaagtctagctatacaacatacttacaagcatatgcttaaacaataaaagttccagagtggcaatagaaaggcatacatagacatctcgctgtttctactattgcaacagagaaggaaagttagtcccatggatctttcaggagcagcaaaaaataaccagagctttactgttgccctgacaagaacccaccatccagagaggtatttcctgagcacctacaagaattccggcactgaggatgggcatcagagtgaggaacaggcaggtagccctgcattttcatcacagtatcaaaaggagaccatattctcctccaggaaaaaataacatagtattaaacaagcagtgaaaccccgtctct

SEQ ID NO: 22163 - DNA, 584 bp, Homo sapiens
cttttcaaaagatctctttcttagattcaaaataactttttaaatcaatttcaaaagaagagtgttttaattcctcacaatctgagacattcaacgagatccaatgctgtcaatgagagcctagccttatacactagtgggaaaaaaaaaaatggccttgtctgaaacacttttcacttgtcaatggttattttaactcagttaaaagtacaaaggtagtttgaaagaaggtttcagtgctaattcctaacctatttctaggcaaagtcaccaatgattaacactttttttttttttttgagacatctcgctgtttctactattgcaacagagaaggaaagttagtcccatggatctttcaggagcagcaaaaaataaccagagctttactgttgccctgacaagaacccaccatccagagaggtatttcctgagcacctacaagaattccggcactgaggatgggcatcagagtgaggaacaggcaggtagccctgcattttcatcacagtatcaaaaggagaccatattctcctccaggaaaaaataacatagtattaaacaagcagtgaaaccccgtctct

SEQ ID NO: 22164 - DNA, 2368 bp, Homo sapiens
  misc_feature (760)..(760): n is a, c, g, or t
  misc_feature (1153)..(1153): n is a, c, g, or t
  misc_feature (2298)..(2298): n is a, c, g, or t
gttttctaagacctccctggcccgccatacgccgatcctgaacctacgaaaacccaagactgcgggcacggtggctcatgcctgtaatcccagcactttgggaggccgaggcgggcagatcacgaggtcaagaagtcgagaccagccttgctaacatggcgaaaccctgactctactgaaaatacaaaaattagctgggcgtgatggcgtgcgcgcctgtagtcccagctgctcgggaggctgaggtaggagaatcgcttcaatccgggaggtggaggttgcggtaagcagagattgcgccactgcactctagcctggcgacagagactccttcaaaaacaacaacaacaacaacaacaacaacaaaacaaaacctcccaagaccctagtgggcagacacacagccagccagacatggagaggagcacattagcagaagaagacgcaagtggctggtcctcgagaggacgttgagaggagcatgccagcagaagagcacacaacgacaggcaccgacacaccaccggcaggccatgcaccagcagaatgatgcggagtttgacggggcagtcagagaagagcctgggccgccaaggggcccgactccaggggaaaaccatctcccttctggctcccccatctgctgagagctacttctactcaataaaaccttgcactcattctccaagcccacgtgtaatccgattcttcagtgtcacctcccaaatgtggaaatgcattgtctttcttctttcctagnccagtggtcctcaaacttgagcaggtttaagcatggtcatagcagaatcaatgtgctcaccccatcatgaaaaaaaaaatgtgttaatgaattgattactactttgagtgtgccatattttaaagacgaagagaaactaatcaagttagtttttatttggtcagaggcttgtttgtgcctgcttatctaaagttataaaggccccaaatatggctccgtgttgcagagggactgtctcttcttatatcgacagagcccatattcacaatgtatcacacttacctcgatgtattgtctggagtttcctaggctgtgtcctttgcctggaatgctctctcttgctggctggcttcttcccaccagctgtggccagggctgctccttattccttcntcaaaactccgtctgctgggtgtggtgcctcacacctgtaatcccagcactttgagaggccaaggtgggagtatcgtttgagcccaggagttcaagacaagcctggacaacagagcaagaccctgtctctaccaaagaaaagaaaagaaaagaaaagaaacagccactttctcttccatgagccagtttatgttttcttcacggcatttgttacaaatcacaaatgtggaggaaaaatgaaggcaaagcaaaataacaggcaagtctgaaaacaaaagtgttgccagtcacgctaagcctcaggcacgcattctgaatgaagctaaagtttaaagtcccctctgatagatttgtgacttaaatgtccacactagcaagtgtgtttctcacatggagaagtagcacgattttatgtcaggaaagggatgagaacatgcttcttgaacacatacaatgctgaagacatttcctggaaaaccattggcctttgcttaggacagttgcatcacacagagatgtttgtggttcagatttataagaaacatgggaactgaagccaaagcactacttttgctcagtataaccaggtgccagatctaaagtgttaggcaggttcctatatgtatgttagaaaaaagttgcccaagttttggacaattccttttccatctctcttacaagtcaacaaatcgaagcaataaactattctctgaagaaaacaaatttatttggttgattcaaacttttaatgagactattactcccctgtgtgcctttcctttctctggttctagaaatacatctagaaagggggaaaatgttaatatattttctactgactttatatcacaaatgcttagcttagagggtggactctgaggaacagtgtcctttccaaatattataaaactttgtgttcattctggaaaaacaaacaaaattaatcacaatgatttcctgctttggagcaatgagaaatgggagggaaacttcaccttttcatagcttttgatgtttgcaccatgtgaattacccacccccaaatttaaaatacgaatttttgaaaaagtgtttacctctgagaagagaaactagtagtgaagaatgaggagctgtagatttttaacgattctgatgtatttgcntttttcccaatgttcatgaataaataaatgtgcattcataattaaaaagaataaacaacctggaaaaaac

SEQ ID NO: 22165 - DNA, 285 bp, Homo sapiens
actacgacagggggatggggacactgattgcagcgggtgtttttttcttttttaagtacagaagaaatactttctcattaaaagtaattccacatagagatgtatgtgaattacagggagaaagccttcagcttccctccggctctgccccgagcccaccccataggtggccatcagtaaggatttcttgggaatccttccagataatttctacttctacaagcacacacctctacgaatgggaaaatattgtgggtaattttctaccgtttgctgttttgtgct

SEQ ID NO: 22166 - DNA, 468 bp, Homo sapiens
tttcttcatcccttccatagtatggagatgttgctggacaatggctgccccttcaaggactattatttcccagcctctcccccttgcatccaggtagaccctgttaccgatgcatgtctacgttacctctaggagacaggtggctgacccatgcattgtactgtatgtccacgggctttccaggttaattctgcatacgggacataataaaaagcactattgccaattcatgcactgaaacctcccatgaacataactttgaaacagattgaggatcttcgagaaatggtgtctcttgcctgtcatcccagcagtttaggagtctgagctgggaggatcacttgagaccagaagtttgagaccagcctgggaaacatagtgagaccctgtctctacaaaaagtaaaataaattagccagtcatcctagctgctagagaggctaaggcaagggtactgcttgagcccag

SEQ ID NO: 22167 - DNA, 774 bp, Homo sapiens
ggaagggcatgcctggagctaattactacaactagcgtgtagttttctgagagtggccctggcatttgcctaatgtttcattcttaaaggtttttgaaattattttggggctttgaagtgcttgctgtaataaatttattgagcatttaccaccccttatcagttatttagtcttcacaacattctcttgaggttaggtactgttgacccattttacagatgagaaaataaaggctcagtaaagctaaataacttaggtcagtcatatccatgagaggagtgaggcttggaatcgaggtcatttcaaagtttattctagtagtgactgctagtgctttccttgtgattttgtattaaagtagactgagactctccagaaactggacctgtgagcttggaccatggcatttctctgtgttctgtctcagtagtagcagaatgacatttgtcataagtaggcagtgctctgatttaaagcaatattttgaaattacttctttttacattttagcaagtgttgatgtaaaatactttaaaacagctctgttcaccactgtctgtaccgagcctttttatttttagagtgttaggtaattaaggcaaaaccatccacattgttttatgtgttctgtagacttctttctggtgtttgcttttactgtttttcagtattgtctacgggagaaaaaaagaaaaacctcagcttgcaaatttttgttcagagatgggatcgttctttgttgttggagggatttacattaaaaaaattcaaga

SEQ ID NO: 22168 - DNA, 439 bp, Homo sapiens
acacatatacaggagagctggttaatccctgcgagttgagctgatgggtggagacacagcaggggaacgaatattagcatcttctatgtgcatggtactgtcctaagtatttgtcagtcagtattctagacacactggagaagaacaaactcaaaaagaaaagtcacacttgagatttaactccagtgtttgttacaacacacagtatgaaatccatcccccccagttcctgcccctcccccactgccccacaccagactaacaggcattaaaagaactataactttcctacagcagtgccactagcaacacccaaatttaaaatcataccccactgttcctgctacttacagggacacattaacagtgaacgtcttgcccacttcaacatcctcctccaatgtaaggggacattattctcagtgtcattgataaggtt

SEQ ID NO: 22169 - DNA, 385 bp, Homo sapiens
actgttctaggtcccggagatgcaacagcgaattgagcaaaccagaattttattctcctacagcttgtgtcctaattggagggatatgttggtcaggattctccagagaagcagaaccagcaggagatatatagaaatggagatatagatacaggtggagatttcaaggaattggcttatgtgattgtaagatctggcaagcctgaagtcttcaggacaggcctataagccggaaactcttggcaggagctgatgctatagtcttgagcagaatttcctctcagagaagcctcagggttgtttggttggtgggttggttggttggttttgaggtagagtctcactactgcactccagctgggcggcagagcaaaactccatctca

SEQ ID NO: 22170 - DNA, 414 bp, Homo sapiens
atgtcagattttctagcaaagatatttcacaattaatagtactaaactttgcttactaaaagtatttaggattcagtgtattaacaaaactctatagtagttaatataaataatattcgttttttaaaaattagtcttaattgcacattcctggaaagtattgtgtttttttaatctctgcaaaaacaggattttaaatattttatgtcataaaacttctgttcattttcttttgctgtatgaaaaaaattaataggattgatagagtctccatttttcttttatgattgcgttttagcggggccaatttaattttaaactgtagatatatttttttactgtatttgctgcattctgtggaattgaattgacagggtatagagttgtacacaagggagtcagaaggtacaatta

SEQ ID NO: 22171 - DNA, 830 bp, Homo sapiens
caggtgcctctccactagacagtcagacaaaggcaaataatggaggatagagagacaggtgttcattaggctggccatagggagaggaagggggtgacagcaggggaaaagaaactgtagtatcagttgtcacaagtagagctcggcccagctttccctcccttcccagccaccctagaattgagagtcccagtgcccctagtgtcgactttctatgtacatcctaggggtgagggagtgcggggcaatgggtaggatataaagcgtaaaggacaaattgccgcagtcttctaattgatgcttccaaactcaggaagggcttatccagtgtaaaatagccccaagcccagcaaccttctagagggctctggctgggcagatagcttttgtttttgagtctccagccctcagtcaaggaaaatataccatagctgctttcttgtcagtggcctttgagagaaagagaaaacaaatctagaattctgttcatctgatagaccgggggagctttgctatggtaggaggtttaggaagggcctttcacgcatagaaaccattgttgatattgccactcccctctcctctgcctcacagaactcctgattctgtcttctttctctctctatatatatattttaaaatgtttaaatggctctaattttttgttttgaattttgaatttaccttttggagttcttctcatgtgaatctacttgttagattgtattaatgagtgtttctggtttgggcatgggaagtgatgggggcctgaagttattttgcagtggctaatggcactgaggaatttcttttttggtgcatttggttta

SEQ ID NO: 22172 - DNA, 118 bp, Homo sapiens
catgaatcattttacttaggcaatcttcagttgaacataccttgttaggaaggaccaaatctcccagatggttgaaaggcaatatgcattgaaatgtttataacattttttaaagaac

SEQ ID NO: 22173 - DNA, 262 bp, Homo sapiens
gaagcacaaagccatcctgattcccgcttcgtatgtaacctattctcatccttctgaaggtgtgtaggatgctgtctttaccctgatatttggggtccagcaacatgccatggcaatggtctttgatcacagacgttcatccactggactgggtacttggtggctccttcagtctagaagaggatgacgctcaagagagggtttttcaattgtttcattatgctgtcctccccgccgtttctttgcggtacttgttgaatgt

SEQ ID NO: 22174 - DNA, 382 bp, Homo sapiens
cgcgtgccacatacctgagatagaggaagcacattaaaagtaagtcatggacagaggcctgggtgaggactaattgtggtgagctggtatagcagtttattgtttgatatagtagactgcagagaatcattttaggtttttgaccaggggagtagtaggaaaatttagcccatctccagtggagatcatagaaccttagaagtaagggatttctggaaacatcttatccaatatcccatttttacttaggccagagaagtgaaataacttgctcaaaaggtcacccagttagaaaagagcaaatctgtgtctcagatttatcctttaccttgtagtccgatgatctttctttcatatcacagtcctccaaaagatattagag

SEQ ID NO: 22175 - DNA, 391 bp, Homo sapiens
ggattatggagtcagagaatctagattcagatttgagctattcccttaactgagaaaatggggcaaggttcttaactcctgtgaactttagtttcctcacctgtaaagggaggataatgatgctgacctcattggattgtcaagatgatgaaatcctagttaatgcatctaacatggcacttggcacgtgggagctcaataaattctcatcatccaaagaacaggattccttttctatcatctaaagatgacctttgcatagtataaacccaggttattttataatccatatactttttttaaaaaaaaagatgaaaacaatcatttttgaataaagatgctctaaaattttggggaggtaggtaaactgttaataaaatcttgtctacat

SEQ ID NO: 22176 - DNA, 321 bp, Homo sapiens
actcctcacccacaactgtgatatcacaaatgtgtcttggtcttgctttaagcgactaaatttgcggtatttttttccatagcaatagaaaatcactatagtactattcactcatgtggacagtgaagttgttttactttgtttaaaattaagaaataacagtaaaatccacatatcttaagtattaatctcaatggatttttatatatacattcccttgataaagaaacaaataattttgttaaacagtttttaatattgctattgttttcttcctaaaattttcataataatttaacattaaagtcctatgcaactaga

SEQ ID NO: 22177 - DNA, 732 bp, Homo sapiens
actcacaaaaaacagctccaggcttgttataatggaataaatgagtcctaagtcttaggccaatgaaacctgacataacttcggaggctaaggtgggataatcccttggccccaggagtttgaggccaacctgggcaacacagcgagaccccatgtctatattttctttagaaactgacatacttctgttttcatccaacctgaactttaaatatttaaagttcattaacaaattcatcaaagatgtcccccagtttataatttcttctttcaaagaagcatccacagtgcaaacccccaaaatctttaataaaccaataggttcttagctataccgtgatgaaaatacctaatgctttcagtgtttctctaacaaggagaataaacatctattaactttctcatacgacagtggatgttatttgccagttacaaaaaagagattactcaactgaataattttgaaataagatgagataaagtattttttagatagatcaagttatttactagacatataagcttactaaatgtccttgtaacaaccatagtaatcctaagaatttctgtcatttgaattacatccataattagcaggcagaataaaataaaaatctacagttcctcaatgttgtcattattacattattattgataccttcacaagtaacaagagaccatcagagtcgggaaaaaaacatttttaatctcgaaatggcatattaactttag

SEQ ID NO: 22178 - DNA, 334 bp, Homo sapiens
tggcctgtgccagactagcgaggtgccaggaggacctgcccagagccagcgtttgcggaaccgacttgccttcccagaggccctttgtgaactcaggaggctaatgaaatgcacgagaatgttattaaaatacgttcgcacacgtttggagagtcttgccttagatggattgctgcttcagtgccctccttgcctcactttttgcctttcgctctgtaaagctgccttgaggacctcctgctcgaggggcacacatccttgtgtcacccttattccaagggctgggcacagtgcatcattttgctcttgtctctctttatggttcaggacttaa

SEQ ID NO: 22179 - DNA, 230 bp, Homo sapiens
ttctttatttttatttagtttaaagagttaggagattctgtggtactggccaaagtagttttaatacatccgctatccaaatgtatgagagaaatactttccacacagtattggttaggaactgagaatatgcatatatgatatatagaaactgtacctcaaagatctggacaccacatggatataacttgtgcttgtgctgaacaaattggacctactctttattgaaa

SEQ ID NO: 22180 - DNA, 557 bp, Homo sapiens
ccattagcagtcactctgcatttcaaccacagatacttctgctctaggcaattaccaggctactttctgtctctgtggattttttcattctggacatttcctagaaatggaatcatataatatgtgatcttttgtaactggttgcttttacttagcataatgttgttaaaggctcatccatgttgtatcatgaatcagtactttattcatttttatggccgaataatattccagtgtgtggatataccacatctagtttattcattgaccagttaatagacactgggtcatttccacttttcggctatcataaatatgcctgtattaatatttatatgcaagtttttgggtagacatatgttttcatttctctttgatttctgagttaaatgataactcgatgtttaacttttaaggaactgacagactctcttccaaagtggctgtacccatttataaatattttttgaatgaaagaattctgtcatgctgaaaatgctttttattcaacaaatactcatttagaatatgtggaaaaaggcaaatagcaaaggaat

SEQ ID NO: 22181 - DNA, 601 bp, Homo sapiens
cagtttaaactgattttctctcatctccattttacccctctccccgattaaaaaaaaagtcaccaagtaaacaatgacgtagttacagctagggcctatgaattcattattcacctctgtagtagtgttatctcagaaggtttcataaaggtatatgaaaaaatgtttatgtgagggggcaggcttctctgataagctttagaatttaggaaaaataacattaccagactttttgttaaaaggagctagattttctgagtttggggtttattttgtttggaagtgaattactagccctatttaatcagatttgcagcacagcattcaaaatttttcatttgattaaatcgcaaagtttctagttttaaagcctcagagcttcctgtgttcccctgtacgaaactaaaaatcaagatataaacaaaaggataccacagatgccttcagattgtttttcagccttttcctggcctctcttttgagtctgtcatttatctaattcaggcatacctttcttgacctagtagatgtctatcaactgttgtgtccacacctagaaaatcaagtgccctattaagaagctgtactttacaaaaaaaaa

SEQ ID NO: 22182 - DNA, 508 bp, Homo sapiens
aatcactacactgtttccacaactgctgtggaagttatatcaaaataagagagaaccaattcattccttttcagaaaagtaatgtcagggagttcccaagccaccctgtgtggatatggttaaaatggactgaaggatggtggtgatcattgcacaacaatgtaaacatacttaaagccactgagctgtgtgcttaaacattaaaatgataaaaaaaaattgtatatctcaccacaatttaaaaagaaaacagggctgggtgcggtggctcacacctgtaatcccagcactttgggaggcggaggcaggcagatcacctgaggtcgggagttcgagatcagcctagccaacatgatgaaaccctgtctctactaaaaatacaaaattaggctggcgaggtggcacacacctgtaatcccagctactcaggaggctaaggcagtagaatcttttgaaccctggaggtggaggttgcagtgaaccgagatcgcaccattgcactccagcc

SEQ ID NO: 22183 - DNA, 416 bp, Homo sapiens
tatagtcttatttctgggtctcaagctccctaatcaaatacctgtttttactgggactgacttttatcatcagaacatcccttaaagtagttggaagctagcagccttggattaaaagctggctgatagaattcaagtctcatacagtggtgtgagttgtggcaccaaagctgtgtttgaaacataagaatgtggttgacttttcaatctatttttaaaaggctggtgaactacttcattcttgggtagccctagacctttacttctccttgctggcaataaaattcaggatggccgggcatggtggctcacgcctgtaatcccagcacttcgggaggccgaggcgggcagatcatgagatcaggagtttgagaccaatctgaccaacatagtgaaaccctgtttctactaaaaaa

SEQ ID NO: 22184 - DNA, 364 bp, Homo sapiens
agaaaacattggtctgcagaagtaggtgatgtttgcagaatctagaatggatagcattctaggatgttttaatgggaagagcctagaactgggggtcaggaaaagtaggttgtggcacagcttcttccttagtttggttcattaaaaaccctgtgggcccagtgatgggtgttgagaaggaattcagaaatgcttacacttgtctctgcccttgaggaccttgtgttctagaaaagagaataagaagcatgcactaataacagtaacatggtagtaaactcaatacgggagggccagagaaggtgccaagggcatcaaaggaaggacccaacactttctttctccctgggagagaggaaagctg

SEQ ID NO: 22185 - DNA, 402 bp, Homo sapiens
tcactgaagtatcccaacatctagaacgtgacctgtggtgtatggtaggcattagatattaatatttgtggaatatgtgaatgaactaactcacaacttattttctctctctggcatattaagtacatgttctgcacacgcttgtgtattcctgattacagctgttggtgacattagaagctgctgttgtggaaggatagcaatggaaggcaggcagcagggaccaaggaataagtgatcagtgaggaaatgaaagcaaaatgtagagcccttgttcacataggccggagtgaagggaaaatattggcttgctagaggggattccagggcaagacatgagttggttattttattttttttcttgttctacaactgcagagacttgaacttatttatatgttg

SEQ ID NO: 22186 - DNA, 279 bp, Homo sapiens
  misc_feature (55)..(55): n is a, c, g, or t
  misc_feature (66)..(66): n is a, c, g, or t
aagagggaaggcttagcatcgtcgtccttgatcagaagggtgatcagcaccgcanaaccccagggncaattggacctacagtggtagcatttagaaaaacatctttacctccaaacaagagggacacaaccaaatcaaagtgattattagagacactttgtcctggagcctgctaaagagcataccccttccttgacctatttagagatactctgtggactttgttcaggaaagaaagcataacagtaatgttcctggttgacttgaaggtaggtggga

SEQ ID NO: 22187 - DNA, 196 bp, Homo sapiens
aaaacaatattaactttggatttttaaaaattatcccaagagaaaattcttttaaaaagattctaagatctatctatatcttactacttatgtatatctatatcttacttatcaaaataatacttttggtacagaattcattttccatttcagtatctgttctgtcccatttttattgagaaagtccaaattctgt

SEQ ID NO: 22188 - DNA, 452 bp, Homo sapiens
cccttttgtcacccacgctggagtatagtggcacaatctcggctcactgcaacctctgcctcctgggttcaagcgattctcctgcttcagcctcctgagtatctgggattacaggcctgtgccaccacacctggctaattttgtatttttagcagagacagggtttcaccatgttggccaggctggtctcgaactcttgacctcaagtgacccacccactttggcctcccaaagtgctgggattacaggcgtgaggcactgtgcccgcccgagaatctgtgtttttcactcatagtttgggattgttcttgcagctgaatacctctgaaataataatcaatgaatatttcattcaataaatatttactatcctcttccgtgtgccagtctcctaagttgtcttaggataataattattatcctaaatcatcccattacttcttagatattta

SEQ ID NO: 22189 - DNA, 1412 bp, Homo sapiens
ctgcactgaggcatggggcggggtgcactgaggatccgagcgagcagccagggctgcaggaaggcagctttggagcacaaagggggtggggcaactcctggcttctgcgggaaggtgtaatcagcttgtttcatcatgctgcaggctggcgagaaacggagccttacaagcgtagggataagaggaacccctcttggtcccctcgatgagggttgttgggccggggagcctcatccacagggcggagtgaaaggggagaaggggagctcacaggcaggcctgccaaggccttctggctttgccagatgtcaagggcagcacctaatactgaaccttaactttcggctttcaaccaaacggcacccttttgctgtttgttttctggaggggacaccttttcttgattcatgcccagacctcccttgtccaggccatgaaaactctgggatggtcgaggccggctgcccatctcagatgggcaaggaagcaaaagtgcagagtggtggaggggccagcttgcagaaacacggccgaacccggccctggatcctagcccagggtctttccagcacaggaggctcctagccctcgtctccaaccctccatgccactgatatctgtggccctgccacaaagttaccctcatgcccttccctggagaccccactctgggccacctcaatctcaggcccctcaactcacctctttcaccctgtgtacactgggtcaatcactcctgcctcctcacagctcccaaatccacctacttcccttcactctggctacaccctggttcacaccacggttgtagctccaaactggtccctgatgtctacattgcactctgcacaacagccaccatgcttattaagaaacgcaatccaaaccaaatccctccctgctgaaagccctccagtggctcacaataaggatcacacttctccccctgcctggtcaggcagccatgggaccccagcctttcctcccacttcggtaaattttaaaggattcggatcatacaaagaatgttcttgaaccagcatggaattaaattagaaatcaattatggaaagagatatagaaaacctcttcaaactatacaacacacttctaagtaacccacgggtcaaagagggaatctcaaaggaaatgagaaaagattttgaactgagtgaaaatgaaaaaatggcatatcaaaatttgtgagatgaagctaaagtaatgattatggggaaattgatatcattaaacactaacattagaagagaagaacgttccaaatcaaatacctcagctttcacctggaaagtagcaaaagaagagtttattaaacttatagtaagcagaagaaataatacacaagagaaatcagagaattgaaaaaacaataaagaaaattagcgaaacctaca

SEQ ID NO: 22190 - DNA, 358 bp, Homo sapiens
tcaatgtagttttcaaatcttcactaaataaactcaagctttttagtttgagtgagcctctattatttaattatattagcaatatattgacgaaaagtctctggaaatagtaaatcaactgggaagttaaaattatttcaggattaggtgttggaagtcctgttttcaccccctggggtttcacttacagaggaagtcaaagacatatgtgtccaggtgtaccagccatctggatcaaagccagaccacttggtctaccacagagcagttagcagttcctgcttctggaaaaatgtgttggtttttcacacaggtgctgcgagatgttttccttttcaccttaactgatagaaagtca

SEQ ID NO: 22191 - DNA, 140 bp, Homo sapiens
ctagtactttggcacaaaatgggcagcagcgggcagaggacgctcctctggacttccctgcggggaaggacatgaggtcaagcctcactttgcttagtgctggccagctcatcctttagcttctgcagctcagccttcag

SEQ ID NO: 22192 - DNA, 453 bp, Homo sapiens
cagatgtagccgttctgtctggggccaagcgtggagataattctggttgtggatcctgaaacgtgataaagctggagaaagggagtttccaaggcaaccagccccttctttgaggggtgtgggtggtgcttcctccccacaccttatgagccgacatccttggagggcagatcacccgtgacccccaaatatcttctcttttcacgaactctgctttgcttgttctccaatgttatttttagcatattgtgagagagaggagagagagagagaaagagagagagaggagcaggaaactgagaaaaagtgaaaataggtaggaaaaaagcaaagcagagtggtattcaagacgccaagagaggagtcgcaaagggtgatcccaggacacacatcaagggataaacggagttattcaagggtaaatagcacagagggggcaagagattaaatagg

SEQ ID NO: 22193 - DNA, 304 bp, Homo sapiens
cagatgtagccgttctgtctggggccaagcgtggagataattctggttgtggatcctgaaacgtgataaagctggagaaagggagtttccaaggcaaccagccccttctttgaggggtgtgggtggtgcttcctccccacaccttatgagccgacatccttggagggcagatcacccgtgacccccaaatatcttctcttttcacgaactctgctttgcttgttctccaaacaaaggccccagatttgaggtctgatcacccaccctaagcctcagaaaaaggctgtgcagagaactggtgatt

SEQ ID NO: 22194 - DNA, 743 bp, Homo sapiens
ctgctgcctccaactgagggcactgggccaagacataaaggaaggcaagtagagatcagcaaaggaggaagggtaggacagcaagatggaagatatttggggaaagatgatgcaaaagccaggaatgtatcctattctcctgtttgttaggtaggcaatagagccaacaccaagacacccaacattctggtctacacatacacaggaacaagtcctcaaatactagtgataaaggagacagggataagcattcagagggccataaatgtctgtctaggacacttgcacatcattgcatacaagcacaacagaagattatctggaaacgttgtgaccaagggataatgcaaatatacttagttttaatttttccccgaaaagaataaagaactctttgaggatactttgggtaccctatagcctatagatcttgacacccctatggtccctttcccctaaacaattgtttctcacactttaaggcattacaaatcccttggggatcttgttaaagtgcagattgctatggtttgaatgtttgtctcctcaaaaactcatgttgaaattttacctggccaacatggtgaaaccccgtctctactaaaaaattacaaaaattggccgggcgcggtggctcacgcctgtaatcccagcactttgggaggccgaggcgggtggatcatgaggtcaggagatcaagaccatcctggctaacacggtgaaaccccgtctctactaaaaaa

SEQ ID NO: 22195 - DNA, 472 bp, Homo sapiens
taatatacaatttttgtaaggatgtgaccaaatttgttcccttacactctaggattataaaatattataacgtctctggagaacagtttggcagtatatttcaaaaaccttaaaagtatgcgtgccttctaattcagcaattctgtttttgagaattttcacggaggaagtagattgcctgcagaggcttacttacttttgacagggggtaacggggcatatcataatgtcatttataataatagaaagtggtaagcaatctaaatgtcattaggggtttggataattgaaatatataaaatacatatcatggagtactatgtcttcattaaaaatagttttgtagaagaatataatggcattaaaatgttttataagatattaaatgaaaaaattctggcttccaaaccatatatatagtatgagcccaagttttgtttttgggtttttctatcaatgatttgttatctga

SEQ ID NO: 22196 - DNA, 481 bp, Homo sapiens
ctaataggtagactgcttctgtgtgattcatcacatgaccaagaagaacaaaggattgtctctttcgagtgacattaagggggaaataaatctgttttgtcacccttgcattagggccctgcttttcagcagatgttcccgagttcatcagcttctctttggaccaaagaatttctcagtaaaggttaaaaataatctggccgggtgcggtggctcacgcctgtaatcccagcactttgggaggctgaggcggtcggatcatgaggtcaggagttcaaaccagcctgaccaatgtagtgaaaccccatctctactaaatatacaaaaaataattagctgggcttggtggtacacgcctgtagtcccagctactcaggaggctgaggcagaagaatcacttgaacttgggaggcagaggttgcagtaagctgagatcgcagcactgcactccagcctgggtgacagagcaagactccatctc

SEQ ID NO: 22197 - DNA, 905 bp, Homo sapiens
ctccacccgacggggtggagtggggtctgaaggctgagaagggagccaagggccagctcagcagcacacacaacaccagggcagttagcttgtttctctcttcccctgtcgcacaggataccttcctgctgtccttcctgagcacaacctggctgaaaacctggaggtcacaacagtacaaagaatcaaagtcaagatcttgtgccagagagcaaatgaactcttcctcttgctgagaaaacccaccctgctcacctaaaccctggccttgcctggtaattccatccatgcgcctggaaggccccagacatcaaggctctgaggggccaggcacggggagaacccagcagtgccctgccctgcagtctgagctaccagattccttgtgaagataatttgaggaccatgactcacccaaccacatttcctggggcctcaaattgaaaattcaggatgggcttttctatatgactggctgatatccaactatgccatggtctttacatgccatgaacattctttcctgccagagttctaagaatctgtgttctctgccttagaccttctgcagatgagcccacaggaagctccacgtgtagctgagctacatgcaccaggcctcagtttgccccaagtcccctgtgtactctctcatggcctgtggccaagaaatgtattctctcactttggacttaggagtccaaagagaagcccagaaacaaaattgcttgaacttgaatttgtgtgcgtgcgcacgtgtgcacgtggtggtgaaggtgtatgttttcggctgttctatgcgtcactgtcaccaaactcccaaataatagtaacatttgtttagatgatgtctgctgacaaatcacaaacacgacgctaactcgcaactctctgctccactggca

SEQ ID NO: 22198 - DNA, 381 bp, Homo sapiens
atggacattgaacttgcctagaaaactgtctggttttatttcaaaacgctaagcctcagtaaaggagagaaatagcaggccacagctgaactacattttctagcaatcctcagaataagatgtggtcattgactgaattctggacaatggaatggagtagagtgaaatacatcactcctaggtttggcctgtcaaatctcatgcacaattctgtacattcatgtgccagcctctcctcgggtggggactccaagcactttggagttggtggagccacaagatggatctgagatctttgctaaggtagggtttccctggctggcctatagctgactgtgacataagagagaaataaattttgattttcttaagctcccaaaa

SEQ ID NO: 22199 - DNA, 266 bp, Homo sapiens
cctttaaaagtttctggccttgcttaaggagataagctacataaaagtcagaacctgagtttatgccattttgcttctttcttatttaacagcacactatataactacaaggcttttaataagttatttctgatgctgttaacaccatttggggctttaaagattgaagtttcctaatcagagacttgttttctatctatctatctatctatcaatctatctatctatctatctatctatctatctatctatctatcatctgtcta

SEQ ID NO: 22200 - DNA, 827 bp, Homo sapiens
  misc_feature (13)..(13): n is a, c, g, or t
gggggctggtccnctagtgtctgggctgggctgcatgggctgcagtggcgccgacctgctggatgatggtggtgccccgtggctgctgaggctgtgagtccctggctgctgcatgccatgtgctgtgtgtgtgtgtgccccctgtgcatggctttgcatgaattcgcctcctgtcgctcctgtgtgatgcctgcatgcatgtgacctgtgccagtgatggctgccatagaaggtggagccccatccctggtgctgacagtgcccaccgctgccctactgatggaccatgcgtgcctgtcctggcggctgtgggtgtcttgcgtgtgacccaccggcctcttctgagtggccatgctgcaactacctgcccaactttatccatgagctgtgctgtcgtccatctgacctgcgctgaccgtcatgggctgcaccatgtgtggttgggcatgcgactggcaggtactttagcatggactggccatcgagatcgtggtgcagatggcctgtggccaacgggcattggatgactgattattggacagaatggcatcttgtcaacacctgcggtctcctgcattatcaggaagatcaaggcagctggtggaatcattctaacagccagccactgccctggaggaccagggggagagtttggagtgaagtttaatgttgccaatggaggtcctgcacccgatgttgtctcagacaaaatctaccaaatcagcaaaacgattgaggaatatgctatatgtcctgatctccaaatcgacctatctcgactaggaagacaagaatttgacctagagaacaaattcaaaccattcaga

SEQ ID NO: 22201 - DNA, 463 bp, Homo sapiens
agtaagaattatccaaaatatgaaaaatattttttaaaaaggtaacaatccaaaagggaaatgtgaaaggatttgaataggcaattcacaaaataggaaacctgtatggttgatacatacttgaaaagatgcatccttaaacaaagaaatgcttgaaagaaggataaaaaatgttttggatggtcttacattagcaattaaatgctgtggccagaagtaacactttacttaggccctgagtgattaggatgatcagagcttgcctggtgacccataggaaatagaacacgagcaagaaataaacttctgttatttaaagccactgagattttgggattgttattgcatataatttagtttatggccgggtacgtggctcacgcctgtaatcccagcactttgggaggtcatagtgggctgatcacctgaggtcaggagtttgaaaccagcctggccaacatgg

SEQ ID NO: 22202 - DNA, 402 bp, Homo sapiens
acgtagtaggagaggctagccaagatctctggtgtcttataaaggtactaatcccaaatgtcagggctacaatctcatgacctaatcaccttgaaagcgtctacctcctaatactatcaccttgggatgtgagtaggatttcatcttactagttttggggggagacaaacattcagacatcctccttccctttttttccttctaagaatgcattccgttcttcttactaatagactgcaaactaaggggagtttcttatcctgttggagaatattctcaaatcattttctataaatggattactgtaggccagcagctacctttttctgcaatggtttagtggcccacatgtgggtcagggtttcccttcttgggacccttttttggtctggagtttgaact

SEQ ID NO: 22203 - DNA, 978 bp, Homo sapiens
gataagcaaacagcaaaaaattaccaatgaaaagttaggagttcaaaagaagtagtctgaactagatagattagatgtcatcctgtgaaataggtttaccacatgatagggaagaactttcaaacagtacagggtctattttcagttattcactatgaaatgagaacatttcacagttgttaaaggttgctttcagaagaaaagcccaactgatgaatgtttttaaaaatgcactattgagagcgaacaacagactggatgccataattttatagtcaagtttgggacaagttttaagaaactgtgttacaattcagagaaaagacagttggtgagcatattaagagatatagggaacagatttagatgatccaatatgcttattatcagaattccagaaaaaggcatgaaatcataaagaagacagaataccaggcaaaattaatgaaaaaatattaatccaaacacatataataaaaagtatcaatttcaagaataaaagaattatataagcatttaacacacataaacattggttacctgtaaaaggtgaaaaaaaaaaacaggttcagattttctgcttaaatatcaaagggcaaatggaacatttttacgatcacctaaaattcttgaaataggccaagatttttcatatacaaaggcaacagccttcttgccacaactaagttcagtgtacaagggtgcatggactcttcctgaaagaaattactagaaataggattctgtatgataagagattaatctactgaagatcttaagaatgggaaagatgtgatatgaaagaaatggtggtaagcagtaaaccagtaagactcaggatgaatgtcaaaataattgtaattttctgaaacaaccagaaaatcttaattattaatagaagttacaagaaaatgatctggacttaaaagtccaggaggttaagatagtataaaaagtatatatatgcaaactctgtta

SEQ ID NO: 22204 - DNA, 947 bp, Homo sapiens
gataagcaaacagcaaaaaattaccaatgaaaagttaggagttcaaaagaagtagtctgaactagatagattagatgtcatcctgtgaaataggtttaccacatgatagggaagaactttcaaacagtacagggtctattttcagttattcactatgaaatgagaacatttcacagttgttaaaggttgctttcagaagaaaagcccaactgatgaatgtttttaaaaatgcactattgagagcgaacaacagactggatgccataattttatagtcaagtttgggacaagttttaagaaactgtgttacaattcagagaaaagacagttggtgagcatattaagagatatagggaacagatttagatgatccaatatgcttattatcagaattccagaaaaaggcatgaaatcataaagaagacagaataccaggcaaaattaatgaaaaaatattaatccaaacacatataataaaaagtatcaatttcaagaataaaagaattatataagcatttaacacacataaacattggttacctgtaaaaggtgaaaaaaaaaaacaggttcagattttctgcttaaatatcaaagggcaaatggaacatttttacgatcacctaaaattcttgaaataggccaagatttttcatatacaaaggcaacagccttcttgccacaactaagttcagtgtacaagggtgcatggactcttcctgaaagaaattactagaaataggattctgtatgataagagattaatctactgaagatcttaagaatgggaaagatgtgatatgaaagaaatggtggtaagcagtaaaccagtaagactcaggatgaaagcactttgggaggccataggcaggcgaatcacttgaagtcaggagttcaaggatctgcctggcaaaatatggtgaacacaaatgtctctaccaaaaaatagg

SEQ ID NO: 22205 - DNA, 3140 bp, Homo sapiens
ggcacgagggtcctctgttaagagtgctactcgcccggggttgatctgtgcatgccactcctgggtcagacggtgaggtcggcgtctgcgaggacgcggcggtggagtagaagggcagccggagacaggcccggcgccccttccgaggctagacggccccagcttcgcggggatcatggcattgctggtggaccgagtgcggggccactggcgaatcgccgccgggctcctgttcaacctgctggtgtccatctgcattgtgttcctcaacaaatggatttatgtgtaccacggcttccccaacatgagcctgaccctggtgcacttcgtggtcacctggctgggcttgtatatctgccagaagctggacatctttgcccccaaaagtctgccgccctccaggctcctcctcctggccctcagcttctgtggctttgtggtcttcactaacctttctctgcagaacaacaccataggcacctatcagctggccaaggccatgaccacgccggtgatcatagccatccagaccttctgctaccagaaaaccttctccaccagaatccagctcacgctgattcctataactttaggtgtaatcctaaattcttattacgatgtgaagtttaatttccttggaatggtgtttgctgctcttggtgttttagttacatccctttatcaagtgtgggtaggagccaaacagcatgaattacaagtgaactcaatgcagctgctgtactaccaggctccgatgtcatctgccatgttgctggttgctgtgcccttctttgagccagtgtttggagaaggaggaatatttggtccctggtcagtttctgctttgcttatggtgctgctatctggagtaatagctttcatggtgaacttatcaatttattggatcattgggaacacttcacctgtcacctataacatgttcggacacttcaagttctgcattactttattcggaggatatgttttatttaaggatccactgtccattaatcaggcccttggcattttatgtacattatttggcattctcgcctatacccactttaagctcagtgaacaggaaggaagtaggagtaaactggcacaacgtccttaattgggtttttgtggagaaaagaatgttgtcccaagaagataaaaaatattgttaagtgtgcaagttattaaaaaaaaaaaaaaaaactcgagactagttctggcgagtttgtagcctctggttcccaggacacaaacatcaagctctgggacatcaggaggaaaggctgtgtcttccgatacagggggcacagccaggccgtgcggtgtctccggttcagccccgatgggaagtggttggcgtcggccgcagatgaccacaccgtgaagctctgggatctcactgccggcaagatgatgtctgagttccctggtcacacggggcctgtcaacgtggtcgagtttcaccccaacgagtacctcctggcctccggcagctctgacaggacaatccgcttctgggacctggagaagttccaggtggtgagctgcatcgaaggggagcctgggcccgtcaggagcgtcctcttcaacccagacggctgctgcctgtacagcggctgccaggactcactgcgtgtctacggctgggaacctgagcggtgctttgatgtggtcctcgtcaactggggcaaggtggccgacctggccatctgcaatgaccagttgataggtgtggccttctcccagagcaacgtctcctcctacgtggtggatctgacgcgtgtcaccaggactggcacggtggcccgggaccctgtgcaggaccaccggcccctggcacagccactgcccaaccccagcgcccccctccggcgcatctatgagcggcccagcacaacctgcagcaagcctcagagggtgaagcagaactcagagagcgagcgccgcagccccagcagcgaggatgaccgggacgagcgcgagtcccgcgcggagatccagaacgccgaggactacaacgagatcttccagcccaagaacagcatcagtcggacgccaccccggagaagtgagcccttccctgcacccccagaggacgacgcagccacagcaaaggaggcagcaaagcccagccctgccatggatgtgcagttcccggtgccaaatctggaggtcctgccccggcccccagtggttgcttccacacctgcacccaaggctgagcctgccatcatccctgccacccggaacgagcccatcgggctgaaggcctccgacttcctgcccgccgtgaagatcccccagcaggccgagctggtggacgaggatgccatgtcacagatccgcaaaggccacgacaccatgtgtgtggtgctcaccagccgccacaagaacctggacactgtgcgggctgtgtggaccatgggcgacatcaagacgtcggtggactccgctgtggccatcaacgacctgtcggtggtggtggacctcctgaacatcgtcaaccagaaagcctccctgtggaagctggacctgtgcaccaccgtcctgccacagattgagaagcttctgcagagcaagtatgagagctacgtccagacgggctgcacctccctgaagctgatcctgcagcggtttctgcccctcatcacagacatgctggcggccccaccctctgtgggtgtggatatcagcagggaggagaggctgcataagtgccggctctgctacaagcagcttaagagcatcagcggcctggtcaagagcaagtcaggcctgagcggccgccatggcagtaccttccgcgagctgcacctgctcatggccagtctggactgaggaaagcagtgggcaggggcgctcggcagcccacagggcctggcctcagcccccactcctgttccttgtgcacccactggcccatgagcctctgcctggcccctgctgctgtcctgtggccgtcctggaggaggtgatgctggtccctggccacctctacagccctgaactcttgagacaactctctccagcaatagctgcccagctttgcccaactgttgcttcttggggcagcgaactgagccctggggctgctgctgtaatttataaggcaaattttattaaatttgtaactattacca

SEQ ID NO: 22206 - DNA, 923 bp, Homo sapiens
  misc_feature (805)..(805): n is a, c, g, or t
  misc_feature (817)..(817): n is a, c, g, or t
  misc_feature (820)..(820): n is a, c, g, or t
  misc_feature (824)..(824): n is a, c, g, or t
  misc_feature (840)..(840): n is a, c, g, or t
  misc_feature (851)..(851): n is a, c, g, or t
gggacgaggtggcgaggggacggtgggccctgggctgggccgagccaggcggggctggctgggcttgcgggcagagagctctgagcgtggggaggctagagcccgtactccgcaagcagagggttgggaggatcagccgtggccgagggacctgcccccgcccccggacgagaggggtcggggtggaggccggagggggcaaaaccaggaggccggaagcagagctgggggtctgcagaaggacagccctgtattgagctgagatggctcgagcctaacattccatgatccaggatcgtgacagatgtgcacaggctgctgctgttgctgctgtgggtaatttggaaccacgaggcaccccagggccagaagacgaggcattctgtctgcctggatgtgtgggaactctctgccaacttgattggtggatctggggggggatccacccccaccccacgaggaaagcacagtttattttgtgggtggggcttcaggtgccagccagctgaaggatggccacccctgtggtcaccaagacagcctggaagttgcaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaatttngccctctgggcncangccnttggctggttcacgtnggagttgtgcntggtcccgagagaacatacctggactcggggagggggttccaaggggcgcccgcgggcgggcacgttctcgc

SEQ ID NO: 22207 - DNA, 1122 bp, Homo sapiens
gcagctgattggtgcgggaggcaaggtgggcggggctctgagccggaggtttgttgtgagggtcggttgtcaagcagcggccaatcaaggcaggggatggaggcaagtgggggtcgcgcctggagcggagcctcggcctccggagccgcagctgcagccctgtattgagctgagatggctcgagcctaacattccatgatccaggatcgtgacagatgtgcacaggctgctgctgttgctgctgtgtgccagccagctgaaggatggccacccctgtggtcaccaagacagcctggaagttgcaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaattcttcgcacactcatgggacacaaagccaacatctgcagcctggatttccacccgtacggcgagtttgtagcctctggttcccaggacacaaacatcaagctctgggacatcaggaggaaaggctgtgtcttccgatacagggggcacagccaggccgtgcggtgtctccggttcagccccgatgggaagtggttggcgtcggccgcagatgaccacaccgtgaagctctgggatctcactgccggcaagatgatgtctgagttccctggtcacacggggcctgtcaacgtggtcgagtttcaccccaacgagtacctcctggcctccggcagctctgacaggacatcagttagtggaccgtggggcaagtcccagatgagtggctgggcttcacaggtaaaccctagccggacagacaacgccactttcacccagaggatatgcactttacagcaggtggccggcacccaggtgtcttaaggttggcagctagtagagcttcaagttacccacacatgtgaaccgtcccagtcgcacctttgcacgacgagagggaccaaaagcacaa

SEQ ID NO: 22208 - DNA, 613 bp, Homo sapiens
tgcatgggtcaattttttttatttcaataattgtttttctttttgtatcatagaaagagtatcatgagtatatcaaacttgtaatttcatggacattgcttaagcccaagctaataaaaatagcaagtcaattttaaaaattgcgtataactagtcaatattaccaggtgatgtgcagaaacaggaagaaaatcgtgaagtctaaaggtaggaaggacaggcatgatgaaagttgagaaacagtgatttccgtctcaggcccatgccctgccctgtctgctggtcctgcagctcatggtggacaccaaagggggagctgaaggaggcagatccttccactgggcttcaggttccaaagcgggtagccgagcagggtcacccctccttcacaaggccccatcgggccgccctgatggcctctccctctccttccctgtgtagaagagatcgtcgcgcatgccagcaacgtgtcctcactggtgctgggcaaagcctccgggcggctgctggctacaggcggggatgactgccgcgtcaacctgtggtccatcaacaagcccaactgcatcatggtgagccccgacagctggcggggggtcaggacaagggcctg

SEQ ID NO: 22209 - DNA, 847 bp, Homo sapiens
actacggctagtgtacgaggcccggtgtctaatcggccgaggccagtctggactgaggaaagcagtgggcaggggcgctcggcagcccacagggcctggcctcagcccccactcctgttccttgtgcacccactggcccatgagcctctgcctggcccctgctgctgtcctgtggccgtcctggaggaggtgatgctggtccctggccacctctacagccctgaactcttgagacaactctctccagcaatagctgcccagctttgcccaactgttgcttcttggggcagcgaactgagccctggggctgctgctgtaatttataaggcaaattttattaaatttgtaactattaccaaaaaaaaaaaaaaaaaacccgcaagtttttttttctttttcttattttctttttttgtttctttttatgtgtgaggggagaggagagaggagtcgtgtgtgttctttacggcagggtgaggtggcggaatatatgagggcggagtgcccccgcgagagaatatatcatttgtatgtagaaacaggaggataccctccccgacgggagaatgagaggtgaactacaacgagcgcacagacagagaggggtgatcccaatggagaagaacccaaccactattatccagtcagagagagaaagacgcgagtcaccacatagaatgcatgcgggtgatgaaacaaaaagacccccgcgaggggaccgcagactaacgatatacacaacacagcggggacataaacaaatagccaagaaaatgaataatatgggaagggccggaaaaaaacgcctctggtagaaagaagggtcaaaacaattaaaaccaacaat

SEQ ID NO: 22210 - DNA, 2693 bp, Homo sapiens
gcagctgattggtgcgggaggcaaggtgggcggggctctgagccggaggtttgttgtgagggtcggttgtcaagcagcggccaatcaaggcaggggatggaggcaagtgggggtcgcgcctggagcggagcctcggcctccggagccgcagctgcagccctgtattgagctgagatggctcgagcctaacattccatgatccaggatcgtgacagatgtgcacaggctgctgctgttgctgctgtgggtaatttggaaccacgaggcaccccagggccagaagacgaggcattctgtctgcctggatgtgtgggaactctctgccaacttgattggtggatctggggggggatccacccccaccccacgaggaaagcacagtttattttgtgggtggggcttcaggtgccagccagctgaaggatggccacccctgtggtcaccaagacagcctggaagttgcaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaattcttcgcacactcatgggacacaaagccaacatctgcagcctggatttccacccgtacggcgagtttgtagcctctggttcccaggacacaaacatcaagctctgggacatcaggaggaaaggctgtgtcttccgatacagggggcacagccaggccgtgcggtgtctccggttcagccccgatgggaagtggttggcgtcggccgcagatgaccacaccgtgaagctctgggatctcactgccggcaagatgatgtctgagttccctggtcacacggggcctgtcaacgtggtcgagtttcaccccaacgagtacctcctggcctccggcagctctgacaggacaatccgcttctgggacctggagaagttccaggtggtgagctgcatcgaaggggagcctgggcccgtcaggagcgtcctcttcaacccagacggctgctgcctgtacagcggctgccaggactcactgcgtgtctacggctgggaacctgagcggtgctttgatgtggtcctcgtcaactggggcaaggtggccgacctggccatctgcaatgaccagttgataggtgtggccttctcccagagcaacgtctcctcctacgtggtggatctgacgcgtgtcaccaggactggcacggtggcccgggaccctgtgcaggaccaccggcccctggcacagccactgcccaaccccagcgcccccctccggcgcatctatgagcggcccagcacaacctgcagcaagcctcagagggtgaagcagaactcagagagcgagcgccgcagccccagcagcgaggatgaccgggacgagcgcgagtcccgcgcggagatccagaacgccgaggactacaacgagatcttccagcccaagaacagcatcagtcggacgccaccccggagaagtgagcccttccctgcacccccagaggacgacgcagccacagcaaaggaggcagcaaagcccagccctgccatggatgtgcagttcccggtgccaaatctggaggtcctgccccggcccccagtggttgcttccacacctgcacccaaggctgagcctgccatcatccctgccacccggaacgagcccatcgggctgaaggcctccgacttcctgcccgccgtgaagatcccccagcaggccgagctggtggacgaggatgccatgtcacagatccgcaaaggccacgacaccatgtgtgtggtgctcaccagccgccacaagaacctggacactgtgcgggctgtgtggaccatgggcgacatcaagacgtcggtggactccgctgtggccatcaacgacctgtcggtggtggtggacctcctgaacatcgtcaaccagaaagcctccctgtggaagctggacctgtgcaccaccgtcctgccacagattgagaagcttctgcagagcaagtatgagagctacgtccagacgggctgcacctccctgaagctgatcctgcagcggtttctgcccctcatcacagacatgctggcggccccaccctctgtgggtgtggatatcagcagggaggagaggctgcataagtgccggctctgctacaagcagcttaagagcatcagcggcctggtcaagagcaagtcaggcctgagcggccgccatggcagtaccttccgcgagctgcacctgctcatggccagtctggactgaggaaagcagtgggcaggggcgctcggcagcccacagggcctggcctcagcccccactcctgttccttgtgcacccactggcccatgagcctctgcctggcccctgctgctgtcctgtggccgtcctggaggaggtgatgctggtccctggccacctctacagccctgaactcttgagacaactctctccagcaatagctgcccagctttgcccaactgttgcttcttggggcagcgaactgagccctggggctgctgctgtaatttataaggcaaattttattaaatttgtaactattacca

SEQ ID NO: 22211 - DNA, 2744 bp, Homo sapiens
gcagctgattggtgcgggaggcaaggtgggcggggctctgagccggaggtttgttgtgagggtcggttgtcaagcagcggccaatcaaggcaggggatggaggcaagtgggggtcgcgcctggagcggagcctcggcctccggagccgcagctgcagccctgtattgagctgagatggctcgagcctaacattccatgatccaggatcgtgacagatgtgcacaggctgctgctgttgctgctgtgggtaatttggaaccacgaggcaccccagggccagaagacgaggcattctgtctgcctggatgtgtgggaactctctgccaacttgattggtggatctggggggggatccacccccaccccacgaggaaagcacagtttattttgtgggtggggcttcaggtgccagccagctgaaggatggccacccctgtggtcaccaagacagcctggaagttgcaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaattcttcgcacactcatgggacacaaagccaacatctgcagcctggatttccacccgtacggcgagtttgtagcctctggttcccaggacacaaacatcaagctctgggacatcaggaggaaaggctgtgtcttccgatacagggggcacagccaggccgtgcggtgtctccggttcagccccgatgggaagtggttggcgtcggccgcagatgaccacaccgtgaagctctgggatctcactgccggcaagatgatgtctgagttccctggtcacacggggcctgtcaacgtggtcgagtttcaccccaacgagtacctcctggcctccggcagctctgacaggacaatccgcttctgggacctggagaagttccaggtggtgagctgcatcgaaggggagcctgggcccgtcaggagcgtcctcttcaacccagacggctgctgcctgtacagcggctgccaggactcactgcgtgtctacggctgggaacctgagcggtgctttgatgtggtcctcgtcaactggggcaaggtggccgacctggccatctgcaatgaccagttgataggtgtggccttctcccagagcaacgtctcctcctacgtggtggatctgacgcgtgtcaccaggactggcacggtggcccgggaccctgtgcaggaccaccggcccctggcacagccactgcccaaccccagcgcccccctccggcgcatctatgagcggcccagcacaacctgcagcaagcctcagagggtgaagcagaactcagagagcgagcgccgcagccccagcagcgaggatgaccgggacgagcgcgagtcccgcgcggagatccagaacgccgaggactacaacgagatcttccagcccaagaacagcatcagtcggacgccaccccggagaagtgagcccttccctgcacccccagaggacgacgcagccacagcaaaggaggcagcaaagcccagccctgccatggatgtgcagttcccggtgccaaatctggaggtcctgccccggcccccagtggttgcttccacacctgcacccaaggctgagcctgccatcatccctgccacccggaacgagcccatcgggctgaaggcctccgacttcctgcccgccgtgaagatcccccagcaggccgagctggtggacgaggatgccatgtcacagatccgcaaaggccacgacaccatgtgtgtggtgctcaccagccgccacaagaacctggacactgtgcgggctgtgtggaccatgggcgacatcaagggccacactgtcccccactgccccacccctgacggtgctctgtttgcacagacgtcggtggactccgctgtggccatcaacgacctgtcggtggtggtggacctcctgaacatcgtcaaccagaaagcctccctgtggaagctggacctgtgcaccaccgtcctgccacagattgagaagcttctgcagagcaagtatgagagctacgtccagacgggctgcacctccctgaagctgatcctgcagcggtttctgcccctcatcacagacatgctggcggccccaccctctgtgggtgtggatatcagcagggaggagaggctgcataagtgccggctctgctacaagcagcttaagagcatcagcggcctggtcaagagcaagtcaggcctgagcggccgccatggcagtaccttccgcgagctgcacctgctcatggccagtctggactgaggaaagcagtgggcaggggcgctcggcagcccacagggcctggcctcagcccccactcctgttccttgtgcacccactggcccatgagcctctgcctggcccctgctgctgtcctgtggccgtcctggaggaggtgatgctggtccctggccacctctacagccctgaactcttgagacaactctctccagcaatagctgcccagctttgcccaactgttgcttcttggggcagcgaactgagccctggggctgctgctgtaatttataaggcaaattttattaaatttgtaactattacca

SEQ ID NO: 22212 - DNA, 2590 bp, Homo sapiens
  misc_feature (14)..(14): n is a, c, g, or t
  misc_feature (26)..(26): n is a, c, g, or t
caggctggtactgncccgggaagtanggcatcggctccggagccgcagctgcagccctgtattgagctgagatggctcgagcctaacattccatgatccaggatcgtgacagatgtgcacaggctgctgctgttgctgctgtgggtaatttggaaccacgaggcaccccagggccagaagacgaggcattctgtctgcctggatgtgtgggaactctctgccaacttgattggtggatctggggggggatccacccccaccccacgaggaaagcacagtttattttgtgggtggggcttcaggtgccagccagctgaaggatggccacccctgtggtcaccaagacagcctggaagttgcaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaattcttcgcacactcatgggacacaaagccaacatctgcagcctggatttccacccgtacggcgagtttgtagcctctggttcccaggacacaaacatcaagctctgggacatcaggaggaaaggctgtgtcttccgatacagggggcacagccaggccgtgcggtgtctccggttcagccccgatgggaagtggttggcgtcggccgcagatgaccacaccgtgaagctctgggatctcactgccggcaagatgatgtctgagttccctggtcacacggggcctgtcaacgtggtcgagtttcaccccaacgagtacctcctggcctccggcagctctgacaggacaatccgcttctgggacctggagaagttccaggtggtgagctgcatcgaaggggagcctgggcccgtcaggagcgtcctcttcaacccagacggctgctgcctgtacagcggctgccaggactcactgcgtgtctacggctgggaacctgagcggtgctttgatgtggtcctcgtcaactggggcaaggtggccgacctggccatctgcaatgaccagttgataggtgtggccttctcccagagcaacgtctcctcctacgtggtggatctgacgcgtgtcaccaggactggcacggtggcccgggaccctgtgcaggaccaccggcccctggcacagccactgcccaaccccagcgcccccctccggcgcatctatgagcggcccagcacaacctgcagcaagcctcagagggtgaagcagaactcagagagcgagcgccgcagccccagcagcgaggatgaccgggacgagcgcgagtcccgcgcggagatccagaacgccgaggactacaacgagatcttccagcccaagaacagcatcagtcggacgccaccccggagaagtgagcccttccctgcacccccagaggacgacgcagccacagcaaaggaggcagcaaagcccagccctgccatggatgtgcagttcccggtgccaaatctggaggtcctgccccggcccccagtggttgcttccacacctgcacccaaggctgagcctgccatcatccctgccacccggaacgagcccatcgggctgaaggcctccgacttcctgcccgccgtgaagatcccccagcaggccgagctggtggacgaggatgccatgtcacagatccgcaaaggccacgacaccatgtgtgtggtgctcaccagccgccacaagaacctggacactgtgcgggctgtgtggaccatgggcgacatcaagacgtcggtggactccgctgtggccatcaacgacctgtcggtggtggtggacctcctgaacatcgtcaaccagaaagcctccctgtggaagctggacctgtgcaccaccgtcctgccacagattgagaagcttctgcagagcaagtatgagagctacgtccagacgggctgcacctccctgaagctgatcctgcagcggtttctgcccctcatcacagacatgctggcggccccaccctctgtgggtgtggatatcagcagggaggagaggctgcataagtgccggctctgctacaagcagcttaagagcatcagcggcctggtcaagagcaagtcaggcctgagcggccgccatggcagtaccttccgcgagctgcacctgctcatggccagtctggactgaggaaagcagtgggcaggggcgctcggcagcccacagggcctggcctcagcccccactcctgttccttgtgcacccactggcccatgagcctctgcctggcccctgctgctgtcctgtggccgtcctggaggaggtgatgctggtccctggccacctctacagccctgaactcttgagacaactctctccagcaatagctgcccagctttgcccaactgttgcttcttggggcagcgaactgagccctggggctgctgctgtaatttataaggcaaattttattaaatttgtaactattacca

SEQ ID NO: 22213 - DNA, 2782 bp, Homo sapiens
gggacgaggtggcgaggggacggtgggccctgggctgggccgagccaggcggggctggctgggcttgcgggcagagagctctgagcgtggggaggctagagcccgtactccgcaagcagagggttgggaggatcagccgtggccgagggacctgcccccgcccccggacgagaggggtcggggtggaggccggagggggcaaaaccaggaggccggaagcagagctgggggtctgcagaaggacagccctgtattgagctgagatggctcgagcctaacattccatgatccaggatcgtgacagatgtgcacaggctgctgctgttgctgctgtgggtaatttggaaccacgaggcaccccagggccagaagacgaggcattctgtctgcctggatgtgtgggaactctctgccaacttgattggtggatctggggggggatccacccccaccccacgaggaaagcacagtttattttgtgggtggggcttcaggtgccagccagctgaaggatggccacccctgtggtcaccaagacagcctggaagttgcaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaattcttcgcacactcatgggacacaaagccaacatctgcagcctggatttccacccgtacggcgagtttgtagcctctggttcccaggacacaaacatcaagctctgggacatcaggaggaaaggctgtgtcttccgatacagggggcacagccaggccgtgcggtgtctccggttcagccccgatgggaagtggttggcgtcggccgcagatgaccacaccgtgaagctctgggatctcactgccggcaagatgatgtctgagttccctggtcacacggggcctgtcaacgtggtcgagtttcaccccaacgagtacctcctggcctccggcagctctgacaggacaatccgcttctgggacctggagaagttccaggtggtgagctgcatcgaaggggagcctgggcccgtcaggagcgtcctcttcaacccagacggctgctgcctgtacagcggctgccaggactcactgcgtgtctacggctgggaacctgagcggtgctttgatgtggtcctcgtcaactggggcaaggtggccgacctggccatctgcaatgaccagttgataggtgtggccttctcccagagcaacgtctcctcctacgtggtggatctgacgcgtgtcaccaggactggcacggtggcccgggaccctgtgcaggaccaccggcccctggcacagccactgcccaaccccagcgcccccctccggcgcatctatgagcggcccagcacaacctgcagcaagcctcagagggtgaagcagaactcagagagcgagcgccgcagccccagcagcgaggatgaccgggacgagcgcgagtcccgcgcggagatccagaacgccgaggactacaacgagatcttccagcccaagaacagcatcagtcggacgccaccccggagaagtgagcccttccctgcacccccagaggacgacgcagccacagcaaaggaggcagcaaagcccagccctgccatggatgtgcagttcccggtgccaaatctggaggtcctgccccggcccccagtggttgcttccacacctgcacccaaggctgagcctgccatcatccctgccacccggaacgagcccatcgggctgaaggcctccgacttcctgcccgccgtgaagatcccccagcaggccgagctggtggacgaggatgccatgtcacagatccgcaaaggccacgacaccatgtgtgtggtgctcaccagccgccacaagaacctggacactgtgcgggctgtgtggaccatgggcgacatcaagacgtcggtggactccgctgtggccatcaacgacctgtcggtggtggtggacctcctgaacatcgtcaaccagaaagcctccctgtggaagctggacctgtgcaccaccgtcctgccacagattgagaagcttctgcagagcaagtatgagagctacgtccagacgggctgcacctccctgaagctgatcctgcagcggtttctgcccctcatcacagacatgctggcggccccaccctctgtgggtgtggatatcagcagggaggagaggctgcataagtgccggctctgctacaagcagcttaagagcatcagcggcctggtcaagagcaagtcaggcctgagcggccgccatggcagtaccttccgcgagctgcacctgctcatggccagtctggactgaggaaagcagtgggcaggggcgctcggcagcccacagggcctggcctcagcccccactcctgttccttgtgcacccactggcccatgagcctctgcctggcccctgctgctgtcctgtggccgtcctggaggaggtgatgctggtccctggccacctctacagccctgaactcttgagacaactctctccagcaatagctgcccagctttgcccaactgttgcttcttggggcagcgaactgagccctggggctgctgctgtaatttataaggcaaattttattaaatttgtaactattacca

SEQ ID NO: 22214 - DNA, 2767 bp, Homo sapiens
gcagctgattggtgcgggaggcaaggtgggcggggctctgagccggaggtttgttgtgagggtcggttgtcaagcagcggccaatcaaggcaggggatggaggcaagtgggggtcgcgcctggagcggagcctcggcctccggagccgcagctgcagccctgtattgagctgagatggctcgagcctaacattccatgatccaggatcgtgacagatgtgcacaggctgctgctgttgctgctgtgggtaatttggaaccacgaggcaccccagggccagaagacgaggcattctgtctgcctggatgtgtgggaactctctgccaacttgattggtggatctggggggggatccacccccaccccacgaggaaagcacagtttattttgtgggtggggcttcaggtgccagccagctgaaggatggccacccctgtggtcaccaagacagcctggaagttgcaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaattcttcgcacactcatgggacacaaagccaacatctgcagcctggatttccacccgtacggcgagtttgtagcctctggttcccaggacacaaacatcaagctctgggacatcaggaggaaaggctgtgtcttccgatacagggggcacagccaggccgtgcggtgtctccggttcagccccgatgggaagtggttggcgtcggccgcagatgaccacaccgtgaagctctgggatctcactgccggcaagatgatgtctgagttccctggtcacacggggcctgtcaacgtggtcgagtttcaccccaacgagtacctcctggcctccggcagctctgacaggacaatccgcttctgggacctggagaagttccaggtggtgagctgcatcgaaggggagcctgggcccgtcaggagcgtcctcttcaacccagacggctgctgcctgtacagcggctgccaggactcactgcgtgtctacggctgggaacctgagcggtgctttgatgtggtcctcgtcaactggggcaaggtggccgacctggccatctgcaatgaccagttgataggtgtggccttctcccagagcaacgtctcctcctacgtggtggatctgacgcgtgtcaccaggactggcacggtggcccgggaccctgtgcaggaccaccggcccctggcacagccactgcccaaccccagcgcccccctccggcgcatctatgagcggcccagcacaacctgcagcaagcctcagagggtgaagcagaactcagagagcgagcgccgcagccccagcagcgaggatgaccgggacgagcgcgagtcccgcgcggagatccagaacgccgaggactacaacgagatcttccagcccaagaacagcatcagtcggacgccaccccggagaagtgagcccttccctgcacccccagaggacgacgcagccacagcaaaggaggcagcaaagcccagccctgccatggatgtgcagttcccggtgccaaatctggaggtcctgccccggcccccagtggttgcttccacacctgcacccaaggctgagcctgccatcatccctgccacccggaacgagcccatcgggctgaaggcctccgacttcctgcccgccgtgaagatcccccagcaggccgagctggtggacgaggatgccatgtcacagatccgcaaaggccacgacaccatgtgtgtggtgctcaccagccgccacaagaacctggacactgtgcgggctgtgtggaccatgggcgacatcaagacgtcggtggactccgctgtggccatcaacgacctgtcggtggtggtggacctcctgaacatcgtcaaccagaaagcgtaagtggctgcagagggggagtgggcggaggggcagggctgggctgatggcagcatgtcctggcctctcctagctccctgtggaagctggacctgtgcaccaccgtcctgccacagattgagaagcttctgcagagcaagtatgagagctacgtccagacgggctgcacctccctgaagctgatcctgcagcggtttctgcccctcatcacagacatgctggcggccccaccctctgtgggtgtggatatcagcagggaggagaggctgcataagtgccggctctgctacaagcagcttaagagcatcagcggcctggtcaagagcaagtcaggcctgagcggccgccatggcagtaccttccgcgagctgcacctgctcatggccagtctggactgaggaaagcagtgggcaggggcgctcggcagcccacagggcctggcctcagcccccactcctgttccttgtgcacccactggcccatgagcctctgcctggcccctgctgctgtcctgtggccgtcctggaggaggtgatgctggtccctggccacctctacagccctgaactcttgagacaactctctccagcaatagctgcccagctttgcccaactgttgcttcttggggcagcgaactgagccctggggctgctgctgtaatttataaggcaaattttattaaatttgtaactattacca

SEQ ID NO: 22215 - DNA, 2818 bp, Homo sapiens
gcagctgattggtgcgggaggcaaggtgggcggggctctgagccggaggtttgttgtgagggtcggttgtcaagcagcggccaatcaaggcaggggatggaggcaagtgggggtcgcgcctggagcggagcctcggcctccggagccgcagctgcagccctgtattgagctgagatggctcgagcctaacattccatgatccaggatcgtgacagatgtgcacaggctgctgctgttgctgctgtgggtaatttggaaccacgaggcaccccagggccagaagacgaggcattctgtctgcctggatgtgtgggaactctctgccaacttgattggtggatctggggggggatccacccccaccccacgaggaaagcacagtttattttgtgggtggggcttcaggtgccagccagctgaaggatggccacccctgtggtcaccaagacagcctggaagttgcaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaattcttcgcacactcatgggacacaaagccaacatctgcagcctggatttccacccgtacggcgagtttgtagcctctggttcccaggacacaaacatcaagctctgggacatcaggaggaaaggctgtgtcttccgatacagggggcacagccaggccgtgcggtgtctccggttcagccccgatgggaagtggttggcgtcggccgcagatgaccacaccgtgaagctctgggatctcactgccggcaagatgatgtctgagttccctggtcacacggggcctgtcaacgtggtcgagtttcaccccaacgagtacctcctggcctccggcagctctgacaggacaatccgcttctgggacctggagaagttccaggtggtgagctgcatcgaaggggagcctgggcccgtcaggagcgtcctcttcaacccagacggctgctgcctgtacagcggctgccaggactcactgcgtgtctacggctgggaacctgagcggtgctttgatgtggtcctcgtcaactggggcaaggtggccgacctggccatctgcaatgaccagttgataggtgtggccttctcccagagcaacgtctcctcctacgtggtggatctgacgcgtgtcaccaggactggcacggtggcccgggaccctgtgcaggaccaccggcccctggcacagccactgcccaaccccagcgcccccctccggcgcatctatgagcggcccagcacaacctgcagcaagcctcagagggtgaagcagaactcagagagcgagcgccgcagccccagcagcgaggatgaccgggacgagcgcgagtcccgcgcggagatccagaacgccgaggactacaacgagatcttccagcccaagaacagcatcagtcggacgccaccccggagaagtgagcccttccctgcacccccagaggacgacgcagccacagcaaaggaggcagcaaagcccagccctgccatggatgtgcagttcccggtgccaaatctggaggtcctgccccggcccccagtggttgcttccacacctgcacccaaggctgagcctgccatcatccctgccacccggaacgagcccatcgggctgaaggcctccgacttcctgcccgccgtgaagatcccccagcaggccgagctggtggacgaggatgccatgtcacagatccgcaaaggccacgacaccatgtgtgtggtgctcaccagccgccacaagaacctggacactgtgcgggctgtgtggaccatgggcgacatcaagggccacactgtcccccactgccccacccctgacggtgctctgtttgcacagacgtcggtggactccgctgtggccatcaacgacctgtcggtggtggtggacctcctgaacatcgtcaaccagaaagcgtaagtggctgcagagggggagtgggcggaggggcagggctgggctgatggcagcatgtcctggcctctcctagctccctgtggaagctggacctgtgcaccaccgtcctgccacagattgagaagcttctgcagagcaagtatgagagctacgtccagacgggctgcacctccctgaagctgatcctgcagcggtttctgcccctcatcacagacatgctggcggccccaccctctgtgggtgtggatatcagcagggaggagaggctgcataagtgccggctctgctacaagcagcttaagagcatcagcggcctggtcaagagcaagtcaggcctgagcggccgccatggcagtaccttccgcgagctgcacctgctcatggccagtctggactgaggaaagcagtgggcaggggcgctcggcagcccacagggcctggcctcagcccccactcctgttccttgtgcacccactggcccatgagcctctgcctggcccctgctgctgtcctgtggccgtcctggaggaggtgatgctggtccctggccacctctacagccctgaactcttgagacaactctctccagcaatagctgcccagctttgcccaactgttgcttcttggggcagcgaactgagccctggggctgctgctgtaatttataaggcaaattttattaaatttgtaactattacca

SEQ ID NO: 22216 - DNA, 1654 bp, Homo sapiens
gcagctgattggtgcgggaggcaaggtgggcggggctctgagccggaggtttgttgtgagggtcggttgtcaagcagcggccaatcaaggcaggggatggaggcaagtgggggtcgcgcctggagcggagcctcggcctccggagccgcagctgcagccctgtattgagctgagatggctcgagcctaacattccatgatccaggatcgtgacagatgtgcacaggctgctgctgttgctgctgtgggtaatttggaaccacgaggcaccccagggccagaagacgaggcattctgtctgcctggatgtgtgggaactctctgccaacttgattggtggatctggggggggatccacccccaccccacgaggaaagcacagtttattttgtgggtggggcttcaggtgccagccagctgaaggatggccacccctgtggtcaccaagacagcctggaagttgcaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaattcttcgcacactcatgggacacaaagccaacatctgcagcctggatttccacccgtacggcgagtttgtagcctctggttcccaggacacaaacatcaagctctgggacatcaggaggaaaggctgtgtcttccgatacagggggcacagccaggccgtgcggtgtctccggttcagccccgatgggaagtggttggcgtcggccgcagatgaccacaccgtgaagctctgggatctcactgccggcaagatgatgtctgagttccctggtcacacggggcctgtcaacgtggtcgagtttcaccccaacgagtacctcctggcctccggcagctctgacaggacaatccgcttctgggacctggagaagttccaggtggtgagctgcatcgaaggggagcctgggcccgtcaggagcgtcctcttcaacccagacggctgctgcctgtacagcggctgccaggactcactgcgtgtctacggctgggaacctgagcggtgctttgatgtggtcctcgtcaactggggcaaggtggccgacctggccatctgcaatgaccagttgataggtgtggccttctcccagagcaacgtctcctcctacgtggtggatctgacgcgtgtcaccaggactggcacggtggcccgggaccctgtgcaggaccaccggcccctggcacagccactgcccaaccccagcgcccccctccggcgcatctatgagcggcccagcacaacctgcagcaagcctcagagggtgaagcagaactcagagagcgagcgccgcagccccagcagcgaggatgaccgggacgagcgcgagtcccgcgcggagatccagaacgccgaggactacaacgagatcttccagcccaagaacagcatcagtccggaacggccaaccccgggaagaagtgaaggccctttcccctgaaaccccc

SEQ ID NO: 22217 - DNA, 1300 bp, Homo sapiens
gcagctgattggtgcgggaggcaaggtgggcggggctctgagccggaggtttgttgtgagggtcggttgtcaagcagcggccaatcaaggcaggggatggaggcaagtgggggtcgcgcctggagcggagcctcggcctccggagccgcagctgcagccctgtattgagctgagatggctcgagcctaacattccatgatccaggatcgtgacagatgtgcacaggctgctgctgttgctgctgtgggtaatttggaaccacgaggcaccccagggccagaagacgaggcattctgtctgcctggatgtgtgggaactctctgccaacttgattggtggatctggggggggatccacccccaccccacgaggaaagcacagtttattttgtgggtggggcttcaggtgccagccagctgaaggatggccacccctgtggtcaccaagacagcctggaagttgcaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaattcttcgcacactcatgggacacaaagccaacatctgcagcctggatttccacccgtacggcgagtttgtagcctctggttcccaggacacaaacatcaagctctgggacatcaggaggaaaggctgtgtcttccgatacagggggcacagccaggccgtgcggtgtctccggttcagccccgatgggaagtggttggcgtcggccgcagatgaccacaccgtgaagctctgggatctcactgccggcaagatgatgtctgagttccctggtcacacggggcctgtcaacgtggtcgagtttcaccccaacgagtacctcctggcctccggcagctctgacaggacaatccgcttctgggacctggagaagttccaggtggtgagctgcatcgaaggggagcctgggcccgtcaggagcgtcctcttcaacccagacggctgctgcctgtacagcggctgccaggactcactgcgtgtctacggctgggaacctgagcggtgctttgatgtggtcctcgtcaactggggcaaggtggccgacctggccatctgcaatgaccagttggtgagagagccatggcacccac

SEQ ID NO: 22218 - DNA, 1282 bp, Homo sapiens
gcagctgattggtgcgggaggcaaggtgggcggggctctgagccggaggtttgttgtgagggtcggttgtcaagcagcggccaatcaaggcaggggatggaggcaagtgggggtcgcgcctggagcggagcctcggcctccggagccgcagctgcagccctgtattgagctgagatggctcgagcctaacattccatgatccaggatcgtgacagatgtgcacaggctgctgctgttgctgctgtgggtaatttggaaccacgaggcaccccagggccagaagacgaggcattctgtctgcctggatgtgtgggaactctctgccaacttgattggtggatctggggggggatccacccccaccccacgaggaaagcacagtttattttgtgggtggggcttcaggtgccagccagctgaaggatggccacccctgtggtcaccaagacagcctggaagttgcaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaattcttcgcacactcatgggacacaaagccaacatctgcagcctggatttccacccgtacggcgagtttgtagcctctggttcccaggacacaaacatcaagctctgggacatcaggaggaaaggctgtgtcttccgatacagggggcacagccaggccgtgcggtgtctccggttcagccccgatgggaagtggttggcgtcggccgcagatgaccacaccgtgaagctctgggatctcactgccggcaagatgatgtctgagttccctggtcacacggggcctgtcaacgtggtcgagtttcaccccaacgagtacctcctggcctccggcagctctgacaggacatcagttagtggaccgtggggcaagtcccagatgagtggctgggcttcacaggtaaaccctagccggacagacaacgccactttcacccagaggatatgcactttacagcaggtggccggcacccaggtgtcttaaggttggcagctagtagagcttcaagttacccacacatgtgaaccgtcccagtcgcacctttgcacgacgagagggaccaaaagcacaa

SEQ ID NO: 22219 - DNA, 980 bp, Homo sapiens
gcagctgattggtgcgggaggcaaggtgggcggggctctgagccggaggtttgttgtgagggtcggttgtcaagcagcggccaatcaaggcaggggatggaggcaagtgggggtcgcgcctggagcggagcctcggcctccggagccgcagctgcagccctgtattgagctgagatggctcgagcctaacattccatgatccaggatcgtgacagatgtgcacaggctgctgctgttgctgctgtgggtaatttggaaccacgaggcaccccagggccagaagacgaggcattctgtctgcctggatgtgtgggaactctctgccaacttgattggtggatctggggggggatccacccccaccccacgaggaaagcacagtttattttgtgggtggggcttcaggtgccagccagctgaaggatggccacccctgtggtcaccaagacagcctggaagttgcaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaattcttcgcacactcatgggacacaaagccaacatctgcagcctggatttccacccgtacggcgagtttgtagcctctggttcccaggacacaaacatcaagctctgggacatcaggaggaaaggctgtgtcttccgatacagggggcacagccaggccgtgcggtgtctccggttcagccccgatgggaagtggttggcgtcggccgcagatgaccacaccgtgaagctctggatctcacgtctagctattcgggggggatccttaag

SEQ ID NO: 22220 - DNA, 2592 bp, Homo sapiens
gcagctgattggtgcgggaggcaaggtgggcggggctctgagccggaggtttgttgtgagggtcggttgtcaagcagcggccaatcaaggcaggggatggaggcaagtgggggtcgcgcctggagcggagcctcggcctccggagccgcagctgcagccctgtattgagctgagatggctcgagcctaacattccatgatccaggatcgtgacagatgtgcacaggctgctgctgttgctgctgtgggtaatttggaaccacgaggcaccccagggccagaagacgaggcattctgtctgcctggatgtgtgggaactctctgccaacttgattggtggatctggggggggatccacccccaccccacgaggaaagcacagtttattttgtgggtggggcttcaggtgccagccagctgaaggatggccacccctgtggtcaccaagacagcctggaagttgcaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaactctgggacatcaggaggaaaggctgtgtcttccgatacagggggcacagccaggccgtgcggtgtctccggttcagccccgatgggaagtggttggcgtcggccgcagatgaccacaccgtgaagctctgggatctcactgccggcaagatgatgtctgagttccctggtcacacggggcctgtcaacgtggtcgagtttcaccccaacgagtacctcctggcctccggcagctctgacaggacaatccgcttctgggacctggagaagttccaggtggtgagctgcatcgaaggggagcctgggcccgtcaggagcgtcctcttcaacccagacggctgctgcctgtacagcggctgccaggactcactgcgtgtctacggctgggaacctgagcggtgctttgatgtggtcctcgtcaactggggcaaggtggccgacctggccatctgcaatgaccagttgataggtgtggccttctcccagagcaacgtctcctcctacgtggtggatctgacgcgtgtcaccaggactggcacggtggcccgggaccctgtgcaggaccaccggcccctggcacagccactgcccaaccccagcgcccccctccggcgcatctatgagcggcccagcacaacctgcagcaagcctcagagggtgaagcagaactcagagagcgagcgccgcagccccagcagcgaggatgaccgggacgagcgcgagtcccgcgcggagatccagaacgccgaggactacaacgagatcttccagcccaagaacagcatcagtcggacgccaccccggagaagtgagcccttccctgcacccccagaggacgacgcagccacagcaaaggaggcagcaaagcccagccctgccatggatgtgcagttcccggtgccaaatctggaggtcctgccccggcccccagtggttgcttccacacctgcacccaaggctgagcctgccatcatccctgccacccggaacgagcccatcgggctgaaggcctccgacttcctgcccgccgtgaagatcccccagcaggccgagctggtggacgaggatgccatgtcacagatccgcaaaggccacgacaccatgtgtgtggtgctcaccagccgccacaagaacctggacactgtgcgggctgtgtggaccatgggcgacatcaagacgtcggtggactccgctgtggccatcaacgacctgtcggtggtggtggacctcctgaacatcgtcaaccagaaagcctccctgtggaagctggacctgtgcaccaccgtcctgccacagattgagaagcttctgcagagcaagtatgagagctacgtccagacgggctgcacctccctgaagctgatcctgcagcggtttctgcccctcatcacagacatgctggcggccccaccctctgtgggtgtggatatcagcagggaggagaggctgcataagtgccggctctgctacaagcagcttaagagcatcagcggcctggtcaagagcaagtcaggcctgagcggccgccatggcagtaccttccgcgagctgcacctgctcatggccagtctggactgaggaaagcagtgggcaggggcgctcggcagcccacagggcctggcctcagcccccactcctgttccttgtgcacccactggcccatgagcctctgcctggcccctgctgctgtcctgtggccgtcctggaggaggtgatgctggtccctggccacctctacagccctgaactcttgagacaactctctccagcaatagctgcccagctttgcccaactgttgcttcttggggcagcgaactgagccctggggctgctgctgtaatttataaggcaaattttattaaatttgtaactattacca

SEQ ID NO: 22221 - DNA, 2671 bp, Homo sapiens
tgcatgggtcaattttttttatttcaataattgtttttctttttgtatcatagaaagagtatcatgagtatatcaaacttgtaatttcatggacattgcttaagcccaagctaataaaaatagcaagtcaattttaaaaattgcgtataactagtcaatattaccaggtgatgtgcagaaacaggaagaaaatcgtgaagtctaaaggtaggaaggacaggcatgatgaaagttgagaaacagtgatttccgtctcaggcccatgccctgccctgtctgctggtcctgcagctcatggtggacaccaaagggggagctgaaggaggcagatccttccactgggcttcaggttccaaagcgggtagccgagcagggtcacccctccttcacaaggccccatcgggccgccctgatggcctctccctctccttccctgtgtagaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaattcttcgcacactcatgggacacaaagccaacatctgcagcctggatttccacccgtacggcgagtttgtagcctctggttcccaggacacaaacatcaagctctgggacatcaggaggaaaggctgtgtcttccgatacagggggcacagccaggccgtgcggtgtctccggttcagccccgatgggaagtggttggcgtcggccgcagatgaccacaccgtgaagctctgggatctcactgccggcaagatgatgtctgagttccctggtcacacggggcctgtcaacgtggtcgagtttcaccccaacgagtacctcctggcctccggcagctctgacaggacaatccgcttctgggacctggagaagttccaggtggtgagctgcatcgaaggggagcctgggcccgtcaggagcgtcctcttcaacccagacggctgctgcctgtacagcggctgccaggactcactgcgtgtctacggctgggaacctgagcggtgctttgatgtggtcctcgtcaactggggcaaggtggccgacctggccatctgcaatgaccagttgataggtgtggccttctcccagagcaacgtctcctcctacgtggtggatctgacgcgtgtcaccaggactggcacggtggcccgggaccctgtgcaggaccaccggcccctggcacagccactgcccaaccccagcgcccccctccggcgcatctatgagcggcccagcacaacctgcagcaagcctcagagggtgaagcagaactcagagagcgagcgccgcagccccagcagcgaggatgaccgggacgagcgcgagtcccgcgcggagatccagaacgccgaggactacaacgagatcttccagcccaagaacagcatcagtcggacgccaccccggagaagtgagcccttccctgcacccccagaggacgacgcagccacagcaaaggaggcagcaaagcccagccctgccatggatgtgcagttcccggtgccaaatctggaggtcctgccccggcccccagtggttgcttccacacctgcacccaaggctgagcctgccatcatccctgccacccggaacgagcccatcgggctgaaggcctccgacttcctgcccgccgtgaagatcccccagcaggccgagctggtggacgaggatgccatgtcacagatccgcaaaggccacgacaccatgtgtgtggtgctcaccagccgccacaagaacctggacactgtgcgggctgtgtggaccatgggcgacatcaagacgtcggtggactccgctgtggccatcaacgacctgtcggtggtggtggacctcctgaacatcgtcaaccagaaagcctccctgtggaagctggacctgtgcaccaccgtcctgccacagattgagaagcttctgcagagcaagtatgagagctacgtccagacgggctgcacctccctgaagctgatcctgcagcggtttctgcccctcatcacagacatgctggcggccccaccctctgtgggtgtggatatcagcagggaggagaggctgcataagtgccggctctgctacaagcagcttaagagcatcagcggcctggtcaagagcaagtcaggcctgagcggccgccatggcagtaccttccgcgagctgcacctgctcatggccagtctggactgaggaaagcagtgggcaggggcgctcggcagcccacagggcctggcctcagcccccactcctgttccttgtgcacccactggcccatgagcctctgcctggcccctgctgctgtcctgtggccgtcctggaggaggtgatgctggtccctggccacctctacagccctgaactcttgagacaactctctccagcaatagctgcccagctttgcccaactgttgcttcttggggcagcgaactgagccctggggctgctgctgtaatttataaggcaaattttattaaatttgtaactattacca

SEQ ID NO: 22222 - DNA, 2475 bp, Homo sapiens
gcagctgattggtgcgggaggcaaggtgggcggggctctgagccggaggtttgttgtgagggtcggttgtcaagcagcggccaatcaaggcaggggatggaggcaagtgggggtcgcgcctggagcggagcctcggcctccggagccgcagctgcagccctgtattgagctgagatggctcgagcctaacattccatgatccaggatcgtgacagatgtgcacaggctgctgctgttgctgctgtaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaattcttcgcacactcatgggacacaaagccaacatctgcagcctggatttccacccgtacggcgagtttgtagcctctggttcccaggacacaaacatcaagctctgggacatcaggaggaaaggctgtgtcttccgatacagggggcacagccaggccgtgcggtgtctccggttcagccccgatgggaagtggttggcgtcggccgcagatgaccacaccgtgaagctctgggatctcactgccggcaagatgatgtctgagttccctggtcacacggggcctgtcaacgtggtcgagtttcaccccaacgagtacctcctggcctccggcagctctgacaggacaatccgcttctgggacctggagaagttccaggtggtgagctgcatcgaaggggagcctgggcccgtcaggagcgtcctcttcaacccagacggctgctgcctgtacagcggctgccaggactcactgcgtgtctacggctgggaacctgagcggtgctttgatgtggtcctcgtcaactggggcaaggtggccgacctggccatctgcaatgaccagttgataggtgtggccttctcccagagcaacgtctcctcctacgtggtggatctgacgcgtgtcaccaggactggcacggtggcccgggaccctgtgcaggaccaccggcccctggcacagccactgcccaaccccagcgcccccctccggcgcatctatgagcggcccagcacaacctgcagcaagcctcagagggtgaagcagaactcagagagcgagcgccgcagccccagcagcgaggatgaccgggacgagcgcgagtcccgcgcggagatccagaacgccgaggactacaacgagatcttccagcccaagaacagcatcagtcggacgccaccccggagaagtgagcccttccctgcacccccagaggacgacgcagccacagcaaaggaggcagcaaagcccagccctgccatggatgtgcagttcccggtgccaaatctggaggtcctgccccggcccccagtggttgcttccacacctgcacccaaggctgagcctgccatcatccctgccacccggaacgagcccatcgggctgaaggcctccgacttcctgcccgccgtgaagatcccccagcaggccgagctggtggacgaggatgccatgtcacagatccgcaaaggccacgacaccatgtgtgtggtgctcaccagccgccacaagaacctggacactgtgcgggctgtgtggaccatgggcgacatcaagacgtcggtggactccgctgtggccatcaacgacctgtcggtggtggtggacctcctgaacatcgtcaaccagaaagcctccctgtggaagctggacctgtgcaccaccgtcctgccacagattgagaagcttctgcagagcaagtatgagagctacgtccagacgggctgcacctccctgaagctgatcctgcagcggtttctgcccctcatcacagacatgctggcggccccaccctctgtgggtgtggatatcagcagggaggagaggctgcataagtgccggctctgctacaagcagcttaagagcatcagcggcctggtcaagagcaagtcaggcctgagcggccgccatggcagtaccttccgcgagctgcacctgctcatggccagtctggactgaggaaagcagtgggcaggggcgctcggcagcccacagggcctggcctcagcccccactcctgttccttgtgcacccactggcccatgagcctctgcctggcccctgctgctgtcctgtggccgtcctggaggaggtgatgctggtccctggccacctctacagccctgaactcttgagacaactctctccagcaatagctgcccagctttgcccaactgttgcttcttggggcagcgaactgagccctggggctgctgctgtaatttataaggcaaattttattaaatttgtaactattacca

SEQ ID NO: 22223 - DNA, 2262 bp, Homo sapiens
gcagctgattggtgcgggaggcaaggtgggcggggctctgagccggaggtttgttgtgagggtcggttgtcaagcagcggccaatcaaggcaggggatggaggcaagtgggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaattcttcgcacactcatgggacacaaagccaacatctgcagcctggatttccacccgtacggcgagtttgtagcctctggttcccaggacacaaacatcaagctctgggacatcaggaggaaaggctgtgtcttccgatacagggggcacagccaggccgtgcggtgtctccggttcagccccgatgggaagtggttggcgtcggccgcagatgaccacaccgtgaagctctgggatctcactgccggcaagatgatgtctgagttccctggtcacacggggcctgtcaacgtggtcgagtttcaccccaacgagtacctcctggcctccggcagctctgacaggacaatccgcttctgggacctggagaagttccaggtggtgagctgcatcgaaggggagcctgggcccgtcaggagcgtcctcttcaacccagacggctgctgcctgtacagcggctgccaggactcactgcgtgtctacggctgggaacctgagcggtgctttgatgtggtcctcgtcaactggggcaaggtggccgacctggccatctgcaatgaccagttgataggtgtggccttctcccagagcaacgtctcctcctacgtggtggatctgacgcgtgtcaccaggactggcacggtggcccgggaccctgtgcaggaccaccggcccctggcacagccactgcccaaccccagcgcccccctccggcgcatctatgagcggcccagcacaacctgcagcaagcctcagagggtgaagcagaactcagagagcgagcgccgcagccccagcagcgaggatgaccgggacgagcgcgagtcccgcgcggagatccagaacgccgaggactacaacgagatcttccagcccaagaacagcatcagtcggacgccaccccggagaagtgagcccttccctgcacccccagaggacgacgcagccacagcaaaggaggcagcaaagcccagccctgccatggatgtgcagttcccggtgccaaatctggaggtcctgccccggcccccagtggttgcttccacacctgcacccaaggctgagcctgccatcatccctgccacccggaacgagcccatcgggctgaaggcctccgacttcctgcccgccgtgaagatcccccagcaggccgagctggtggacgaggatgccatgtcacagatccgcaaaggccacgacaccatgtgtgtggtgctcaccagccgccacaagaacctggacactgtgcgggctgtgtggaccatgggcgacatcaagacgtcggtggactccgctgtggccatcaacgacctgtcggtggtggtggacctcctgaacatcgtcaaccagaaagcctccctgtggaagctggacctgtgcaccaccgtcctgccacagattgagaagcttctgcagagcaagtatgagagctacgtccagacgggctgcacctccctgaagctgatcctgcagcggtttctgcccctcatcacagacatgctggcggccccaccctctgtgggtgtggatatcagcagggaggagaggctgcataagtgccggctctgctacaagcagcttaagagcatcagcggcctggtcaagagcaagtcaggcctgagcggccgccatggcagtaccttccgcgagctgcacctgctcatggccagtctggactgaggaaagcagtgggcaggggcgctcggcagcccacagggcctggcctcagcccccactcctgttccttgtgcacccactggcccatgagcctctgcctggcccctgctgctgtcctgtggccgtcctggaggaggtgatgctggtccctggccacctctacagccctgaactcttgagacaactctctccagcaatagctgcccagctttgcccaactgttgcttcttggggcagcgaactgagccctggggctgctgctgtaatttataaggcaaattttattaaatttgtaactattacca

SEQ ID NO: 22224 - DNA, 648 bp, Homo sapiens
agatgtgatctgctccattattttccataaacgttttgattataaagatcagcaatttcttaacttaatggaaaagttgaatggcaagtatgagagctacgtccagacgggctgcacctccctgaagctgatcctgcagcggtttctgcccctcatcacagacatgctggcggccccaccctctgtgggtgtggatatcagcagggaggagaggctgcataagtgccggctctgctacaagcagcttaagagcatcagcggcctggtcaagagcaagtcaggcctgagcggccgccatggcagtaccttccgcgagctgcacctgctcatggccagtctggactgaggaaagcagtgggcaggggcgctcggcagcccacagggcctggcctcagcccccactcctgttccttgtgcacccactggcccatgagcctctgcctggcccctgctgctgtcctgtggccgtcctggaggaggtgatgctggtccctggccacctctacagccctgaactcttgagacaactctctccagcaatagctgcccagctttgcccaactgttgcttcttggggcagcgaactgagccctggggctgctgctgtaatttataaggcaaattttattaaatttgtaactattacca

SEQ ID NO: 22225 - DNA, 450 bp, Homo sapiens
gcggccgccatggcagtaccttccgcgagctgcacctgctcatggccagtctggactgaggaaagcagtgggcaggggcgctcggcagcccacagggcctggcctcagcccccactcctgttccttgtgcacccactggcccatgagcctctgcctggcccctgctgctgtcctgtggccgtcctggaggaggtgatgctggtccctggccacctctacagccctgaactcttgagacaactctctccagcaatagctgcccagctttgcccaactgttgcttcttggggcagcgaactgagccctggggctgctgctgtaatttataaggcaaattttattaaatttgtaactattaccaggtttccttgtggggaatgttttctgctggccacagggctccccgggcccaggagtgcctgccccatggtttgagatgaggccacaccc

SEQ ID NO: 22226 - DNA, 1194 bp, Homo sapiens
cctagaggatcccatctcaggccgggacgagcgcgagtcccgcgcggagatccagaacgccgaggactacaacgagatcttccagcccaagaacagcatcagtcggacgccaccccggagaagtgagcccttccctgcacccccagaggacgacgcagccacagcaaaggaggcagcaaagcccagccctgccatggatgtgcagttcccggtgccaaatctggaggtcctgccccggcccccagtggttgcttccacacctgcacccaaggctgagcctgccatcatccctgccacccggaacgagcccatcgggctgaaggcctccgacttcctgcccgccgtgaagatcccccagcaggccgagctggtggacgaggatgccatgtcacagatccgcaaaggccacgacaccatgtgtgtggtgctcaccagccgccacaagaacctggacactgtgcgggctgtgtggaccatgggcgacatcaagacgtcggtggactccgctgtggccatcaacgacctgtcggtggtggtggacctcctgaacatcgtcaaccagaaagcctccctgtggaagctggacctgtgcaccaccgtcctgccacagattgagaagcttctgcagagcaagtatgagagctacgtccagacgggctgcacctccctgaagctgatcctgcagcggtttctgcccctcatcacagacatgctggcggccccaccctctgtgggtgtggatatcagcagggaggagaggctgcataagtgccggctctgctacaagcagcttaagagcatcagcggcctggtcaagagcaagtcaggcctgagcggccgccatggcagtaccttccgcgagctgcacctgctcatggccagtctggactgaggaaagcagtgggcaggggcgctcggcagcccacagggcctggcctcagcccccactcctgttccttgtgcacccactggcccatgagcctctgcctggcccctgctgctgtcctgtggccgtcctggaggaggtgatgctggtccctggccacctctacagccctgaactcttgagacaactctctccagcaatagctgcccagctttgcccaactgttgcttcttggggcagcgaactgagccctggggctgctgctgtaatttataaggcaaattttattaaatttgtaactattacca

SEQ ID NO: 22227 - DNA, 619 bp, Homo sapiens
gcagctgattggtgcgggaggcaaggtgggcggggctctgagccggaggtttgttgtgagggtcggttgtcaagcagcggccaatcaaggcaggggatggaggcaagtgggggtcgcgcctggagcggagcctcggcctccggagccgcagctgcagccctgtattgagctgagatggctcgagcctaacattccatgatccaggatcgtgacagatgtgcacaggctgctgctgttgctgctgtgggtaatttggaaccacgaggcaccccagggccagaagacgaggcattctgtctgcctggatgtgtgggaactctctgccaacttgattggtggatctggggggggatccacccccaccccacgaggaaagcacagtttattttgtgggtggggcttcaggtgccagccagctgaaggatggccacccctgtggtcaccaagacagcctggaagttgcaagagatcgtcgcgcatgccagcaacgtgtcctcactggtgctgggcaaagcctccgggcggctgctggctacaggcggggatgactgccgcgtcaacctgtggtccatcaacaagcccaactgcatcatgtcgagattcgggatcctctataatc

SEQ ID NO: 22228 - DNA, 3035 bp, Homo sapiens
ctttctcttttaaaaaaagtcaactagaattgagaagaggtgattttttttcagatcgcttctcgagtttaatattttcacattcttttcaccctttttctcaatctagatttaaaattaggatatatgtcatttccttgtctgtatttgtagctccttagttaccagtatgcctctccattttctacaaataagaggttataacacatatacataattctaaccttaagggaacacacgtttacatactttacttcccaagcccttcctgtttggggtacagattgagagagtcatgaatcaacacatctagcaagaccacaggtgtaagagtctaagatcgtcttcaaaattctgaagtcccagtctttacctgtccagtgaatgaatattcagagcagcttttcctgggcttcccagtggtgatagctgaggtcaaaccacaaaaaataagaaagcaagagtgaaatgcacccctccagagaaacactttgtagtgtttaattctgttaatagagaagagctgcttctgtttgcgctcacttcatcagtggcacccttctgcagaattttaatataaaaacattatggatataatagaactggattttctgacttaaaaatgtaagttttattttaatcttgaaacgtggattgtttctgtggagctcttaaacatgagaagaatacttacggttgataatgtgtaacatgatctgaaatgtgactcatttgagcctctttgtcccatcgtcctgtttttgaattattgacattgtcagtctctttgcttcctgggtgagacttggggtttgagggacagggaatgaccttcttggtgaaacttaaaatataacattgcaattgcagtgactttacagtgttaaattagagaaaatagtctgattttttaaaccttccttaactggaaaaaagtcacatggttttaccaggattgaaataaacagtcaatgtgacttttaacatgtgtttttttgaaataaaggacacgtactcttcaattaaaaagttccttatagggactctggcaaatgctaacacagttgctttacaatgtttacaattcagacaatacgacttataatagaaaatcctcattcatttagcattgaaaagctggaagttgcttctttaatgttgaatagtatacagtggtattgagcatggactttctaaatgttttatatatacatataaaaatatattggtgtctcacacccagaaagatgttatattgtagatattattaggaaaacagtgtttctcaggaacgttgtaaattttaaatgatatatgtacttcccgtcctcccacctccactctgtgctctaatgtgagactgcttcagcagtgttgctaagttaatggaaaactttttctaatcaagtcaggtgaatgtgtattctgctaaataatgttagccatttacatgaattgtatggtcattaaatggaatcagtgattcctctttaatttccagaggggaaatgaattatggaaatcagtcagcattctgatcattaaattttatactttaattttgccgttcagcattctaaatatccaatgtgaaagtcacatgataatttgttttgcattgcgtgcactgtacaacacttacaacttgtcatttaaaatgttttctcgggaaatgaatgctagtcagaaagtaatagattgtattattcatagttttaaaattatgacaatgtcataattactacaaagctaaataatcgtgtttatttttgtgcagttgccctttgatagttcctggttttaaaacctattaagtgtataatcttacaaatagtcatctacaaaatttatggagaaagtgcccagcccattcacatcacatggaccaggaattcttttgtaaatgacttaaggtaacatcatgcagttcagtgcctaataaatgctttttaatgatgaacatttctataatgactcgtaagataccatagtctgatttttctcacattaaaataactgaagtcacttgtgtaacgtagttatactttgctgcattttaattaaccttcaacagctattaaagtggaatgtaagttaaattttgaaggaaaggaaataaatgttttccatatttcgtcttgatttactttctgtatgagaacagctgtgtttttgataggtttatggtttgcatgagttcatatttaaagtgatccaggccaatgcatggctattgctgtaaatcttgatgtttatttctgccttgtaaagttctatcacggcctacctggaatttaaaattcagtagacaaattaattggtcctctgcacaacttttttaataagtagattattttacaaagaaatttgaacaaatttaattgaatcttttgtttagcttgcctctaagaacttttcttaataaagctcccaaaacttctcagcaaataaatctcccttaagtaggaaaactagatttcatatttgcttactttgaattaacagcaactttccacaggtaaatctgttcttgcaaagatgtgagcagaatagttaaaaataatatttttatgtttcatggttctaaatggaagccataaatgcagtaaatactatctgttgtttaactactttaatcgtcattttttacattttcaagtttattaggttaagaaaaacagggcagccttggaaggcagctactacagaaaactgcagttttgcgttaaagataaagtagtattttcagctccctgaaaaaccattcctgctgaaactgctgtagaaattgtgaagctgcatgagtggagagtattgaatctgtggttatagtagttttctcaggtttgtttatcttgatgtttgatgcactgtgttttatagttattaaaattgagtaatattatttctatgcagtgttatgtgtcattggccttttgtgaatgtgcatgttttaaactgcaaattttaaacattttgtcctctaattgttattaaaaatgaaataaactttaccattacttaaaaaaaaaaaa

SEQ ID NO: 22229 - DNA, 2980 bp, Homo sapiens
ctttctcttttaaaaaaagtcaactagaattgagaagaggtgattttttttcagatcgcttctcgagtttaatattttcacattcttttcaccctttttctcaatctagatttaaaattaggatatatgtcatttccttgtctgtatttgtagctccttagttaccagtatgcctctccattttctacaaataagaggttataacacatatacataattctaaccttaagggaacacacgtttacatactttacttcccaagcccttcctgtttggggtacagattgagagagtcatgaatcaacacatctagcaagaccacaggtgtaagagtctaagatcgtcttcaaaattctgaagtcccagtctttacctgtccagtgaatgaatattcagagcagcttttcctgggcttcccagtggtgatagctgaggtcaaaccacaaaaaataagaaagcaagagtgaaatgcacccctccagagaaacactttgtagtgtttaattctgttaatagagaagagctgcttctgtttgcgctcacttcatcagtggcacccttctgcagaattttaatataaaaacattatggatataatagaactggattttctgacttaaaaatgtaagttttattttaatcttgaaacgtggattgtttctgtggagctcttaaacatgagaagaatacttacggttgataatgtgtaacatgatctgaaatgtgactcatttgagcctctttgtcccatcgtcctgtttttgaattattgacattgtcagtctctttgcttcctgggtgagacttggggtttgagggacagggaatgaccttcttggtgaaacttaaaatataacattgcaattgcagtgactttacagtgttaaattagagaaaatagtctgattttttaaaccttccttaactggaaaaaagtcacatggttttaccaggattgaaataaacagtcaatgtgacttttaacatgtgtttttttgaaataaaggacacgtactcttcaattaaaaagttccttatagggactctggcaaatgctaacacagttgctttacaatgtttacaattcagacaatacgacttataatagaaaatcctcattcatttagcattgaaaagctggaagttgcttctttaatgttgaatagtatacagtggtattgagcatggactttctaaatgttttatatatacatataaaaatatattggtgtctcacacccagaaagatgttatattgtagatattattaggaaaacagtgtttctcaggaacgttgtaaattttaaatgatatatgtacttcccgtcctcccacctccactctgtgctctaatgtgagactgcttcagcagtgttgctaagttaatggaaaactttttctaatcaagtcaggtgaatgtgtattctgctaaataatgttagccatttacatgaattgtatggtcattaaatggaatcagtgattcctctttaatttccagaggggaaatgaattatggaaatcagtcagcattctgatcattaaattttatactttaattttgccgttcagcattctaaatatccaatgtgaaagtcacatgataatttgttttgcattgcgtgcactgtacaacacttacaacttgtcatttaaaatgttttctcgggaaatgaatgctagtcagaaagtaatagattgtattattcatagttttaaaattatgacaatgtcataattactacaaagctaaataatcgtgtttatttttgtgcagttgccctttgatagttcctggttttaaaacctattaagtgtataatcttacaaatagtcatctacaaaatttatggagaaagtgcccagcccattcacatcacatggaccaggaattcttttgtaaatgacttaaggtaacatcatgcagttcagtgcctaataaatgctttttaatgatgaacatttctataatgactcgtaagataccatagtctgatttttctcacattaaaataactgaagtcacttgtgtaacgtagttatactttgctgcattttaattaaccttcaacagctattaaagtggaatgtaagttaaattttgaaggaaaggaaataaatgttttccatatttcgtcttgatttactttctgtatgagaacagctgtgtttttgataggtttatggtttgcatgagttcatatttaaagtgatccaggccaatgcatggctattgctgtaaatcttgatgtttatttctgccttgtaaagttctatcacggcctacctggaatttaaaattcagtagacaaattaattggtcctctgcacaacttttttaataagtagattattttacaaagaaatttgaacaaatttaattgaatcttttgtttagcttgcctctaagaacttttcttaataaagctcccaaaacttctcagcaaataaatctcccttaagtaggaaaactagatttcatatttgcttactttgaattaacagcaactttccacaggtaaatctgttcttgcaaagatgtgagcagaatagttaaaaataatatttttatgtttcatggttctaaatggaagccataaatgcagtaaatactatctgttgtttaactactttaatcgtcattttttacattttcaagtttattaggttaagaaaaacagggcagccttggaaggcagctactacagaaaactgcagttttgcgttaaagataaagtagtattttcagctccctgaaaaaccattcctgctgaaactgctgtagaaattgtgaagctgcatgagtggagagtattgaatctgtggttatagtagttttctcaggtttgtttatcttgatgtttgatgcactgtgttttatagttatttgtgcatgttttaaactgcaaattttaaacattttgtcctctaattgttattaaaaatgaaataaactttaccattacttaaaaaaaaaaaa

SEQ ID NO: 22230 - DNA, 801 bp, Homo sapiens
cagatattttctatgtgatttagagagtaggagtttagtgtgtagagtttaataagatgaaagtgttcttggggtcttgtgagactaatagaacaagagttactactggttccactgtggaaaaatttataggaactgtagtctttataataatccctttaaggacaaaattcgtttattgcctgtcttctcacacttcggagcaaaacttaactgaatgaaccttgaagattgagttaatcatttctagaaaagaattaaattaggaagaaaacctgctaaaacttttgtctgtcagtcagcatttatttggctctcctgtgggtagatttgtaatggagaaacaggagcactagaaaccttgcctcattcttgtttcagagaaaacctaaaatcccagctgggatccaaacctgtatgcacacaaatatcagcaaatcttaatgctctagagtacagacttcctgacttcaaagttgattcatcatagcaaaattaaaactataacttggcaaaaaagtgatcgacattctaaagatttgaaagcattggctgggtgcagtggctcatgcctgtgatgccagcactttgagaggctgagacgggaggatcacttgagcccaggagttcaagaacagcctggggaatgtggggaaacctcatctctacaaaaaaaatacaaaaaattaggtgggtttggtggtgagagcctgtagttccagctactcaggaggctaaggcgggaggatcacttgagcctggggaggtcaaggcctgcatgacagagcaagaccctgtctc

SEQ ID NO: 22231 - DNA, 416 bp, Homo sapiens
aaacgtctcaaatgcataattttattattttatttgttgtctccagattggtctgaggactccgctttcttcactgcccattcatcttcatactgttctcatatttttttttaaattgggatatgcaatgatccttagtttataaattcaactccactttgccacacacagtgttacgcttggggaaacaattagaacttgcccttcttggccaggcgcggtggctcccgcctgtgatcccagcactttgggaggccaaggtgggcagatcacgaggtcaagagatggagaccatcctggccaacatggtgaaaccccgtctctactaaaaatacaaaaattagctgggcatggtggcgcgcgcctgtagtcccagctatttgggaggctgaggcaggagaatcgcttgaacccgg

SEQ ID NO: 22232 - DNA, 907 bp, Homo sapiens
gtggtatttgttatggcccctgtacactcccttccctccctctcccaagtccagtccgcagctcgctcatcaccaggctcctttccatgactctttcttgatcaggcctttttatcgtcctcaccacaggttagagcacagcagagtaatccctccccggaaagagaagatcacagattttgtcatattaaatacattgtagaaattcatggtagcaggggcaagatcatttaaacaaaacagaaagtttcagagagagaaaaagccaaggacaaagattaatcatttttctgcttaaaaaaaatggctttgatttgcaaccatggaatgctccactgtttctcttctcttcaaagacatctactgaaaggattccttaaccttaccaagtggccaaaatacttttctgagaagagtcacagagcataggcccccctagggtacacagagatttcattagtccctagatgtttcctgatccttttaaaaactggttaaattcagagactctaggcaattacttctttcagaacctgtgaggcaaaaacgaaagaagaaggcaggacacgcagtgtaacaaaccttggaatggtaagtaggaaatatgagttagttttttggctaagctatgaatttaccttgtgcctgccagaaatcactcagtcttttgtgactgtaaattttctgtaagtgttaattggtttggtttattattgcaagaagcaagggagcaatgttgtgtattataatttcattgtgtcaattttgccaaattatcttgcattttgttattctatgaactcataatgggataaggagtataggctttgattcagaacatatgtgatgttgctataaatgcttcatggaaaaccctaaatatattttgaagcctacatagtcaaaa

SEQ ID NO: 22233 - DNA, 961 bp, Homo sapiens
gtggtatttgttatggcccctgtacactcccttccctccctctcccaagtccagtccgcagctcgctcatcaccaggctcctttccatgactctttcttgatcaggcctttttatcgtcctcaccacaggttagagcacagcagagtaatccctccccggaaagagaagatcacagattttgtcatattaaatacattgtagaaattcatggtagcaggggcaagatcatttaaacaaaacagaaagtttcagagagagaaaaagccaaggacaaagattaatcatttttctgcttaaaaaaaatggctttgatttgcaaccatggaatgctccactgtttctcttctcttcaaagacatctactgaaaggattccttaaccttaccaagtggccaaaatacttttctgagaagagtcacagagcataggcccccctagggtacacagagatttcattagtccctagatgtttcctgatccttttaaaaactggttaaattcagagactctaggcaattacttctttcagaacctgtgaggcaaaaacgaaagaagaaggcaggacacgcagtgtaacaaaccttggaatgattggtctgaggactccgctttcttcactgcccattcatcttcatactgttctcatatttttttttaaattgggatatgcaatgatccttagtttataaattcaactccactttgccacacacagtgttacgcttggggaaacaattagaacttgcccttcttggccaggcgcggtggctcccgcctgtgatcccagcactttgggaggccaaggtgggcagatcacgaggtcaagagatggagaccatcctggccaacatggtgaaaccccgtctctactaaaaatacaaaaattagctgggcatggtggcgcgcgcctgtagtcccagctatttgggaggctgaggcaggagaatcgcttgaacccgg

SEQ ID NO: 22234 - DNA, 886 bp, Homo sapiens
gtggtatttgttatggcccctgtacactcccttccctccctctcccaagtccagtccgcagctcgctcatcaccaggctcctttccatgactctttcttgatcaggcctttttatcgtcctcaccacaggttagagcacagcagagtaatccctccccggaaagagaagatcacagattttgtcatattaaatacattgtagaaattcatggtagcaggggcaagatcatttaaacaaaacagaaagtttcagagagagaaaaagccaaggacaaagattaatcatttttctgcttaaaaaaaatggctttgatttgcaaccatggaatgctccactgtttctcttctcttcaaagacatctactgaaaggattccttaaccttaccaagtggccaaaatacttttctgagaagagtcacagagcataggcccccctagggtacacagagatttcattagtccctagatgtttcctgatccttttaaaaactggttaaattcagagactctaggcaattacttctttcagaacctgtgaggcaaaaacgaaagaagaaggcaggacacgcagtgtaacaaaccttggaatggacttcgccagacttcatcagaagaaagcagtgcaagaggggactgcagaggaaagctggggcttgggaaaccagcagcaggggccacgtgggcaggtggtttctgtgtgaacctctgatctgtgcaacataaacaggaaatgttgaaggcttccagtgctcttttttgatgtcgagaacattctacggcacaaaagagtttgcctctcactgtttctcatatatggaggttctctaatcagcatcctgaacagatttgatttagactaaaaacccaagtaaaactagctttatc

SEQ ID NO: 22235 - DNA, 558 bp, Homo sapiens
gcagctagtgagtagaaccaacagggtgcccatttttgatggtgttgtctgtctttcacattttcccagtggtcagggagagagtccagatgggacaggatgtgtcctggtaggtaagggcacccccaggtgtacctgccaatccagctgtaaggtaagtaagaccagctatgactgcctcacacccatagctaactccaggagaaaggataggccccatcatgtagcttgatactattttgccatcctagccacatattattattcagttgatgggtttggccacattactaagaggtaaccatcccttagcctggctgctagtgtggggtgtgttgctcttgtgtttttggatgcgtagaggtgcctgacccattgcctgaatttgcaccatcatcagccatcctatgttgtcatgtacagcatagtctatagagggggtgatattaacctgcttacaagccacatggaagaaatgtttccaggtttctccaaaagtggagcactcatggtgagtggtactgtaatcatagatgggaaatgggtgagaatttttac

SEQ ID NO: 22236 - DNA, 576 bp, Homo sapiens
aataggctgaatagataaatatatatgtgaatgcacaaagactggaaatgtacatcagatgttatttaaatatattttaagttacaaaatatccccttgcttaaacctgtcgacttcagattcagaagagtcataccgtgatgagatttactgagcagctatcagcctagcccttccagcacagccctatttgttgactcactccctaggaaggatcagaaacaaagttactgaagtgtagccaagaatttagttattaagaatatttattctggctgggttcagtgactcatgtctataatcccagcactttgggaggccgaggttggagaatcacttgagctcaggatttcaagaactgagcaacaggagttcaccctgggcaacatagtaaggcctgttctccactaaaaattaaaaaaaaaaaaaaagttaggtgtggtggtgtgtgcctgtagtcacagttacttgggaggctgaggcaggaggatcacttgagcctgggaggtcaagactacagtgagctatgattgccctactattctccagcctgggtaacagtgagaccctgtctca

SEQ ID NO: 22237 - DNA, 276 bp, Homo sapiens
ttttttttttaaagaaggagctatttcagctcacgatctaaaattatatagatgaagacaacactgaagaagaaaaatggcatgatgattaggatacatctagaggcaaggaaacacaacaaaacgggaaaactattaaagggaaaggaagaagagaataatcatgaacaaagaaaattgaaaatatattaaggatattctgagacacagacgtatgcacacatacatgtatgtgcacacatacacacatacacacacaaaatgaagagaagggag

SEQ ID NO: 22238 - DNA, 268 bp, Homo sapiens
gctggtctcgaactcctaacctcatgatccaccaacctcggcctcccaaagtgctgggattacaggcgtgagctactgcatccagcctgttttgttttttgagacagtctcactctgttgcccaggctgattgcagtggtgcaatcgctgctcactgtagcctcgacctccctagactcagctgatccttgcacttcagcctctagaggagttgggaccacaggcgtgctctagcatgcccggctaatttttgttttttgtttttttt

SEQ ID NO: 22239 - DNA, 415 bp, Homo sapiens
tcaagtgaatatgatgattgtacatgtaattgggaaatatggcctagtgtgcatagagtgctttatagctcagtgcccagcacaggtgaaacactgaaatgtttggtaatggtcagctgtcataataatagttttttgtttctttgcttttatcttttgtttttttgagcctgggcaacagagtgagaggctatctcaaaaaaaaaaaaaaaaaaaaagcaaggacaccatggaccagagaggtgaagtaacctgctcaaagtcacactacttggaagaagtgggaagggtgggcacagttgctcatgcctataatcccagtactttggaagaccaaggtaggaggatgaggccaggagtttgaaaccaccctgggcaatgtagtgagactccatctctccaaaaatttacaaga

SEQ ID NO: 22240 - DNA, 583 bp, Homo sapiens
ccaggctggtctcagactcctgggctcaagcaatcctcctgcctcagctcctaaagtattttattactgttaacaagtaagggctgggtgcggtggctcatgtctttaatcctagcactttgggaggccaaggaaggtggatcacctgaggtcaggagttccagaccagcctggccaacatagtggaaccccacctctactaaaattacaaaaaattagccaggtgtggtggcgggtgcctgtaatcccaggcaacttgggagactaaggcagaagaattgcttgaacctgggaggctgaggttgcagtgagccaagatcatgccactgcactccagcctgggcaacagagtgagaggctatctcaaaaaaaaaaaaaaaaaaaaagcaaggacaccatggaccagagaggtgaagtaacctgctcaaagtcacactacttggaagaagtgggaagggtgggcacagttgctcatgcctataatcccagtactttggaagaccaaggtaggaggatgaggccaggagtttgaaaccaccctgggcaatgtagtgagactccatctctccaaaaatttacaaga

SEQ ID NO: 22241 - DNA, 245 bp, Homo sapiens
aacccaggagacagaggttgcattgagctgagatcatgcaactgcactccagcctgggcgacagaatgagactgcatctcaaaaaaaaaaaaaaaaaaaatccatgtactccaaagggactctccaaggctctcatcaaaatacttttcattcttgttctaatataattttaatactcttggctgaggccggtggatcacttgagcccaggagttccagactagcctgggcaaatggcaaaaccc

SEQ ID NO: 22242 - DNA, 211 bp, Homo sapiens
tccagttcagcaagaagatattacaattgtaaatatatacgtacccaacttcagagcagctacatatgtaaagtaaatattgatagcagtaaagatcagagaaaaagataaaatagagattaaaaaatagaaaagattaatgaaacaaagagttggctttttgaggaggtcaactaaattgacaaatctttaactacactaaaaaaaaaaa

SEQ ID NO: 22243 - DNA, 333 bp, Homo sapiens
gctcagatgcttgaccctctctccctcttcatggaatagtaggacttagggtcagctacagagccagcccagatacaagaggataggaaataaaggatacctctcaatggaggagtgacaaataatttgcttccatcttacatctactacagatcataatggttttaatgtgacttaaaagtattttttgaagtgtgtcatatgccctttaactttcatatggattcgatgtgtagatgattttaaattatacacagtaaaatttgtcagtcacttctgagattatcccaacttctcgcccatatacaaaattttcttcttaaatgaaaagca

SEQ ID NO: 22244 - DNA, 1273 bp, Homo sapiens
ggcttctctgtgtcttaacagctgccccttgcctggcttttcagcttcttaccccatgctaagaattggcatataccctaaataggaaaatgggcttgcagaaagtcaggctcacctcagtgagcctcccctctctccaagatctggttcctcaaatcgtggctgattagtagctttcctattacttcacacagatgtttaaaaattttatctggcttttctaatttccctcatcagaaccagtctgctacaacctactctattaaagctggaagttaaacacgtctgtttttttttgtttgttttaagtggattatgttaaaaaataaaaatcacaggccaaaaaccaaggtaacaatgtcattttaaacatgtaaatttaataaaggatatatgttgatttttagttactctttcttgccttattaaaagcttgtcagtaccttttttcatatgtactctgaaattcttacaaatatatgttgctttgttccagagaatatgtgtactaaaagactataatttttctgagtctggttctccattcaaatgttttaatacttttgtgattttatgatttgtaattgtcgactctcacctcccaattcaacatgatcctaaaatgtacaaaataatttgaatgattgagtttcaaaaagttttagaaaacttgatcttgtaacttttattccaaagctttgttgagggggagaagtacaggcttctgcctttaagggtactgcttcacttttggggcaaaaaagcaagggttttcaaagggggacttgacatgaatggcatgcaggggagggggtgagccagtgggggtctcaatgacttgctttggtgctttatctaccaggtggttgagctggtgccctcgcgggcagaactaggtggtaaggtggccagagtcttgagatactctccaagtgggagtgagtttcatcatgggcatactttaggttataatttgttatctctcgaggcagtctcctggtcgaagagacgtctggctctggagcttctaagtaagcaagagcttccaagtaagcacacagataagcttgccctacagggagtgtctggtgaaggaaaggtaaatgttataattgcatttctaaagagctaagtaggaagtggggaacaagggaaaaggaggaaacagaaaagaagaaaaaagtattttttaaaaaagtaattctttctcttagaaaaaggtgggtacttggttacagtctaaaccctttaccgtggctgagtaggtattttt

SEQ ID NO: 22245 - DNA, 289 bp, Homo sapiens
atctatctttattgctgagttttcctcattttttattctttattgtcctttttattcttttgtctttttctttaatctttatgtttttaaaattttagatgccaaagtgtttcataacacagcatccaacaacctccaaaccataagttgtaggcagaaggaaggaaaatgagaatgaagtagtttggtagctttattcttcagcatctgtttgagagtaatctctgaatctgtttgtttttatcacaagctatgcgcacatttttatttgtgcattacttctttcata

SEQ ID NO: 22246 - DNA, 402 bp, Homo sapiens
aattttgcaataactaaaatattgcacctataaaaagggaagctttgtcccttccacagggctcttcgaatgtggtgatgccatgtggaagctggggcttttggaagttggttatgattgagtggtgagatctcttcactctccctctcactacttcttcattctagaaagagtagtaaatacttatttttctaactgactaaagactcttatatttatttgttctattgatggtagaccttgcgtgatgctttcctatatctctattgaaatcttctgaaagtgacagaatgttcccattaaaaacaatttactgccactttgcttcaagacactggaccaaactataattaatagtgagttagagagaatggagttagtaggtactggtgactagaggtg

SEQ ID NO: 22247 - DNA, 212 bp, Homo sapiens
tctggttatggaaatagttggttctaattttaaccaacacctactactgtttcagcacattcctctaggttcaaggaaatgatgactttccagtcagggtctacagtgacacagacatgaacttggaaatttaagcttccaattttcagccactccaccatgtttctgtttgcgtgtgtgtttttttaaagagtcaaaataccatgaaaaac

SEQ ID NO: 22248 - DNA, 3935 bp, Homo sapiens
caggctcagaggctgaagcaggaggaaggaaggactggaaggaaaaagagacaggttagagggaaagaggcttgggaagaaaacagcagaaaagaaactgctcattacacttacagagaggcaagtaacggtggagatgaggacagagggaaccaagactctgaaagacaaaaaatacaaatagagcgaaagaggaaaaaaatgtcaagaagaacatccatccggagaaatgaagagaatgaaagttttaaactgcagagccgttctgtgcttttccggcacaaaattatatcgctgattttaagcccttttgcatttgccagccgttgacattaagaggcatgtttaacggtgccaacagcatctccttttccttctcctcttcctcttcttcttcttcctcctcctcctcctctttttcctcctcctcgttctcctcccatcagcaagaagacaaaccgaggacagtcttgaaatatcgaaatttcctctttgggatttgccagcgccaagactgtcggaataaaggacgctgactattgtattattgttattttattaattagtcagtggaaagattacagatgaggaaaggggacgcctgtcacccttcctgtgctaagatttaaaaaaaaatgaggctggattgcgggaagctctaaaatgaagcaaaaggagtaagatttttaaagacagaaagccacaggagcccccacgtagcgcacttttatttgtattttttcagatttttttttgtttcgtggtggtgggggaggtgattgggtggctgactggctgcgggaagctacttcctttccttttggagatgattgtgctattattgtttgccttgctctggatggtggaaggagtcttttcccagcttcactacacggtacaggaggagcaggaacatggcactttcgtggggaatatcgctgaagatctgggtctggacattacaaaactttcggctcgcgggtttcagacggtgcccaactcaaggaccccttacttagacctcaacctggagacaggggtgctgtacgtgaacgagaaaatagaccgcgaacaaatctgcaaacagagcccctcctgtgtcctgcacctggaggtctttctggagaaccccctggagctgttccaggtggagatcgaggtgctggacattaatgacaaccccccctctttcccggagccagacctgacggtggaaatctctgagagcgccacgccaggcactcgcttccccttggagagcgcattcgacccagacgtgggcaccaactccttgcgcgactacgagatcacccccaacagctacttctccctggacgtgcagacccagggggatggcaaccgattcgctgagctggtgctggagaagccactggaccgagagcagcaagcggtgcaccgctacgtgctgaccgcggtggacggaggaggtgggggaggagtaggagaaggagggggaggtggcgggggagcaggcctgcccccccagcagcagcgcaccggcacggccctactcaccatccgagtgctggactccaatgacaatgtgcccgctttcgaccaacccgtctacactgtgtccctaccagagaactctcccccaggcactctcgtgatccagctcaacgccaccgacccggacgagggccagaacggtgaggtcgtgtactccttcagcagccacatttcgccccgggcgcgggagcttttcggactctcgccgcgcactggcagactggaggtaagcggcgagttggactatgaagagagcccagtgtaccaagtgtacgtgcaagccaaggacctgggccccaacgccgtgcctgcgcactgcaaggtgctagtgcgagtactggatgctaatgacaacgcgccagagatcagcttcagcaccgtgaaggaagcggtgagtgagggcgcggcgcccggcactgtggtggcccttttcagcgtgactgaccgcgactcagaggagaatgggcaggtgcagtgcgagctactgggagacgtgcctttccgcctcaagtcttcctttaagaattactacaccatcgttaccgaagcccccctggaccgagaggcgggggactcctacaccctgactgtagtggctcgggaccggggcgagcctgcgctctccaccagtaagtcgatccaggtacaagtgtcggatgtgaacgacaacgcgccgcgtttcagccagccggtctacgacgtgtatgtgactgaaaacaacgtgcctggcgcctacatctacgcggtgagcgccaccgaccgggatgagggcgccaacgcccagcttgcctactctatcctcgagtgccagatccagggcatgagcgtcttcacctacgtttctatcaactctgagaacggctacttgtacgccctgcgctccttcgactatgagcagctgaaggacttcagttttcaggtggaagcccgggacgctggcagcccccaggcgctggctggtaacgccactgtcaacatcctcatagtggatcaaaatgacaacgcccctgccatcgtggcgcctctaccagggcgcaacgggactccagcgcgtgaggtgctgccccgctcggcggagccgggttacctgctcacccgcgtggccgccgtggacgcggacgacggcgagaacgcccggctcacttacagcatcgtgcgtggcaacgaaatgaacctctttcgcatggactggcgcaccggggagctgcgcacagcacgccgagtcccggccaagcgcgacccccagcggccttatgagctggtgatcgaggtgcgcgaccatgggcagccgcccctttcctccaccgccaccctggtggttcagctggtggatggcgccgtggagccccagggcgggggcgggagcggaggcggagggtcaggagagcaccagcgccccagtcgctctggcggcggggaaacctcgctagacctcaccctcatcctcatcatcgcgttgggctcggtgtccttcatcttcctgctggccatgatcgtgctggccgtgcgttgccaaaaagagaagaagctcaacatctatacttgtctggccagcgattgctgcctctgctgctgctgctgcggtggcggaggttcgacctgctgtggccgccaagcccgggcgcgcaagaagaaactcagcaagtcagacatcatgctggtgcagagctccaatgtacccagtaacccggcccaggtgccgatagaggagtccgggggctttggctcccaccaccacaaccagaattactgctatcaggtatgcctgacccctgagtccgccaagaccgacctgatgtttcttaagccctgcagcccttcgcggagtacggacactgagcacaacccctgcggggccatcgtcaccggttacaccgaccagcagcctgatatcatctccaacggaagcattttgtccaacgaggtaaggctgaagcgaaaggaccaccatctctcatctcctccatcagaaagcctcctctagcccggcccttgtatctctggtgcactgtatctatttttaggatattagcttatgtgtatcgttgtgggagcagagatgggcggtcaccttctcccactccttcgtgtgtaacctaactttcgcgttgttccaccctttcacatttattttcattccgtccccttggtactttgccaccttggagctccctcctttgctcttccatcctgtcagtcctttcccttctcagtaacctgggcatgaagggaaactgcgtgaagggagagggaaatgtggaggagggacttactttctagcactggcaaaggtcttttttctttgcgtctgtcccaggcattaataaagttggctctattttgctttgtttaacgatgcttttagtcgcgtgtacaagtaagctatagattgtttaacttta

SEQ ID NO: 22249 - DNA, 613 bp, Homo sapiens
ctttttcacagcacgggcacggaaaaggatatgctagtcaattctacaggacttacctgaagcagcatgatttgcacaaacatcaacttttcaacttcattatcttggccatccagttagtcatgtgtaactgagtattagatttcggatggagtcatcactaattgctctcagcaggcctgagaaatgagttgaaatgtgcagaactgtagaaactttagaggcaacagattttgcctccccgttacagcactatctatctttctctctccaaatgtcactgagccctttagatgtttatattcaccacgagaagccagtcataaagatataaatgcaatatcactgttttaaacttgactgttttatattatttttgtgtgatcaagtgttccgcaagctattccaactttacaagagaaattctgtgggttataaaaaatgttgtattctgaagacccacaaaatatcaaagacattctgtagtttatacaccgtgttgcaaagtgtttactgtactatttcaaagcttctaaataaatataaaatatatatattatattatataattttcctaaaacaaaaaaaagaaaatggcctcgtttgtcctcac

SEQ ID NO: 22250 - DNA, 708 bp, Homo sapiens
  misc_feature (40)..(40): n is a, c, g, or t
gggaaagtggacgcaggaggcatacgagcacaaggagatncagagctcacggaaaaggatatgctagtcaattctacaggacttacctgaagcagcatgatttgcacaaagtcgaccaacaaaagcatcaacttttcaacttcattatcttggccatccagttagtcatgtgtaactgagtattagatttcggatggagtcatcatggccaattataggacctaattgctctcagcaggcctgagaaatgagttgaaatgtgcagaactgtagaaactttagaggcaacagattttgcctccccgatcagtgtgtgcctgtttacagcactatctatctttctctctccaaatgtcactgagccctttagatgtttatattcaccacgagaagccagtcataaagataaaggaaatttgtgcattataaatgcaatatcactgttttaaacttgactgttttatattatttttgtgtgatcaagtgttccgcaagctattccaactttacaagagaaattgtgattatgttcttttcacctgtgggttataaaaaatgttgtattctgaagacccacaaaatatcaaagacattctgtagtttatacaccgtgttgcaaagtgtttactgtactatttcaaagcttctaaataaatatgattttcttctctcaatcaaaaacacaacacactggcctcctggcctcaa

SEQ ID NO: 22251 - DNA, 1507 bp, Homo sapiens
  misc_feature (45)..(45): n is a, c, g, or t
ggcagggggggctgttagggcagtaagattaagttttggaaaggncttgcgaggcgggcaaacacggaaaaggatatgctagtcaattctacaggacttacctgaagcagcatgatttgcacaaagtcgaccaacaaaagcatcaacttttcaacttcattatcttggccatccagttagtcatgtgtaactgagtattagatttcggatggagtcatcatggccaattataggacctaattgctctcagcaggcctgagaaatgagttgaaatgtgcagaactgtagaaactttagaggcaacagattttgcctccccgatcagtgtgtgcctgtttacagcactatctatctttctctctccaaatgtcactgagccctttagatgtttatattcaccacgagaagccagtcataaagataaaggaaatttgtgcattataaatgcaatatcactgttttaaacttgactgttttatattatttttgtgtgatcaagtgttccgcaagctattccaactttacaagagaaattgtgattatgttcttttcacctgtgggttataaaaaatgttgtattctgaagacccacaaaatatcaaagacattctgtagtttatacaccgtgttgcaaagtgtttactgtactatttcaaagcttctaaataaatataaaatatatatattatattatataattttcctaaaatgtggtacaactcagttggtttttaaatggatgcatacagtccacatcatacaataaaataaaaggtaattcagggtcccaaagacaaacttactaagaaaaaatcattaatagttttctcccaatttccatatcttactcaaccgtgtttttccttgtttaaaagaaaatgatgctctaagctacaaaattttgtcaaaaactcatattgaattttcaatgccaaagatgtagctattgatgttatcagacagagcactgactatgtactatcaaactatctaacaatctgcataagtctgattctatttctatgactttgaatttagaatcacttaaagcttttataaagaatcgataaattcacctgtatttgttgttagaaaaaaactgggtgtctgtacattttgtggtgtaaaatatgtaattgaagattactattttaagaagtcatcagtcatatcactcacacagaattttattttacatagttttgtgacttaattacacatgaatataaaatctataattctatatgaatatatagagatatagaaacatctgaactggtaaagaataactataaaatatgaaagctctaaatttaaaataaatttagagatagaatcatggtacattattgtttcagtattccatgtaaaaattttatagcttaaatgtagtcagtgtttgattaatgaaaaaattcttcatgagtcagccttcaaaagttaagcttgccttttacttttatgtcaacaatattaattattaaatttagtaagacgcactttcctt

SEQ ID NO: 22252 - DNA, 1492 bp, Homo sapiens
acccgctctcccatatagtcgcaccgcacccacaaacaacacccttacacggaaaaggatatgctagtcaattctacaggacttacctgaagcagcatgatttgcacaaagtcgaccaacaaaagcatcaacttttcaacttcattatcttggccatccagttagtcatgtgtaactgagtattagatttcggatggagtcatcatggccaattataggacctaattgctctcagcaggcctgagaaatgagttgaaatgtgcagaactgtagaaactttagaggcaacagattttgcctccccgatcagtgtgtgcctgtttacagcactatctatctttctctctccaaatgtcactgagccctttagatgtttatattcaccacgagaagccagtcataaagataaaggaaatttgtgcattataaatgcaatatcactgttttaaacttgactgttttatattatttttgtgtgatcaagtgttccgcaagctattccaactttacaagagaaattgtgattatgttcttttcacctgtgggttataaaaaatgttgtattctgaagacccacaaaatatcaaagacattctgtagtttatacaccgtgttgcaaagtgtttactgtactatttcaaagcttctaaataaatataaaatatatatattatattatataattttcctaaaatgtggtacaactcagttggtttttaaatggatgcatacagtccacatcatacaataaaataaaaggtaattcagggtcccaaagacaaacttactaagaaaaaatcattaatagttttctcccaatttccatatcttactcaaccgtgtttttccttgtttaaaagaaaatgatgctctaagctacaaaattttgtcaaaaactcatattgaattttcaatgccaaagatgtagctattgatgttatcagacagagcactgactatgtactatcaaactatctaacaatctgcataagtctgattctatttctatgactttgaatttagaatcacttaaagcttttataaagaatcgataaattcacctgtatttgttgttagaaaaaaactgggtgtctgtacattttgtggtgtaaaatatgtaattgaagattactattttaagaagtcatcagtcatatcactcacacagaattttattttacatagttttgtgacttaattacacatgaatataaaatctataattctatatgaatatatagagatatagaaacatctgaactggtaaagaataactataaaatatgaaagctctaaatttaaaataaatttagagatagaatcatggtacattattgtttcagtattccatgtaaaaattttatagcttaaatgtagtcagtgtttgattaatgaaaaaattcttcatgagtcagccttcaaaagttaagcttgccttttacttttatgtcaacaatattaattattaaatttagtaagacgcactttcctt

SEQ ID NO: 22253 - DNA, 707 bp, Homo sapiens
  misc_feature (45)..(45): n is a, c, g, or t
ggcagggggggctgttagggcagtaagattaagttttggaaaggncttgcgaggcgggcaaacacggaaaaggatatgctagtcaattctacaggacttacctgaagcagcatgatttgcacaaagtcgaccaacaaaagcatcaacttttcaacttcattatcttggccatccagttagtcatgtgtaactgagtattagatttcggatggagtcatcatggccaattataggacctaattgctctcagcaggcctgagaaatgagttgaaatgtgcagaactgtagaaactttagaggcaacagattttgcctccccgatcagtgtgtgcctgtttacagcactatctatctttctctctccaaatgtcactgagccctttagatgtttatattcaccacgagaagccagtcataaagataaaggaaatttgtgcattataaatgcaatatcactgttttaaacttgactgttttatattatttttgtgtgatcaagtgttccgcaagctattccaactttacaagagaaattgtgattatgttcttttcacctgtgggttataaaaaatgttgtattctgaagacccacaaaatatcaaagacattctgtagtttatacaccgtgttgcaaagtgtttactgtactatttcaaagcttctaaataaatataaaaaaaaaaaaaatggccctcgtggcctaagca

SEQ ID NO: 22254 - DNA, 723 bp, Homo sapiens
  misc_feature (45)..(45): n is a, c, g, or t
ggcagggggggctgttagggcagtaagattaagttttggaaaggncttgcgaggcgggcaaacacggaaaaggatatgctagtcaattctacaggacttacctgaagcagcatgatttgcacaaagtcgaccaacaaaagcatcaacttttcaacttcattatcttggccatccagttagtcatgtgtaactgagtattagatttcggatggagtcatcatggccaattataggacctaattgctctcagcaggcctgagaaatgagttgaaatgtgcagaactgtagaaactttagaggcaacagattttgcctccccgatcagtgtgtgcctgtttacagcactatctatctttctctctccaaatgtcactgagccctttagatgtttatattcaccacgagaagccagtcataaagataaaggaaatttgtgcattataaatgcaatatcactgttttaaacttgactgttttatattatttttgtgtgatcaagtgttccgcaagctattccaactttacaagagaaattgtgattatgttcttttcacctgtgggttataaaaaatgttgtattctgaagacccacaaaatatcaaagacattctgtagtttatacaccgtgttgcaaagtgtttactgtactatttcaaagcttctaaataaatatgattttcttctctcaatcaaaaacacaacacactggcctcctggcctcaa

SEQ ID NO: 22255 - DNA, 720 bp, Homo sapiens
  misc_feature (45)..(45): n is a, c, g, or t
ggcagggggggctgttagggcagtaagattaagttttggaaaggncttgcgaggcgggcaaacacggaaaaggatatgctagtcaattctacaggacttacctgaagcagcatgatttgcacaaagtcgaccaacaaaagcatcaacttttcaacttcattatcttggccatccagttagtcatgtgtaactgagtattagatttcggatggagtcatcatggccaattataggacctaattgctctcagcaggcctgagaaatgagttgaaatgtgcagaactgtagaaactttagaggcaacagattttgcctccccgatcagtgtgtgcctgtttacagcactatctatctttctctctccaaatgtcactgagccctttagatgtttatattcaccacgagaagccagtcataaagataaaggaaatttgtgcattataaatgcaatatcactgttttaaacttgactgttttatattatttttgtgtgatcaagtgttccgcaagctattccaactttacaagagaaattgtgattatgttcttttcacctgtgggttataaaaaatgttgtattctgaagacccacaaaatatcaaagacattctgtagtttatacaccgtgttgcaaagtgtttactgtactatttcaaagcttctaaataaatataaaaaacaaaacccaacaagaccaaccggtggcctcgttggcctcaa

SEQ ID NO: 22256 - DNA, 726 bp, Homo sapiens
  misc_feature (45)..(45): n is a, c, g, or t
ggcagggggggctgttagggcagtaagattaagttttggaaaggncttgcgaggcgggcaaacacggaaaaggatatgctagtcaattctacaggacttacctgaagcagcatgatttgcacaaagtcgaccaacaaaagcatcaacttttcaacttcattatcttggccatccagttagtcatgtgtaactgagtattagatttcggatggagtcatcatggccaattataggacctaattgctctcagcaggcctgagaaatgagttgaaatgtgcagaactgtagaaactttagaggcaacagattttgcctccccgatcagtgtgtgcctgtttacagcactatctatctttctctctccaaatgtcactgagccctttagatgtttatattcaccacgagaagccagtcataaagataaaggaaatttgtgcattataaatgcaatatcactgttttaaacttgactgttttatattatttttgtgtgatcaagtgttccgcaagctattccaactttacaagagaaattgtgattatgttcttttcacctgtgggttataaaaaatgttgtattctgaagacccacaaaatatcaaagacattctgtagtttatacaccgtgttgcaaagtgtttactgtactatttcaaagcttctaaataaatatttagttttagattttagcaaaaaaaacatcttggtctctttggctataaaggg

SEQ ID NO: 22257 - DNA, 5374 bp, Homo sapiens
caggctcagaggctgaagcaggaggaaggaaggactggaaggaaaaagagacaggttagagggaaagaggcttgggaagaaaacagcagaaaagaaactgctcattacacttacagagaggcaagtaacggtggagatgaggacagagggaaccaagactctgaaagacaaaaaatacaaatagagcgaaagaggaaaaaaatgtcaagaagaacatccatccggagaaatgaagagaatgaaagttttaaactgcagagccgttctgtgcttttccggcacaaaattatatcgctgattttaagcccttttgcatttgccagccgttgacattaagaggcatgtttaacggtgccaacagcatctccttttccttctcctcttcctcttcttcttcttcctcctcctcctcctctttttcctcctcctcgttctcctcccatcagcaagaagacaaaccgaggacagtcttgaaatatcgaaatttcctctttgggatttgccagcgccaagactgtcggaataaaggacgctgactattgtattattgttattttattaattagtcagtggaaagattacagatgaggaaaggggacgcctgtcacccttcctgtgctaagatttaaaaaaaaatgaggctggattgcgggaagctctaaaatgaagcaaaaggagtaagatttttaaagacagaaagccacaggagcccccacgtagcgcacttttatttgtattttttcagatttttttttgtttcgtggtggtgggggaggtgattgggtggctgactggctgcgggaagctacttcctttccttttggagatgattgtgctattattgtttgccttgctctggatggtggaaggagtcttttcccagcttcactacacggtacaggaggagcaggaacatggcactttcgtggggaatatcgctgaagatctgggtctggacattacaaaactttcggctcgcgggtttcagacggtgcccaactcaaggaccccttacttagacctcaacctggagacaggggtgctgtacgtgaacgagaaaatagaccgcgaacaaatctgcaaacagagcccctcctgtgtcctgcacctggaggtctttctggagaaccccctggagctgttccaggtggagatcgaggtgctggacattaatgacaaccccccctctttcccggagccagacctgacggtggaaatctctgagagcgccacgccaggcactcgcttccccttggagagcgcattcgacccagacgtgggcaccaactccttgcgcgactacgagatcacccccaacagctacttctccctggacgtgcagacccagggggatggcaaccgattcgctgagctggtgctggagaagccactggaccgagagcagcaagcggtgcaccgctacgtgctgaccgcggtggacggaggaggtgggggaggagtaggagaaggagggggaggtggcgggggagcaggcctgcccccccagcagcagcgcaccggcacggccctactcaccatccgagtgctggactccaatgacaatgtgcccgctttcgaccaacccgtctacactgtgtccctaccagagaactctcccccaggcactctcgtgatccagctcaacgccaccgacccggacgagggccagaacggtgaggtcgtgtactccttcagcagccacatttcgccccgggcgcgggagcttttcggactctcgccgcgcactggcagactggaggtaagcggcgagttggactatgaagagagcccagtgtaccaagtgtacgtgcaagccaaggacctgggccccaacgccgtgcctgcgcactgcaaggtgctagtgcgagtactggatgctaatgacaacgcgccagagatcagcttcagcaccgtgaaggaagcggtgagtgagggcgcggcgcccggcactgtggtggcccttttcagcgtgactgaccgcgactcagaggagaatgggcaggtgcagtgcgagctactgggagacgtgcctttccgcctcaagtcttcctttaagaattactacaccatcgttaccgaagcccccctggaccgagaggcgggggactcctacaccctgactgtagtggctcgggaccggggcgagcctgcgctctccaccagtaagtcgatccaggtacaagtgtcggatgtgaacgacaacgcgccgcgtttcagccagccggtctacgacgtgtatgtgactgaaaacaacgtgcctggcgcctacatctacgcggtgagcgccaccgaccgggatgagggcgccaacgcccagcttgcctactctatcctcgagtgccagatccagggcatgagcgtcttcacctacgtttctatcaactctgagaacggctacttgtacgccctgcgctccttcgactatgagcagctgaaggacttcagttttcaggtggaagcccgggacgctggcagcccccaggcgctggctggtaacgccactgtcaacatcctcatagtggatcaaaatgacaacgcccctgccatcgtggcgcctctaccagggcgcaacgggactccagcgcgtgaggtgctgccccgctcggcggagccgggttacctgctcacccgcgtggccgccgtggacgcggacgacggcgagaacgcccggctcacttacagcatcgtgcgtggcaacgaaatgaacctctttcgcatggactggcgcaccggggagctgcgcacagcacgccgagtcccggccaagcgcgacccccagcggccttatgagctggtgatcgaggtgcgcgaccatgggcagccgcccctttcctccaccgccaccctggtggttcagctggtggatggcgccgtggagccccagggcgggggcgggagcggaggcggagggtcaggagagcaccagcgccccagtcgctctggcggcggggaaacctcgctagacctcaccctcatcctcatcatcgcgttgggctcggtgtccttcatcttcctgctggccatgatcgtgctggccgtgcgttgccaaaaagagaagaagctcaacatctatacttgtctggccagcgattgctgcctctgctgctgctgctgcggtggcggaggttcgacctgctgtggccgccaagcccgggcgcgcaagaagaaactcagcaagtcagacatcatgctggtgcagagctccaatgtacccagtaacccggcccaggtgccgatagaggagtccgggggctttggctcccaccaccacaaccagaattactgctatcaggtatgcctgacccctgagtccgccaagaccgacctgatgtttcttaagccctgcagcccttcgcggagtacggacactgagcacaacccctgcggggccatcgtcaccggttacaccgaccagcagcctgatatcatctccaacggaagcattttgtccaacgagactaaacaccagcgagcagagctcagctatctagttgacagacctcgccgagttaacagttctgcattccaggaagccgacatagtaagctctaaggacagtggtcatggagacagtgaacagggagatagtgatcatgatgccaccaaccgtgcccagtcagctggtatggatctcttctccaattgcactgaggaatgtaaagctctgggccactcagatcggtgctggatgccttcttttgtcccttctgatggacgccaggctgctgattatcgcagcaatctgcatgttcctggcatggactctgttccagacactgaggtgtttgaaactccagaagcccagcctggggcagagcggtccttttccacctttggcaaagagaaggcccttcacagcactctggagaggaaggagctggatggactgctgactaatacgcgagcgccttacaaaccaccatatttgacacggaaaaggatatgctagtcaattctacaggacttacctgaagcagcatgatttgcacaaagtcgaccaacaaaagcatcaacttttcaacttcattatcttggccatccagttagtcatgtgtaactgagtattagatttcggatggagtcatcatggccaattataggacctaattgctctcagcaggcctgagaaatgagttgaaatgtgcagaactgtagaaactttagaggcaacagattttgcctccccgatcagtgtgtgcctgtttacagcactatctatctttctctctccaaatgtcactgagccctttagatgtttatattcaccacgagaagccagtcataaagataaaggaaatttgtgcattataaatgcaatatcactgttttaaacttgactgttttatattatttttgtgtgatcaagtgttccgcaagctattccaactttacaagagaaattgtgattatgttcttttcacctgtgggttataaaaaatgttgtattctgaagacccacaaaatatcaaagacattctgtagtttatacaccgtgttgcaaagtgtttactgtactatttcaaagcttctaaataaatataaaatatatatattatattatataattttcctaaaatgtggtacaactcagttggtttttaaatggatgcatacagtccacatcatacaataaaataaaaggtaattcagggtcccaaagacaaacttactaagaaaaaatcattaatagttttctcccaatttccatatcttactcaaccgtgtttttccttgtttaaaagaaaatgatgctctaagctacaaaattttgtcaaaaactcatattgaattttcaatgccaaagatgtagctattgatgttatcagacagagcactgactatgtactatcaaactatctaacaatctgcataagtctgattctatttctatgactttgaatttagaatcacttaaagcttttataaagaatcgataaattcacctgtatttgttgttagaaaaaaactgggtgtctgtacattttgtggtgtaaaatatgtaattgaagattactattttaagaagtcatcagtcatatcactcacacagaattttattttacatagttttgtgacttaattacacatgaatataaaatctataattctatatgaatatatagagatatagaaacatctgaactggtaaagaataactataaaatatgaaagctctaaatttaaaataaatttagagatagaatcatggtacattattgtttcagtattccatgtaaaaattttatagcttaaatgtagtcagtgtttgattaatgaaaaaattcttcatgagtcagccttcaaaagttaagcttgccttttacttttatgtcaacaatattaattattaaatttagtaagacgcactttcctt

SEQ ID NO: 22258 - DNA, 3248 bp, Homo sapiens
  misc_feature (47)..(48): n is a, c, g, or t
  misc_feature (53)..(54): n is a, c, g, or t
agagcggcggcgggaagtgttgcgcaggcgcatccgatcgactcggnnggtgnngatctcttggagacggcgacccaggcatctggggagccacagaagtcgtactcccttaaaccctgctttgctccccctgtggatgtaaccccttagctggcattttgcatctcaattggcttgtgatggaggcgtctttggggattcagatggatgagccaatggctttttctccccagcgtgaccggtttcaggctgaaggctctttaaaaaaaaacgagcagaattttaaacttgcaggtgttaaaaaagatattgagaagctttatgaagctgtaccacagcttagtaatgtgtttaagattgaggacaaaattggagaaggcactttcagctctgtttatttggccacagcacagttacaagtaggacctgaagagaaaattgctctaaaacacttgattccaacaagtcatcctataagaattgcagctgaacttcagtgcctaacagtggctggggggcaagataatgtcatgggagttaaatactgctttaggaagaatgatcatgtagttattgctatgccatatctggagcatgagtcgtttttggacattctgaattctctttcctttcaagaagtacgggaatatatgcttaatctgttcaaagctttgaaacgcattcatcagtttggtattgttcaccgtgatgttaagcccagcaattttttatataataggcgcctgaaaaagtatgccttggtagactttggtttggcccaaggaacccatgatacgaaaatagagcttcttaaatttgtccagtctgaagctcagcaggaaaggtgttcacaaaacaaatcccacataatcacaggaaacaagattccactgagtggcccagtacctaaggagctggatcagcagtccaccacaaaagcttctgttaaaagaccctacacaaatgcacaaattcagattaaacaaggaaaagacggaaaggagggatctgtaggcctttctgtccagcgctctgtttttggagaaagaaatttcaatatacacagctccatttcacatgagagccctgcagtgaaactcatgaagcagtcaaagactgtggatgtactgtctagaaagttagcaacaaaaaagaaggctatttctacgaaagttatgaatagtgctgtgatgaggaaaactgccagttcttgcccagctagcctgacctgtgactgctatgcaacagataaagtttgtagtatttgcctttcaaggcgtcagcaggttgcccctagggcaggtacaccaggattcagagcaccagaggtcttgacaaagtgccccaatcaaactacagcaattgacatgtggtctgcaggtgtcatatttctttctttgcttagtggacgatatccattttataaagcaagtgatgatttaactgctttggcccaaattatgacaattaggggatccagagaaactatccaagctgctaaaacttttgggaaatcaatattatgtagcaaagaagttccagcacaagacttgagaaaactctgtgagagactcaggggtatggattctagcactcccaagttaacaagtgatatacaagggcatgcttctcatcaaccagctatttcagagaagactgaccataaagcttcttgcctcgttcaaacacctccaggacaatactcagggaattcatttaaaaagggggatagtaatagctgtgagcattgttttgatgagtataataccaatttagaaggctggaatgaggtacctgatgaagcttatgacctgcttgataaacttctagatctaaatccagcttcaagaataacagcagaagaagctttgttgcatccattttttaaagatatgagcttgtgataatggatcttcatttaatgtttactgttatgaggtagaataaaaaagaatactttgtaatagccacaagttcttgtttagagaccagagcaggattaataatttattttaacattttagtgtttggtggcacattctaaaatatagattaagaatacttaaaatgcctgggatagttcttgggactaacaacatgatcttctttgagttaaacctacctaagtagattttaggtgggttcctattaggtcagatttttagcttccctaattacctttcactgacatatacagaaaaaggagcagttttagttttaattaattaaaattaacagatgtgatgaggattaaatgaatcaaaagacttaatttgtagattcttttagagttatgagctaggtatagtttggggaaactcaacctggtgctggtgctcttaacaattttgtaaataaagaagataatttccttttctagaggtacatattaggccttttatgaacactaaaacaatgaggaaatgttggtcatggggcaaagtatcacttaaaattgaattcatccatttttaaaaaacacttcatgaaagcattctggtgtgaattgccatttttttcttactggcttctcaattttcttccttctctgcccctacctaaaacattctcctcggaaattacatggtgctgaccacaaagtttctggatgttttattaaatattgtacgtgtttacagttgggaatttaaaataatacatacactggttgataaagggaagctgcaggaccaaggtgaagattgatagtccaaatgcttttcttttttgagttgtatattttttcacaccatcttagatataattaggtagctgctgaaaggaaaagtgaatacagaattgacggtattattggagatttttcctctgcgtagagccatccagatctctgtatcctgttttgactaagtcttaggtgggttgggaagacagataatgaagtaggcaaagagaaaaggacccaagatagaggtttatattcagaaatggtatatatcaatgacagcatatcaaacttcctatgggaaaaagtctggtgggtggtcagctgacagatttcccatttagtagtcatagaatacagaaatagtttagggacatgtattcattttgttattttgagcattgataggtcagtatatctacctaatctgtttggtaagtataggatatataaaccattaccattgatctgtcttatgccataatcttaaaaaaaaattgaatgctcttgaatttgtatattcaataaagttatccttttataaaaaaaaagtcgacgcggccgc

SEQ ID NO: 22259 - DNA, 3177 bp, Homo sapiens
agagcggcggcgggaagtgttgcgcaggcgcatccgatcgactcgctgctttgctccccctgtggatgtaaccccttagctggcattttgcatctcaattggcttgtgatggaggcgtctttggggattcagatggatgagccaatggctttttctccccagcgtgaccggtttcaggctgaaggctctttaaaaaaaaacgagcagaattttaaacttgcaggtgttaaaaaagatattgagaagctttatgaagctgtaccacagcttagtaatgtgtttaagattgaggacaaaattggagaaggcactttcagctctgtttatttggccacagcacagttacaagtaggacctgaagagaaaattgctctaaaacacttgattccaacaagtcatcctataagaattgcagctgaacttcagtgcctaacagtggctggggggcaagataatgtcatgggagttaaatactgctttaggaagaatgatcatgtagttattgctatgccatatctggagcatgagtcgtttttggacattctgaattctctttcctttcaagaagtacgggaatatatgcttaatctgttcaaagctttgaaacgcattcatcagtttggtattgttcaccgtgatgttaagcccagcaattttttatataataggcgcctgaaaaagtatgccttggtagactttggtttggcccaaggaacccatgatacgaaaatagagcttcttaaatttgtccagtctgaagctcagcaggaaaggtgttcacaaaacaaatcccacataatcacaggaaacaagattccactgagtggcccagtacctaaggagctggatcagcagtccaccacaaaagcttctgttaaaagaccctacacaaatgcacaaattcagattaaacaaggaaaagacggaaaggagggatctgtaggcctttctgtccagcgctctgtttttggagaaagaaatttcaatatacacagctccatttcacatgagagccctgcagtgaaactcatgaagcagtcaaagactgtggatgtactgtctagaaagttagcaacaaaaaagaaggctatttctacgaaagttatgaatagtgctgtgatgaggaaaactgccagttcttgcccagctagcctgacctgtgactgctatgcaacagataaagtttgtagtatttgcctttcaaggcgtcagcaggttgcccctagggcaggtacaccaggattcagagcaccagaggtcttgacaaagtgccccaatcaaactacagcaattgacatgtggtctgcaggtgtcatatttctttctttgcttagtggacgatatccattttataaagcaagtgatgatttaactgctttggcccaaattatgacaattaggggatccagagaaactatccaagctgctaaaacttttgggaaatcaatattatgtagcaaagaagttccagcacaagacttgagaaaactctgtgagagactcaggggtatggattctagcactcccaagttaacaagtgatatacaagggcatgcttctcatcaaccagctatttcagagaagactgaccataaagcttcttgcctcgttcaaacacctccaggacaatactcagggaattcatttaaaaagggggatagtaatagctgtgagcattgttttgatgagtataataccaatttagaaggctggaatgaggtacctgatgaagcttatgacctgcttgataaacttctagatctaaatccagcttcaagaataacagcagaagaagctttgttgcatccattttttaaagatatgagcttgtgataatggatcttcatttaatgtttactgttatgaggtagaataaaaaagaatactttgtaatagccacaagttcttgtttagagaccagagcaggattaataatttattttaacattttagtgtttggtggcacattctaaaatatagattaagaatacttaaaatgcctgggatagttcttgggactaacaacatgatcttctttgagttaaacctacctaagtagattttaggtgggttcctattaggtcagatttttagcttccctaattacctttcactgacatatacagaaaaaggagcagttttagttttaattaattaaaattaacagatgtgatgaggattaaatgaatcaaaagacttaatttgtagattcttttagagttatgagctaggtatagtttggggaaactcaacctggtgctggtgctcttaacaattttgtaaataaagaagataatttccttttctagaggtacatattaggccttttatgaacactaaaacaatgaggaaatgttggtcatggggcaaagtatcacttaaaattgaattcatccatttttaaaaaacacttcatgaaagcattctggtgtgaattgccatttttttcttactggcttctcaattttcttccttctctgcccctacctaaaacattctcctcggaaattacatggtgctgaccacaaagtttctggatgttttattaaatattgtacgtgtttacagttgggaatttaaaataatacatacactggttgataaagggaagctgcaggaccaaggtgaagattgatagtccaaatgcttttcttttttgagttgtatattttttcacaccatcttagatataattaggtagctgctgaaaggaaaagtgaatacagaattgacggtattattggagatttttcctctgcgtagagccatccagatctctgtatcctgttttgactaagtcttaggtgggttgggaagacagataatgaagtaggcaaagagaaaaggacccaagatagaggtttatattcagaaatggtatatatcaatgacagcatatcaaacttcctatgggaaaaagtctggtgggtggtcagctgacagatttcccatttagtagtcatagaatacagaaatagtttagggacatgtattcattttgttattttgagcattgataggtcagtatatctacctaatctgtttggtaagtataggatatataaaccattaccattgatctgtcttatgccataatcttaaaaaaaaattgaatgctcttgaatttgtatattcaataaagttatccttttataaaaaaaaagtcgacgcggccgc

SEQ ID NO: 22260 - DNA, 3298 bp, Homo sapiens
cggtccttcccggctgagctcgcggccagcgctggccggcggattcccattcattcacccttctcctcctccgcccagtactcgtggccagggtcgtatcagttctccgtcaacttgcttggggccttggacgagcctcctggcgcttcctgtcagtggcgaaaagctgctttgctccccctgtggatgtaaccccttagctggcattttgcatctcaattggcttgtgatggaggcgtctttggggattcagatggatgagccaatggctttttctccccagcgtgaccggtttcaggctgaaggctctttaaaaaaaaacgagcagaattttaaacttgcaggtgttaaaaaagatattgagaagctttatgaagctgtaccacagcttagtaatgtgtttaagattgaggacaaaattggagaaggcactttcagctctgtttatttggccacagcacagttacaagtaggacctgaagagaaaattgctctaaaacacttgattccaacaagtcatcctataagaattgcagctgaacttcagtgcctaacagtggctggggggcaagataatgtcatgggagttaaatactgctttaggaagaatgatcatgtagttattgctatgccatatctggagcatgagtcgtttttggacattctgaattctctttcctttcaagaagtacgggaatatatgcttaatctgttcaaagctttgaaacgcattcatcagtttggtattgttcaccgtgatgttaagcccagcaattttttatataataggcgcctgaaaaagtatgccttggtagactttggtttggcccaaggaacccatgatacgaaaatagagcttcttaaatttgtccagtctgaagctcagcaggaaaggtgttcacaaaacaaatcccacataatcacaggaaacaagattccactgagtggcccagtacctaaggagctggatcagcagtccaccacaaaagcttctgttaaaagaccctacacaaatgcacaaattcagattaaacaaggaaaagacggaaaggagggatctgtaggcctttctgtccagcgctctgtttttggagaaagaaatttcaatatacacagctccatttcacatgagagccctgcagtgaaactcatgaagcagtcaaagactgtggatgtactgtctagaaagttagcaacaaaaaagaaggctatttctacgaaagttatgaatagtgctgtgatgaggaaaactgccagttcttgcccagctagcctgacctgtgactgctatgcaacagataaagtttgtagtatttgcctttcaaggcgtcagcaggttgcccctagggcaggtacaccaggattcagagcaccagaggtcttgacaaagtgccccaatcaaactacagcaattgacatgtggtctgcaggtgtcatatttctttctttgcttagtggacgatatccattttataaagcaagtgatgatttaactgctttggcccaaattatgacaattaggggatccagagaaactatccaagctgctaaaacttttgggaaatcaatattatgtagcaaagaagttccagcacaagacttgagaaaactctgtgagagactcaggggtatggattctagcactcccaagttaacaagtgatatacaagggcatgcttctcatcaaccagctatttcagagaagactgaccataaagcttcttgcctcgttcaaacacctccaggacaatactcagggaattcatttaaaaagggggatagtaatagctgtgagcattgttttgatgagtataataccaatttagaaggctggaatgaggtacctgatgaagcttatgacctgcttgataaacttctagatctaaatccagcttcaagaataacagcagaagaagctttgttgcatccattttttaaagatatgagcttgtgataatggatcttcatttaatgtttactgttatgaggtagaataaaaaagaatactttgtaatagccacaagttcttgtttagagaccagagcaggattaataatttattttaacattttagtgtttggtggcacattctaaaatatagattaagaatacttaaaatgcctgggatagttcttgggactaacaacatgatcttctttgagttaaacctacctaagtagattttaggtgggttcctattaggtcagatttttagcttccctaattacctttcactgacatatacagaaaaaggagcagttttagttttaattaattaaaattaacagatgtgatgaggattaaatgaatcaaaagacttaatttgtagattcttttagagttatgagctaggtatagtttggggaaactcaacctggtgctggtgctcttaacaattttgtaaataaagaagataatttccttttctagaggtacatattaggccttttatgaacactaaaacaatgaggaaatgttggtcatggggcaaagtatcacttaaaattgaattcatccatttttaaaaaacacttcatgaaagcattctggtgtgaattgccatttttttcttactggcttctcaattttcttccttctctgcccctacctaaaacattctcctcggaaattacatggtgctgaccacaaagtttctggatgttttattaaatattgtacgtgtttacagttgggaatttaaaataatacatacactggttgataaagggaagctgcaggaccaaggtgaagattgatagtccaaatgcttttcttttttgagttgtatattttttcacaccatcttagatataattaggtagctgctgaaaggaaaagtgaatacagaattgacggtattattggagatttttcctctgcgtagagccatccagatctctgtatcctgttttgactaagtcttaggtgggttgggaagacagataatgaagtaggcaaagagaaaaggacccaagatagaggtttatattcagaaatggtatatatcaatgacagcatatcaaacttcctatgggaaaaagtctggtgggtggtcagctgacagatttcccatttagtagtcatagaatacagaaatagtttagggacatgtattcattttgttattttgagcattgataggtcagtatatctacctaatctgtttggtaagtataggatatataaaccattaccattgatctgtcttatgccataatcttaaaaaaaaattgaatgctcttgaatttgtatattcaataaagttatccttttataaaaaaaaagtcgacgcggccgc

SEQ ID NO: 22261 - DNA, 2010 bp, Homo sapiens
gtaggcacgagtcaccacacacggtaagttcaagatggatctgaccctgttctccatatagcagatcctggatcatggtaggtcgtggctggtgacactttacctaatcttagctggcacccgggcagcggataatcgcagtctgtacttagaaccaaagtcgcatggatgtgagtttcgtcgtatggtgcaccctacttgtgatgcatcatactatacgagggaatccagaagcgagctctcactaattccaagattacaacctcctggcggaaatcaatattatgtagcaaagaagttccagcacaagacttgagaaaactctgtgagagactcaggggtatggattctagcactcccaagttaacaagtgatatacaagggcatgcttctcatcaaccagctatttcagagaagactgaccataaagcttcttgcctcgttcaaacacctccaggacaatactcagggaattcatttaaaaagggggatagtaatagctgtgagcattgttttgatgagtataataccaatttagaaggctggaatgaggtacctgatgaagcttatgacctgcttgataaacttctagatctaaatccagcttcaagaataacagcagaagaagctttgttgcatccattttttaaagatatgagcttgtgataatggatcttcatttaatgtttactgttatgaggtagaataaaaaagaatactttgtaatagccacaagttcttgtttagagaccagagcaggattaataatttattttaacattttagtgtttggtggcacattctaaaatatagattaagaatacttaaaatgcctgggatagttcttgggactaacaacatgatcttctttgagttaaacctacctaagtagattttaggtgggttcctattaggtcagatttttagcttccctaattacctttcactgacatatacagaaaaaggagcagttttagttttaattaattaaaattaacagatgtgatgaggattaaatgaatcaaaagacttaatttgtagattcttttagagttatgagctaggtatagtttggggaaactcaacctggtgctggtgctcttaacaattttgtaaataaagaagataatttccttttctagaggtacatattaggccttttatgaacactaaaacaatgaggaaatgttggtcatggggcaaagtatcacttaaaattgaattcatccatttttaaaaaacacttcatgaaagcattctggtgtgaattgccatttttttcttactggcttctcaattttcttccttctctgcccctacctaaaacattctcctcggaaattacatggtgctgaccacaaagtttctggatgttttattaaatattgtacgtgtttacagttgggaatttaaaataatacatacactggttgataaagggaagctgcaggaccaaggtgaagattgatagtccaaatgcttttcttttttgagttgtatattttttcacaccatcttagatataattaggtagctgctgaaaggaaaagtgaatacagaattgacggtattattggagatttttcctctgcgtagagccatccagatctctgtatcctgttttgactaagtcttaggtgggttgggaagacagataatgaagtaggcaaagagaaaaggacccaagatagaggtttatattcagaaatggtatatatcaatgacagcatatcaaacttcctatgggaaaaagtctggtgggtggtcagctgacagatttcccatttagtagtcatagaatacagaaatagtttagggacatgtattcattttgttattttgagcattgataggtcagtatatctacctaatctgtttggtaagtataggatatataaaccattaccattgatctgtcttatgccataatcttaaaaaaaaattgaatgctcttgaatttgtatattcaataaagttatccttttataaaaaaaaagtcgacgcggccgc

SEQ ID NO: 22262 - DNA, 930 bp, Homo sapiens
agagcggcggcgggaagtgttgcgcaggcgcatccgatcgactcgctgctttgctccccctgtggatgtaaccccttagctggcattttgcatctcaattggcttgtgatggaggcgtctttggggattcagatggatgagccaatggctttttctccccagcgtgaccggtttcaggctgaaggctctttaaaaaaaaacgagcagaattttaaacttgcaggtgttaaaaaagatattgagaagctttatgaagctgtaccacagcttagtaatgtgtttaagattgaggacaaaattggagaaggcactttcagctctgtttatttggccacagcacagttacaagtaggacctgaagagaaaattgctctaaaacacttgattccaacaagtcatcctataagaattgcagctgaacttcagtgcctaacagtggctggggggcaagataatgtcatgggagttaaatactgctttaggaagaatgatcatgtagttattgctatgccatatctggagcatgagtcgtttttggacattctgaattctctttcctttcaagaagtacgggaatatatgcttaatctgttcaaagctttgaaacgcattcatcagtttggtattgttcaccgtgatgttaagcccagcaattttttatataataggcgcctgaaaaagtatgccttggtagactttggtttggcccaaggaacccatgatacgaaaatagagcttcttaaatttgtccagtctgaagctcagcaggaaaggtgttcacaaaacaaatcccacataatcacaggaaacaagattccactgagtggcccagtacctaaggagctggatcagcagtccaccacaaaagcttctgttaaaagaccctacacaaatgcacaaattcagattaaacaaggaaaagacggaaag

SEQ ID NO: 22263 - DNA, 335 bp, Homo sapiens
tctcccagatcacccattgtatttctttgttgtatgtctttagtctcctttaatctagaatcattcttcagcttttctttaactgtctgacatggatgtttttgaaacatacaggcctattgtgaatgtccttcaatttgggtttgtttcatgattagattcaaattatacatttttggaaaaaaaaatagcatgagtagattgggggtggtggctcacgcctgtaatcctagcactttgggaggccaaggtggaaggatcactttagcccaggagttcgagaccagcctatgcaacatagcaagacctcctctctacaaaacattttaaaaatt

SEQ ID NO: 22264 - DNA, 218 bp, Homo sapiens
ttagaatctacagttactaaaactgaagaagtggaaaatctggagaccgatacatagaaaaaggaaaaagacagtcaaagactcatcctccagattggagttttatttaaaccatggtttctcaacctcagcaatattgacatattgggccagacaattctttgtggagggttctcctgtgtgttgtaggatgtttagtgacatcccctctacctaag

SEQ ID NO: 22265 - DNA, 336 bp, Homo sapiens
ctcagagaagtgtccctcataccttaggttacaattaatgagcattcattgaacccctacaaattctaggcagtatgctaagcactttacatttataggtttatatgagaaatgtaaatctcatatttctatgaagtgtacagacagggaactgagttgttaaaatttacctaatattacatggtaagtgagtagtagattgagctttgaacttggatatgactgattagagttaaaaccttaagcacaagaaataagttttatttaatgtcttgctaaatgtattttattgatcaagacatggtggctcacatctgtaatcccagcactttgggt

SEQ ID NO: 22266 - DNA, 276 bp, Homo sapiens
gggcaaactcactggtctggccctgcctctacccttgctcctggaaaaggaagaatgcctttagctgggccctgaagaatgggcaaggggtgggtagctggaggggccagggagttgctgcacgggagtcggaccaatgtgtgtcagggtctctatctgttgtttgcaaacaagctctggactaaggtgataccacccagatgtggacacctgaggaaaagctaaatttgtcatcctgtgcaaactattggtctcccacaatcccctgtgacccct

SEQ ID NO: 22267 - DNA, 138 bp, Homo sapiens
tactcctccaaggccattctcagtaaatgcatgtccaggcacccggctgttcctgccacaaatctgggaaatatccttgacaccatcctaccccttgctctccctcatccaatcagtcgccaagccctaatcattatc

SEQ ID NO: 22268 - DNA, 1501 bp, Homo sapiens
gagcggagggtacgggcaatgagtccatgtatttgtgttttcagggaggtgttagggaaaggtggaggaaggcgaagagaaggctaaggaagcctaagaactgcggctgcagagtcacggaaacacttcgctccgctccaggatcactggcacaggcctttgccagggcgaactccgggcaagacccgtgaccccaccccagaaaactcccgactcccgggctggagaaggtagccaagatcattctcagttgccatatggcaaagacacaggaagctgccctgtgtagagacccacatggcaaggaactgagacatcctgccaacaaccaccagagtctgaggcctgctgccatcaccacgtgagtgagacatcttagaagtggatccttcagcctaagtcaagccttcagatgattgcatcttgactgcagcctcatcaaagaccttgaaccagaaccacccaactcaattactctcaaatgcttaacccatagaaactatagcgattatggcttgctatggcagtcagcccccaagatggaccccattgattctggactcctggtgccaaaaccattgtacccagatcaactgcaaacaagaacagagttttaatggaaattttaaacaagtaagatgaaaatcctgaagcatttctttcaagaattgtaacaggagatgaaacatggttttaccagtataatcccgaagacaaagtacaatcagagcaatggctaccaagaggtggaagtggtccagtcaaagcaaaagcagacctgccaagagcaaaggtcgtgggaatagttttttgggatacttattttgcttgttgactttctgaagagccaaagaacaataatatctgcttgtttcaagagtgttttgagaaagtttgctaaagctttagcagaaaaattcctggaaaagcttcaccagtctttttctaccgcaacaatgctcccactcattcttctcatcaaacaagggcaattttacaagactttcaatgagaaatcattaggcatcgaccttacagtcctaatttggctctttctaacttctttttgtttcctaatcttaaaaaatctgcaaagggctcccatttttcgtcatttaatcatgtaaaaaagacatggttaaatttccatgaatctcaatttttttagggatggattaaatgactggtgtcatcacttacaaccatggttgacctcgatggagcttatgttgagaaataaagtttatattctttatcttttaattcaatttttccatgaacattttgaagtgccctcatattataaatgatatttcattgttagtggttcattaatagggtatttaaatacaattcttttttaatattagtcctgtacactgagatcatgtttaaaaacctattagttctagtagtattttatagatttcttttgattttctatgtatacaatcatgtttctccaaataaagagttttatttttttccttccaaaaaaaaa

SEQ ID NO: 22269 - DNA, 2569 bp, Homo sapiens
gaactgccatttgaaggggctttggtggtgttcacagctgcctctttggcacctcctcccaagccggagtcaaggaggcccctgagccttggaccagccactgccacctccgacctgctcggccagaagctgcccagggacaaagcagagtgcaggtcatttatcttcaggctttgagatctgcgtggggggagctgttgcagcagcccaagccgcaggaattgctgagacaggatggcctggcaggggctggtcctggctgcctgcctcctcatgttcccctccaccacagcggactgcctgtcgcggtgctccttgtgtgctgtaaagacccaggatggtcccaaacctatcaatcccctgatttgctccctgcaatgccaggctgccctgctgccctctgaggaatgggagagatgccagagctttctgtcttttttcaccccctccacccttgggctcaatgacaaggaggacttggggagcaagtcggttggggaagggccctacagtgagctggccaagctctctgggtcattcctgaaggagctggagaaaagcaagtttctcccaagtatctcaacaaaggagaacactctgagcaagagcctggaggagaagctcaggggtctctctgacgggtttagggagggagcagagtctgagctgatgagggatgcccagctgaacgatggtgccatggagactggcacactctatctcgctgaggaggaccccaaggagcaggtcaaacgctatgggggctttttgcgcaaataccccaagaggagctcagaggtggctggggagggggacggggatagcatgggccatgaggacctgtacaaacgctatgggggcttcttgcggcgcattcgtcccaagctcaagtgggacaaccagaagcgctatggcggttttctccggcgccagttcaaggtggtgactcggtctcaggaagatccgaatgcttactctggagagctttttgatgcataagcacctcttttcatggagtagagtcaggagaaacccctgacaccttttcaggttggagtgcattcattcatcctcttatatgtgccccttccccatgctcagctcagcattgtgtacaaaatatccaagcccagcctatctctcttctgcgtgggagtatgttatttctctggggtctgtgatggggaagggtggatgtcccttccccacaataggcttagtgcttggctcagacacctagactctaaaactatcagcagcggcagcagcagcagcagcagcagtttgtgatctgtccttccaacctgttcacgtgactcctcaattccagggaaccagagcgatgtgttctttgtacctgtaggtctatgatgtccaaacttaacagatcacatgcccctcttagaagaaatatgagcatgctccctcatgcagatagtatacacatcataaacaaagagtagaactttaaaagaaggtaaataatcatacacagaaatcctaacattatattcccaaatctcaaaagatctcctgtgcacctgactttggagacgatgctttaggtaaaaagcttaaacattgccttatattggatcaggaacccttacagtagagggtccagtcttctagtggggtttaatgtttagtcagtgtactctgagtcctcattgttcagaaaagcacctcttgaagaactgacttcctgaactcccagtcatgttggtaccctggacagtgcctaactccttacagaagggagtgaaaacctctttcggaaatgattgagagcagcctcttgaatgcttaaatgatcaaggagggagaaaggcaaaccaatttgttctgtgcaacaaactcaaaatgtggaccagttccctcagccctcattaaactaattaaactgatgggtatcatgcttctactccatggtgaactgaagcagagtcaagctgatgaagttaagcacaaccatgttcttgagcagctgaattggctgccaagagtccaagccatctggcccaacatacgcactgggcattgggtaagggactccagaagcagcagctagaaagagaaaaagccctcttcaatccccataatgcttctttcctcttaatgtctcaaaataaaaccagaaagaggaataaaatgattaagtgcttgaggccaaatgagttcccttgattcaaataaccctgaatcagaggcagagacctcctgatgtcttggtttccatcaaagccctccctgtctgtctgtctctcttttgctctctcattcccaggcactctcttttggtttgtgggtccaggagatgaggctggataggagaggaaaaggcttgagtctggataatttgtataagatgctgctgagcacatctcttcatgcgcagtccccaggtatctgatgatgttctgaaatggatagattgttttagagttattttgtgtcctttaaaaaaatcccatttatgcaatttacttggaatttgcttagcctttaataggcttgtgtaatttcctgctcctccagtacaataaataaaagaaagatgaaaaaaaaa

SEQ ID NO: 22270 - DNA, 364 bp, Homo sapiens
ataaataaactataggggtgaggttatatattgccaacttgcctaattaaacaatagtatggttctggtttgaagggatcactactaacaaatgggctcatcttactttatggtgtggtagtaggtaaagtttttagtaaattggctcaagatccctcagaataatatattatcttttagtaatagagaaaactagccccaaatgtagaaagatgtttaaattgaaatgtatacagctggccaggcatggtggctcacgcctgtaatcccagcactttgggaggtggggcaggcggatcatgaggtcaggagatcgagaccatcctggccaacatggtgaaaccctgtctgtactacaaatacc

SEQ ID NO: 22271 - DNA, 322 bp, Homo sapiens
cacatccttggcaactgtcaggcaaacactgcaaccaacaattccactaggggtagaaaaacacttgcttaattcacgttacttgataacttcttctggaaaaaaaaaattaggggaggtggggaagaaacctccttctttcttctccacgaatccgaccgacgctacttgctttgcaacagcatcgcccttccccggccccctcccgcttcccagcactttccccctttaagaacacagaccaaccaaaatgatttaacttgagcagatgacagaaggaaaataaaacacgttaagagaatacggtctgatttgggatggc

SEQ ID NO: 22272 - DNA, 896 bp, Homo sapiens
aaaaaaatcaaaaacaaacaaaaataagtgaaaggactacttatcatttccagcagtcatgatgacaagttaaggtgggttaccaattccaatataggaaggggatttcttgtttgtctaaatttctttttttcttaaaaaaaaaaaatcatttttatgggtctgttgtacaggccattaagtcataacaaggtgtttataatcgtatcaattgtgttgggggttcctttcttaactggtacaatttaggcaggcctgtattactgtattattattgttgttgttgttattgttttatatatatagtttggacatgtttattatctcttgctcctggatcctatttcagtgagctcccacactgtggggagggagggttttggggtaaggggagacttctgttcttaactgtggggaatgttcttgctggtttccttatccttgatgactcttacagaggtgctagaaaattattttcttttgccacttatgcaagaggcttggtgcagaagctgaaggcagtgtgtgcaaacactcccattccacacacgccccttcccctccccacatcaggtggtgcctttggagcacttttgtgtaggaaggaattcctgctgaactgtagctctcactcacccccaaatcattgaatgaccctgaggcccagttcctgtggtgcaacagtgctgctttctgctactttcaatgggaacagctgtacatgttgcagggcaggatttggttcccaagagcaaagactactgcagacacctgacttggtggttctcctgatttcttatctcctgaaaaatgctcctgctgttggtgtgtttgtttgtttgttccattttgtggaagtttttcatccaaactttaactaacttggcaaaaaaaaa

SEQ ID NO: 22273 - DNA, 426 bp, Homo sapiens
gattacataccacatattttcggaatttgtccttcttcccaaattaaatgatcttgtatctgtactacacttcatcgtgttttgatttttagttcttttctccaaggtgcatatccagtgtgtgtattataattagcaaacttaataagcagcaaagttctcatttagagttttccttatgtaataggtaataatggaacagctagagtcaaacttctagaattgctttgcaaaatactgggagaaagttaattatgacgtatttactgagaggagattaaataaaaccagttaaatgagctgaagtccaaaatgagattttaggtagacatacctataggtaccagatagtaagtatttggacagcaaaacaacaaaactatcttcttttaaggtgggtagcccatcagccttgatattttcttt

SEQ ID NO: 22274 - DNA, 413 bp, Homo sapiens
aacaagcagtgggctggttttggccgtcaggttctagtttgccagcccctgcactaggatcattttttgggcccaaccctcacccctttattattcatgcattggaagttaatttctggctgggcgtggtggctcacgtctgtaatcccagcactttgggaggctgaggcaggcagatcacttcagccaggagttcaagaccagcctggccaacatggccaaacgccatctctactaaaaatataaaaattagccaggcctgggggcacccgcctgtagtcccagctacttgagaagctaaggcatgaaaatcgcttgaacccaggaggtggaggttgtagtgagccaagattgcgccactgtacttcattcagcctgtgtgacagagcaagatcctgtttcaaaaaaaaaaa

SEQ ID NO: 22275 - DNA, 336 bp, Homo sapiens
atggaaggaactctgaacacgtccgaacatcagaaggaacaaactctggtcacaccgtctttaagaactataacactcaccgcgagggtcggcggcttcattcttgaagtcagtgagaccaagaacccaccaattccggacacacagtggcctctggggggattccaccagggttcaggccctggactggggctggatgaatagatcccatcaggtcccaccctgggggacttggaaaacttttatgtctagctaaaggattgtaaatacaccagtcagcactctgtgtctagctccaggtcgtggatgcaccaatcagcatctgtatctagctaa

SEQ ID NO: 22276 - DNA, 1714 bp, Homo sapiens
ggcacgagggccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggaggcccacgcgcgcatccatctgcgggactatgtgatcgaagacgacgtcaacatggccatccgcgtgatgctggagagcttcatagacacacagaagttcagcgtcatgcgcagcatgcgcaagacttttgcccgctacctttcattccggcgtgacaacaatgagctgttgctcttcatactgaagcagttagtggcagagcaggtgacatatcagcgcaaccgctttggggcccagcaggacactattgaggtccctgagaaggacttggtggataaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcaggtttctgtgcccctgtggtggaagagggcacgacagtgccagcgcagcgttctgggctcctcagtcgcaggggtgggatgtgagtcatgcggattatccactcgccacagttatcagctgccatgctcctgtttgtattaaatggcagggtcatcattatttgtagg

SEQ ID NO: 22277 - DNA, 1755 bp, Homo sapiens
ggcacgagggccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggaggcccacgcgcgcatccatctgcgggactatgtgatcgaagacgacgtcaacatggccatccgcgtgatgctggagagcttcatagacacacagaagttcagcgtcatgcgcagcatgcgcaagacttttgcccgctacctttcattccggcgtgacaacaatgagctgttgctcttcatactgaagcagttagtggcagagcaggtgacatatcagcgcaaccgctttggggcccagcaggacactattgaggtccctgagaaggacttggtggataaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcaggtttctgtgcccctgtggtggaagagggcacgacagtgccagcgcagcgttctgggctcctcagtcgcaggggtgggatgtgagtcatgcggattatccactcgccacagttatcagctgccattgctccctgtctgtttccccactctcttatttgtgcattcggttggtttctgtagtttaattttaataaagttgaataaaatat

SEQ ID NO: 22278 - DNA, 379 bp, Homo sapiens
aagcccagtagattcagctgatgtctctgttccagttactagtaggccaggatcaaggtgtctgtcagtctgaagtcttctttggcaagagtctgcttccaggctcatttgaataattggcagaattcagttccatgcatttgtagaactgagatcttcatttccttgctgactgtgggctgagagattgttttcaatttctagaggccacctgcattccttggctgatggtctcatccatctttgagccagcaacagtgggtaaattcctgttacacttcaaatccctctcgcttattagtctacttacatttctgactctagccagagtgatatccttgtttttaaggatgtctgtgattagattaagcccaccaaa

SEQ ID NO: 22279 - DNA, 442 bp, Homo sapiens
tcccgtgaaacaaaacaatctcgcattaatctagagatggtacaggtatgttggaaaacaatattgcaaaatatatcaacaatcataaaattgttcaaagcattttttttgagactgagtcttgctgtgttgcctaggcttgactggactgcaacagctgttcacaggcacaatcattgcacactacagcctcgagctcttgggctcaagcaatcgtcctgcctcagtcgcccaagtagctgggactgcagtcacacacatctccatatcccactctcaaagtcttagattcaataatatttcttatgaaaagctatcctccagaaataatttaacaaaatgagtaagctacatattcccaaatttttcttatagcattaccagctgaatttccccaaactatattagagataaatattaggggtatagtgacgtaaattat

SEQ ID NO: 22280 - DNA, 410 bp, Homo sapiens
ggaagagataaaggaaagcagattttagcatagttgatcatttgggttttggatttatttgattaggaaacaataaataaagtgcttggagatctatcagtagtgtcacaaagaaaccattttttttaaatgatacaggtcacaggtgacctgggcttaaaggagtcattataaatcctactatccttctccatggtagagagattcccaagagtgcatcctaacggagacagaggctcgctacacggccttgctgacccagatccagagtctgattgataacctggaagctcagctggcagagatccggtgtgccctggaaagacagaaccaagaatacgagatcctgctggacgtcaagtcccggctggaatgtgagattaccacataccgcagccttctggagagct

SEQ ID NO: 22281 - DNA, 523 bp, Homo sapiens
ctatggttgttcaattgctctaatagcatttattgaaaaggttaatgatttatttgtacttctgccaaaattaattgatcatactcatgtggtcatacttccgctttctctgttttataccacttagctttgtctatcttgctatcaataccacactgtcttgattactgtagctatatattactgtagctatatagtaaactttaataaaaggaagatgaactttcttcttcttttttcaaaatcggtttggctgtttaaggtctttttcttttggtatacattttagagtaaaagtacatacttctatgaaataccttactaagcttctgataggaaatacgataacactgtagaacagtttagggaggactggtatctttactaaatcttctaacccataaacatgatatttaggtcttcttgtctttcaccaacattttgtaattttcaacatgtagattctatacaattttgttgagattatgtcatctgtgaataaagactgttttatttcttttcc

SEQ ID NO: 22282 - DNA, 367 bp, Homo sapiens
ccttctgactccaagcctgtagtcctttcactggcctacagctgcttcctgagcccctttcctggttcagtcaggcaaaacaaaccagcttcctgcgagttaagggggaaaagggtttaatggggactgactcattgagattggcagtcccctttggttaatttcatcaggtcatctcctagcgttccatttccttttgtggagacacagatcagaggcaatctggctctgtatgaactcactttgtgactctgggtgaatcatttccctctctgggtttcaggttcctcattgcacagtaagtatattggaattcagtggttctcaaatctgctggaacgtcagaatcacctggggacattttctt

SEQ ID NO: 22283 - DNA, 759 bp, Homo sapiens
  misc_feature (2)..(2): n is a, c, g, or t
angacaaacctttcctcagagttgctttatagttgtgggtctgagaataaattcacagattcacccactgcatgctttgatggtttcacgtcaggaatgggcctacttttcctcaggtgagagcggaatcctgctgtacaagccacctgtaatgtgggcagtggcaactgctgtttcctttccaagtcttctgaggttgtttcctagtaagtgagctggaggctatggggcctggtcctggtggtagctattttgcttttggacataaaatcttggtagcttaatgtatttgttcctagggctgcagtagcaaagtaccacaaaccgggtggtactggtactgtgggttgtcccgcagttctggagactggaagtctgaaatcagatgctggcagggttaatttgtcctgagggctgtgagggagacacagctcctggctttctcctagctgctggtagtttactggcaacctttggcattccttagcttgtggcatcatcactccagtattcatgtgatattcttcctgtgtgtgtgtctctatgtcaagatttcccctgtttataagaaaaccagtcatattgggttagtggttgagcccaccttactgaccaaataaagtcacatgtcgaggtactacgggttaggatttcaacatgtacattttagagggacacaatttaatctataatagtgtggaattttcttttgggtatctaccagtcaccaagatatttatccctacttgaccagccacc

SEQ ID NO: 22284 - DNA, 1524 bp, Homo sapiens
  misc_feature (1133)..(1133): n is a, c, g, or t
ttttcattaaccttttcagaagacaaacagatccctgataagggaataaaattttaaacacatttttaaaacaaattttaaatgttaagcaaatgtgaaacattgggctagttttctttgttcattaatttctaggctcagacaacattttgcattgtatcaggcccaggcagtcagtttttgtggttacttttggggctgtgttggccctccctcatggtggtgtgaccctaggaacataggcccctaaaccgtttccctgatcttttcccagtaataaggcatttattgcaacatagcatcaactccattatgttgtatacacaagaactgttttgcttttttgaggcttggtcatggatactgattatgaacagacaaaaaatcttcagcatgtcctctttaggagaagttgtccttggatccatttgccaaggatttgtttaggtggcatagcagacagaggacattgtcttacagagcattaaagaatcatcataggagcagcaaacaattttattactgtaaaatttggtggtagtgggttttctatcccattttagtatttaatatacatcatctgccttctgggattaatgtctaaatgatacattgaaattcttggagatgccttagaaatgtctgtcaataggaattttttttctactttttaaggctatgttaatctcatagtgaaatttcctagttaaacagtaaaaaatagaaaatttatccaaatagtctggatgaactggttttaccttctcatgacaaaatggtaggtgaccaaacagtaggatgggtaaatgcagttctacttttatctattaaaaattagcagttgttctttaaaaagaagcaaattttataatttctaagtgccacctgcctgctgtttgcatttgtgcctcagggcccaaagaagcaagagataagcagtaatgtgtatgttttgcaatggttcttgtcaccattaaacaacaactggaaagaagggaaaataattgggggatcagatatactctcttttctcttgtctttattgttcctaatatcaggtgcccctccagtgtgtgaaaatggtatgaagcctggaggcctggcaaaggatgaagaacagagaatgggaatanaaagggacagaccatttttgctcagctctagactttttttttaaatcagctgtcatatgtgaaataatagcagaacagtgtaatgattaagaacatgatcctcggccgggcgcggtggctcaagcctgtaatcccagcactttgggaggccgaatcacgaggtcaggagatcgagaccgtcctggctaacacggtgaaaccccatctctactaaaaatccaaaaaaaaaaaaaaaaaaaaaatcagccgggcgcggtggcaggcacctgtagtcccagctattcgggaggctgaggcaggagaatggcgtgaacccgggaggcggagcttgcagtgagccgagatcgggccactgcactccagcctgggcgacagagcaagactctgtcta

SEQ ID NO: 22285 - DNA, 635 bp, Homo sapiens
gcacccccaccaaagtctgagcatcattctacaaatgccttgtccagcggtgaacattctattgcagccaagcaaagtaaggggcatcagttgcacattttgccatcaagcaaagcaacaaaatgatgccttgcagcttttatggccaaacaaacacaaatgatgtaattgggaaaagctgtctccgaataggaggaaaagagtaaagggcaatcctttgagctggagagatgaccaccattcgagggtctgggatcaaagccccagccagacatcaaagcccatttgagtctaatgccaaaaaagccacagtgaattaaacttcatatataaactaattatagcttgaccccacaatcaggcttcagtgagcacacaggggaaagaaagcagacattgaaacaaaagatcaagaaaaaagaagcgtggtagcaaaatggggcaacatcatggccctgaaaattttaaacatcttttgagggcagaagggaataggggaatagcagaagaaacagcaaatgtttgacaatgctggtcttgtttgaaaggctatgaaacaactccttccatcctctctggtgcacaaccaaacactaccaaataaaccatcctacatgaaaaggttaaaaaatagc

SEQ ID NO: 22286 - DNA, 144 bp, Homo sapiens
gactccatctcagaaaaaaaaaaaaagtgtaggtctgtacaatgcagactgagtttctttgctgatcagttccagagcccttgccttaccacggtctgtgagatccggctcccggccagcgctccagcctcattttctccccat

SEQ ID NO: 22287 - DNA, 499 bp, Homo sapiens
acacttaccatgagtggagcctgtggaactggaagttgctctgggtgagtcagtggttgagtggtgtgtgtgtgtgagtaaacagtgcatttggtaccgatctttgactatcagaacatgaagtttcctcattttgtgcagtagccacatgctattttattccagggtgtgctctagcctacttacccagctcctgttgataagacatttaggtggttcccagtgttttgctattaaagacaatgcagtagtggataattttgtgagtaatattccacatctatctaagtatatatgtaggttaaatttctagaaatgaagttgctagaacaaaggaaaaataatctgtgtgtttgattatatgagagaaatgaagctactttaaaaattttacattaataaaatttttatattggaaacttaacttatttaaatgcaaagattatttagctatttttagaatattagtggactttagtatatctggtaccttaaaaag

SEQ ID NO: 22288 - DNA, 213 bp, Homo sapiens
gagaaagtccacatcccaggccttgcaaatggctgtgcctcctggggagaggagtggaggggagggcttgtccaggctgctggacatttgccaagtctcaaggcacaagcctgtgagctggccttcctgtgtcacaattctctcaccacagcaggcctccgtcaccagctcaccctgccccacaatcctggtgcatgcaaaggcatctggatt

SEQ ID NO: 22289 - DNA, 643 bp, Homo sapiens
cagaaaagtaaggaaacataactgggtaggaatgtccacttacgtttcacaaactcacttttagagtttcatgccactttcctcattcttctctttaagatactattatattgaacgtgggacccatgtctaaatacttgtatagataaatatttcttgtatattcttcccatacaagcaagacttgaatacagttgtagctagtcccacttttataataaaagcttccaaactctttatcataaactttgtctgtgagcttgggaatacagagaaagcaagttgatcattctgagacccttcctcatttgccctgaatcagttccccaagattggactgtactttaagctagttgttgtagcagtggtggttgttgttttatatcttgagatacttctagaacattctagaaacagggtattctaaaggcttactttatatgccatcctttttgaaccctcttattttagaaattattacacgtgcacacttatgatttcaaccttgtaaaataatttcaaattcatttcgtatccacattttactgcagtttccctatcatcatctcaatagttatagaactggttgaaattaaactgttttgaactaagaagtagatatatatatatatatatatatata

SEQ ID NO: 22290 - DNA, 882 bp, Homo sapiens
ggcacgagagaaaagcaaaaaagaagaaaaaattacccacaatcttaccatccagctataacaacacccagcattaggatataggtttgaaaatctgaattttcccccaaaatgcattacaatatcctttcctgtcattgaaatttattcaacaaccttaatagtatcctcattaatttaccaaaatattaaatcatcccttgtttttgattatttaagttgctattttctattgttgaaagcaaattttttcaacagaaaaggagggagaggcacaaagccctcaaggaatgtaataggaaagccatgggaagcaattaaataggtgggacccagaaatggggaggatgaagcttccaaaggataagatactttcaactttaacagtttggttttaaggacagctcctatttttttaaaacagccccactagggacttttgatggtgaacttccccagatgcccgtgacgtcaggaggtgaaagcaggtgctgcagtgggtggggctggcagctggtgtgctgctcaccgagaagggaggagggaggagccacggagaagcctggagaaggagtaacacaagaaagagactgcgccgtgaccctgtgaggaggcatttatgctttaaacccccatagggagtattcagagggcagaacctcagaagtagctgtgtgggtgtcgaggaggtagagcgttccttgctccttacagacctcactccccttttgcatccaggggccaatgctcctgccatcagccttgcgctctccttttcacttctcttatgggctcaggtggttaaagatgcttatgattttggcctggtgaaaaatccctaaggcaggaaagcacatgaaaggaattaggctatcttggaaa

SEQ ID NO: 22291 - DNA, 172 bp, Homo sapiens
aaatgatccacccacctcagcctcccacagtgctgggatcacagatgtgagctactgggcccagctgagcataagagtcttttctgtgtcacctttgtgttccctacagtgtctagcaagtgcgttgtgaggggaagataattgaataaattttatccaggtaaatgaacaa

SEQ ID NO: 22292 - DNA, 301 bp, Homo sapiens
gagacatcagcctactatttaaacaacaccctgtctggtttctatggcacaaactaccttcaaaaacaaaatgaaccatattaaatgaagcccagggaaagtcaagctcaggagtgctgccatagtctgtactccgagtcaggagacctggacttttatgttgcattgaccctgcagtcttgggctggggcctcaagcccaccaagaagagtgtaatttaccagccactgcagagtacagccggtgggatggagacagatgcccacctgagtgccaagcgaaacctgctccaaattttgtg

SEQ ID NO: 22293 - DNA, 309 bp, Homo sapiens
ccacagcaaggaaaatgagagaaaagagaagttcaggagagaaaggagatagaaagctggagaaagggaaaagatgcatttggtgaaaggaggtataagttgcatttcattcattcattcagcactagtttttgagcactatgtgccagccaccagcctcccttccaccagcctcccttccaccagtctcccttccaccagcctccctccctccagtctcccttctcccttccaccagccttgagggtctctctctcaacccctcaattgtttcctccatctcatttatcacaatttgtgatttgaaaa

SEQ ID NO: 22294 - DNA, 456 bp, Homo sapiens
ccacagcaaggaaaatgagagaaaagagaagttcaggagagaaaggagatagaaagctggagaaagggaaaagatgcatttggtgaaaggaggtataagttgcatttcattcattcattcagcactagtttttgagcactatgtgccagccacagggctaggtcccaggaatatggcaacagatgagttaaacaaagttactggtttcatgaagcctaccttttgttggaggaggtagaaggtagactcctaaagaataactagttgttcaaaatcacaaattgtgataaatgagatggaggaaacaaatgaggggttgagagagagaccctcaaggctggagagagaagagcttccttagattgtgtgatcagaaaagccttctcaaaaaaagtaattgccttttttggaacaaggagcattctgaaataaggaaaaagagaatgctgggaaatc

SEQ ID NO: 22295 - DNA, 351 bp, Homo sapiens
tctctgtgaaacaagaaaatataatgaactgtcatttgcacgttgcacaaagcatgaactttatttggagtcttagataaacttgttctgatctagaaatgaaaaataatgaactctgctgagttctgcatttcctgtctgaagttagctttaccataaggatctggtgggtaagtgtttgttgttcttgtcattaattattggaacagagttgtttggagtagatgattcattgtggaacaaatcgtctgattttgagggacattttccattataaaataattatacataaaaacagaagtattgctttaatactaagatttgtaacaatgccatgtcattctggttgta

SEQ ID NO: 22296 - DNA, 315 bp, Homo sapiens
ggtaatatgtctggtagcttgggaatccaggggctttccactttgtgattcaaccatagcaacatgagacttcaaatttgccctcgtgtggaaaagagatcttggaaaatccactcttgaattgacacacatcatttgcacttacagtccattggctagaactagtcatgtggctcaaacctaacctcagggaggctgggagaaataaaggagggcatgtattctctgtggatatcactctcattatcacatttgctccatcccttgtcagacattgaatgaacaaacactttggaaattgcaatgtggaaaaaa

SEQ ID NO: 22297 - DNA, 286 bp, Homo sapiens
aaatgtattgaaatgttagaatttatatggagtccagctttttactttccgaacacacacaagtgctttgaaattcattgagaagttatttctttggcaaaaaactcttgcttactctttcccttcaagagaacaggatctaacaaggtctatactctgaaattgtttaagatctttaaagtctgctcttactcttgaagtaagacatttcctttggtgatgacctcattggaaaggtcaaggagtgaataggaaattcttagagattgagatggcattgccaata

SEQ ID NO: 22298 - DNA, 348 bp, Homo sapiens
cacctcagaccatccttggatttatattatccttccagcttcccaaccagtagcagagcaaaggatgccccaactctgctccagtgctaaccccttcacctgtgtttgacagtgtctcccttttccactgcagctcctgcttccacatttatcctcaccctcaaagatctctggcttgttccctctgaattctgccatacacccaggcttccctgttgtaatatcatgtgcctcttgcctcttagtctcttttgctcccttttactacaaaacatgttgaacaggtggtccacgctcctatctctgcgtctctccaaaccaattttcatttccaccaatttactgaac

SEQ ID NO: 22299 - DNA, 642 bp, Homo sapiens
tgaatctgaaggatgccttcatctgtattcccctgagtccagagtcccatgaagtgtttgcctttgaataggaagactctgacactaaagctaaatgatagtattgctggatgatgctccatcaaggcttcaaaaactcactaaccgtccgggggaaatacatgctaaggagttttgggacctccaattgaaaaatgagactttgcttatatatgttgatggcatattagaagccagcacaactatggcaaattgaccagaatattatactggctttacatttttttttttgtctggatggggatccaaagtatccaagaaaaaaatcacaaatattgaaaaactcaattatatattttaggtttgaattttctcaggagcagagtaatctgctttcggactggagagaagctcttgtcagggtggccagactcaggacatggcagcagctgtgaggggtttttaggtatggctgaatgttgccatatttcattttcttattttgggcttatagcaaaatgtctctatgaagccctaagaccagacacttgacttctagaatggacaaggaatgtcaaaaggcctttctaaccattaagtaaaaattactaatggatctggctactgagaccccctgaacta

SEQ ID NO: 22300 - DNA, 2075 bp, Homo sapiens
tagagaaaagctctcgctatgttacccgggctggtctcgaactcctgggctcaagagatcctctggcctccgcctcccaaagttctgggattacaggtgtgagtccatgtgcccagccctttaattctttacttggggttcaggtgactacatatttcttacttacaaattttacttaatctcgctgatgctgtcacttgaaagctgacccaccttgaatgaagcctcctccaacaagtctggaatccatccgaatttaaattaacaggcgctcctatgaattccatcagagaacacacagtagatgctttagaacctcttcccatgcctccgaagtatctggtttgcattgtggtggccattagtcatccatgggcttctgatgtaaaaaacaaacctgcctcttttgaccctgtgctgtacagcatcagggcagtgattgctggccacatactggacccttgaaacagagggctctgcatccatgtccatgagccttcatgcccatctggccatcaggccttgggaagcagcaccccacagctttggcacagctgcagtgacctccttgcctccgaatggagtcaaatgtgtacacgctgcaattctcatctgcaggaagcactggcctccttcatccttaggctatagtgctgacactggcctccttcatcctcagactgtggtgccggatgtcacccctctgcgaggcccttgggatcgactgagtgaccagcagtgaagttcgtcagccttctgaatggatgccatgatcagatgtgatggagctcagtgggatgctgctgctttccctcccttagctaggatgtccctgataaaggatgacacccaagcctcagcacaactggccaaacttgaggtggtcatcatagcactgatgctgggccaacaattagccccatttgtacctttttacaaactttttgacaattgccaagaatcgtccaccttccctccccattgaattaaatacacttcttgtctcatggatactcagaataccaatcaaggtaacagatgcctttattttaactaaggacacagtacagatctcacagggacactccttatcccttgcagagttccagacactactgatggtcaccaaagcaacatttcatcagaaaacacagtgctgggcttgtgaagaaggtgtccagcagagcttccactgcccctgtaggctgcaggcagctgcttcagttgagagatacactgagctcctcaaagaattcctatttaaggtacaaagcagcgactggatgccctgctggattccactattgccacaggctttgataactctaagttcatgctccttaggaaagtgcactttttacaccaatgttagacagttccctcagttgcctttactggacatcaaggagttcacatttttgacaatctttcagtcctgaactgtccaaggggtggaggtagctccatacaggaagctgcctgctgcgtgtggatcagtaatatcagacttgcccaacagctcactggagacatcaaaaccaatgcatgggggatgcatgacgtcacccaaatatttaccacacgcttttgctgccagagaccccagatcacttttcctgcctcctgctaaacaaatgggagcagtagcttctcatcagcctccacatttcattactcataattgtggccttcctaatgtctcatgcccctaagcacttattacaatgtctcaacagccttctctcagcctctcaaaatattagtcatcattaaaataaatgtctgatgttaaagcatcagggtcaattgtactgtgacacctaaaatttcatgctgcatcccaccaggtcctcagcctaatggctttcatgcccccaacagactgctaaactctttgaattagtcaagcatatccctcaagggacaaggggttaccccaccctctgatttctaccaagcctgcctcccgcaccctgtgctccagagtgaacccccgggtagacctgcacagatgcagtgtcatcccctgttgggctgagtatgcgagatgaataaattacggtgaatttcgtcta

SEQ ID NO: 22301 - DNA, 710 bp, Homo sapiens
ccgggctgcaggaattcggcacgaggaaatatagacacattggataaatgctatttaaagtctgagtgcgttggtaactgattcagtcatctgtaggttgaagtgattacttttatctgccttcatagtgagaattagatttctattctttgtaaagcagggaatatagattgtgcatggagtaaaagaattcaatccttattaataatgatggtagctgcgctgcagaaaagaaagcctgtcagagtaacttattcagttttacatcataatcagaggtgtgtccatctctgttgaaggcagaattaaaaaccccttcaacatttttaaaataatagatgaaaaacatctcaaagtctcctttaaaatttgaattgacgattccacataaaaggaagggaccaaaaatatcttaaagaaatacttcacgatggaagtgatgttttaagtgaaatttcatcaaggagaagtttttccaaaaagtatttttacctcaggaagaatctcattagtttattctgtaaatagttcctagtaaaatgataaagacttgatttttcaaaaacaataaaaaacttacacggtttaatctaatgttgtgatttcgaaagtgcttcttctgcaatcatagttacgcgtgtgtatttatatgcattttcttagctcattcaaacgccaataaaatactatactatccaggctccttaaaa

SEQ ID NO: 22302 - DNA, 360 bp, Homo sapiens
gtccaaggggtggaggtagctccatacaggaagctgcccctgtaggctgcaggcagctgcttcagttgagagatacactgagctcggtcaattgtactgtgacacctaaaatttcatgctgcatcccaccaggtcctcagcctaatggctttcatgcccccaacagactgctaaactctttgaattagtcaagcatatccctcaagggacaaggggttaccccaccctctgatttctaccaagcctgcctcccgcaccctgtgctccagagtgaacccccgggtagacctgcacagatgcagtgtcatcccctgttgggctgagtatgcgagatgaataaattacggtgaatttcgtcta

SEQ ID NO: 22303 - DNA, 3750 bp, Homo sapiens
tagagaaaagctctcgctatgttacccgggctggtctcgaactcctgggctcaagagatcctctggcctccgcctcccaaagttctgggattacaggtgtgagtccatgtgcccagccctttaattctttacttggggttcaggtgactacatatttcttacttacaaattttacttaatctcgctgatgctgtcacttgaaagctgacccaccttgaatgaagcctcctccaacaagtctggaatccatccgaatttaaattaacaggcgctcctatgaattccatcagagaacacacagtagatgctttagaacctcttcccatgcctccgaagtatctggtttgcattgtggtggccattagtcatccatgggcttctgatgtaaaaaacaaacctgcctcttttgaccctgtgctgtacagcatcagggcagtgattgctggccacatactggacccttgaaacagagggctctgcatccatgtccatgagccttcatgcccatctggccatcaggccttgggaagcagcaccccacagctttggcacagctgcagtgacctccttgcctccgaatggagtcaaatgtgtacacgctgcaattctcatctgcaggaagcactggcctccttcatccttaggctatagtgctgacactggcctccttcatcctcagactgtggtgccggatgtcacccctctgcgaggcccttgggatcgactgagtgaccagcagtgaagttcgtcagccttctgaatggatgccatgatcagatgtgatggagctcagtgggatgctgctgctttccctcccttagctaggatgtccctgataaaggatgacacccaagcctcagcacaactggccaaacttgaggtggtcatcatagcactgatgctgggccaacaattagccccatttgtacctttttacaaactttttgacaattgccaagaatcgtccaccttccctccccattgaattaaatacacttcttgtctcatggatactcagaataccaatcaaggtaacagatgcctttattttaactaaggacacagtacagatctcacagggacactccttatcccttgcagagttccagacactactgatggtcaccaaagcaacatttcatcagaaaacacagtgctgggcttgtgaagaaggtgtccagcagagcttccactgcccctgtaggctgcaggcagctgcttcagttgagagatacactgagctcctcaaagaattcctatttaagtttaggctatgagcatagatggaagaggtggctgctgtattggatcaaggatatgagcagagatggatgaggcagcggctgtaatggatcaaggctatgaacatcttgtgaagtaggatgttaagtctgcaaatatcagagtgaatccaaacttatcaattcaacactggattgtaaaacagctcaaaaaaagactaaaaacacagctctacactttaggaggttggggcaggcagattgctcgagctcaggagtgggagacaagtttaggaaacatggaaaaaccctgtctcaaaaaaaaaaaaatttgaattagctgggtatggtggtataagcctgtggttccagcttctcaggaggctgaggtgagaggattgcttgagcctggaaggtgaggctgcagtgagctctgatcacaccactgcattccagcctaggtgatagagtgagaccctgtcttaaaaaaacaaacaaacaaacaaaaaacaaaaacagctctaaacgaatgtggctagaaaagtagctcaagttgttcctgtctggtgaaatacaaacataaatgaattatttatgtgccagtggcttcctgatgctgagagcaaagccagttgttctggcaggttctggaaaaatttatcacctcatggggttcaatgccaatgtcaaatcataaatataataatcaaatctgaaagtgaacccagtttcagagacatccagaagccactgtgtatgaagctcctttcagataaagagaagatattatttgacttcttatctctgttgtctagcacaatgtccagaacacaacagatattccatatgcacagtcacatcctatgtatgtgtgtttcttttccagcaaggactagaggtcctaagctttgtttgtatgacgagccagtgcccaaatgagcaggagggtcttagcacagtcacctacacactcatttcgatgctctgaccccttatcttggctagtcaaagcgtggtctatgagtttgcattttgataggatcccctggtgaatcttgtgcatgtcaaaggaagagaagaactgccctcaaaatatagagcaggtgaactaaattattaacttatagaggtaggctggctatttatttatgtatcttgttgatgggaagattcaaattgatatacataatcacccccataaggatttcaggtaaaaaacaaacaaacaaaggtttagatgttagatatattttacaattaccacaccagtctttttactacagcatctagtaacacatttaccatagatttagatggaaattttcatcccataagcctttgttagtatttttaaaattgaatactcaataaatagtggccaagttgaatctcttagaggaatctcactcaaactacagtcatattttccaataggccccacaaaaatcattgctctagagtaatttaatatatttatccacctctttagacacttaggtaagtataataatacaagttttgtgcgtgtgtgtgtattgtgtaccttgtggcttcttgcccagtttctgcaacacctgaagctgatgcatgtttaatgtaaataatgtccagcaatgttacaaatgttgacttttatgtgcccatcaggaaaaaaaagatgaatgttattgtagaggaaattttcattctggaaaaaatgcatactatttgaatattattttcatgatttccacagatattacacacagatattatattccaaggattatgtttcaaagtcatcaaaaatagaaaatacatctatatttctaactgaaaataataacagtaagtagcccagctttggggaaatgtaataaaaatattaatgaccatcacaactcattaaaagcataaattgtgcaatgatttaaactacatgttcttcatatgaatgtgtgtagaaatatagacacattggataaatgctatttaaagtctgagtgcgttggtaactgattcagtcatctgtaggttgaagtgattacttttatctgccttcatagtgagaattagatttctattctttgtaaagcagggaatatagattgtgcatggagtaaaagaattcaatccttattaataatgatggtagctgcgctgcagaaaagaaagcctgtcagagtaacttattcagttttacatcataatcagaggtgtgtccatctctgttgaaggcagaattaaaaaccccttcaacatttttaaaataatagatgaaaaacatctcaaagtctcctttaaaatttgaattgacgattccacataaaaggaagggaccaaaaatatcttaaagaaatacttcacgatggaagtgatgttttaagtgaaatttcatcaaggagaagtttttccaaaaagtatttttacctcaggaagaatctcattagtttattctgtaaatagttcctagtaaaatgataaagacttgatttttcaaaaacaataaaaaacttacacggtttaatct

SEQ ID NO: 22304 - DNA, 3692 bp, Homo sapiens
tagagaaaagctctcgctatgttacccgggctggtctcgaactcctgggctcaagagatcctctggcctccgcctcccaaagttctgggattacaggtgtgagtccatgtgcccagccctttaattctttacttggggttcaggtgactacatatttcttacttacaaattttacttaatctcgctgatgctgtcacttgaaagctgacccaccttgaatgaagcctcctccaacaagtctggaatccatccgaatttaaattaacaggcgctcctatgaattccatcagagaacacacagtagatgctttagaacctcttcccatgcctccgaagtatctggtttgcattgtggtggccattagtcatccatgggcttctgatgtaaaaaacaaacctgcctcttttgaccctgtgctgtacagcatcagggcagtgattgctggccacatactggacccttgaaacagagggctctgcatccatgtccatgagccttcatgcccatctggccatcaggccttgggaagcagcaccccacagctttggcacagctgcagtgacctccttgcctccgaatggagtcaaatgtgtacacgctgcaattctcatctgcaggaagcactggcctccttcatccttaggctatagtgctgacactggcctccttcatcctcagactgtggtgccggatgtcacccctctgcgaggcccttgggatcgactgagtgaccagcagtgaagttcgtcagccttctgaatggatgccatgatcagatgtgatggagctcagtgggatgctgctgctttccctcccttagctaggatgtccctgataaaggatgacacccaagcctcagcacaactggccaaacttgaggtggtcatcatagcactgatgctgggccaacaattagccccatttgtacctttttacaaactttttgacaattgccaagaatcgtccaccttccctccccattgaattaaatacacttcttgtctcatggatactcagaataccaatcaaggtaacagatgcctttattttaactaaggacacagtacagatctcacagggacactccttatcccttgcagagttccagacactactgatggtcaccaaagcaacatttcatcagaaaacacagtgctgggcttgtgaagaaggtgtccagcagagcttccactgcccctgtaggctgcaggcagctgcttcagttgagagatacactgagctcctcaaagaattcctatttaagtttaggctatgagcatagatggaagaggtggctgctgtattggatcaaggatatgagcagagatggatgaggcagcggctgtaatggatcaaggctatgaacatcttgtgaagtaggatgttaagtctgcaaatatcagagtgaatccaaacttatcaattcaacactggattgtaaaacagctcaaaaaaagactaaaaacacagctctacactttaggaggttggggcaggcagattgctcgagctcaggagtgggagacaagtttaggaaacatggaaaaaccctgtctcaaaaagaggctgaggtgagaggattgcttgagcctggaaggtgaggctgcagtgagctctgatcacaccactgcattccagcctaggtgatagagtgagaccctgtcttaaaaaaacaaacaaacaaacaaaaaacaaaaacagctctaaacgaatgtggctagaaaagtagctcaagttgttcctgtctggtgaaatacaaacataaatgaattatttatgtgccagtggcttcctgatgctgagagcaaagccagttgttctggcaggttctggaaaaatttatcacctcatggggttcaatgccaatgtcaaatcataaatataataatcaaatctgaaagtgaacccagtttcagagacatccagaagccactgtgtatgaagctcctttcagataaagagaagatattatttgacttcttatctctgttgtctagcacaatgtccagaacacaacagatattccatatgcacagtcacatcctatgtatgtgtgtttcttttccagcaaggactagaggtcctaagctttgtttgtatgacgagccagtgcccaaatgagcaggagggtcttagcacagtcacctacacactcatttcgatgctctgaccccttatcttggctagtcaaagcgtggtctatgagtttgcattttgataggatcccctggtgaatcttgtgcatgtcaaaggaagagaagaactgccctcaaaatatagagcaggtgaactaaattattaacttatagaggtaggctggctatttatttatgtatcttgttgatgggaagattcaaattgatatacataatcacccccataaggatttcaggtaaaaaacaaacaaacaaaggtttagatgttagatatattttacaattaccacaccagtctttttactacagcatctagtaacacatttaccatagatttagatggaaattttcatcccataagcctttgttagtatttttaaaattgaatactcaataaatagtggccaagttgaatctcttagaggaatctcactcaaactacagtcatattttccaataggccccacaaaaatcattgctctagagtaatttaatatatttatccacctctttagacacttaggtaagtataataatacaagttttgtgcgtgtgtgtgtattgtgtaccttgtggcttcttgcccagtttctgcaacacctgaagctgatgcatgtttaatgtaaataatgtccagcaatgttacaaatgttgacttttatgtgcccatcaggaaaaaaaagatgaatgttattgtagaggaaattttcattctggaaaaaatgcatactatttgaatattattttcatgatttccacagatattacacacagatattatattccaaggattatgtttcaaagtcatcaaaaatagaaaatacatctatatttctaactgaaaataataacagtaagtagcccagctttggggaaatgtaataaaaatattaatgaccatcacaactcattaaaagcataaattgtgcaatgatttaaactacatgttcttcatatgaatgtgtgtagaaatatagacacattggataaatgctatttaaagtctgagtgcgttggtaactgattcagtcatctgtaggttgaagtgattacttttatctgccttcatagtgagaattagatttctattctttgtaaagcagggaatatagattgtgcatggagtaaaagaattcaatccttattaataatgatggtagctgcgctgcagaaaagaaagcctgtcagagtaacttattcagttttacatcataatcagaggtgtgtccatctctgttgaaggcagaattaaaaaccccttcaacatttttaaaataatagatgaaaaacatctcaaagtctcctttaaaatttgaattgacgattccacataaaaggaagggaccaaaaatatcttaaagaaatacttcacgatggaagtgatgttttaagtgaaatttcatcaaggagaagtttttccaaaaagtatttttacctcaggaagaatctcattagtttattctgtaaatagttcctagtaaaatgataaagacttgatttttcaaaaacaataaaaaacttacacggtttaatct

SEQ ID NO: 22305 - DNA, 3105 bp, Homo sapiens
cacataggatgtgactgtgcatatggaatgtctgttgtgttctggacattgtactagacactagagataaaaagtcaaatatcccttgcctctatctgaaaggagcttcctactcagtggattctgactgcagtatatattttctcttctgacctgggagagtgagctctacctcaatgttggtaattgaacactgcccagtggatttgacaggggagaccacaggtagttgtgttcctacatagctatgaccatagtatatctcacgatgccatttccccgttgtcaaaaggctccctccagtatcatacacgctccccatgattatacattcttcttccttccaccaaattttccttaatcttgtaaagataaaaacataaaccacattcttgtcatattaattatatattaatgatgaaaattccttacttttcatgtgtttaatattttctcccaatttatagaatatattggttaatataagaataaattttagccatgcacatctattacaaacttcattttatactttgctatttttaaatttcttatgctcttataaaacatgtgttctggactcacgttggcttccatttcttccctctggcttctattagtttaggctatgagcatagatggaagaggtggctgctgtattggatcaaggatatgagcagagatggatgaggcagcggctgtaatggatcaaggctatgaacatcttgtgaagtaggatgttaagtctgcaaatatcagagtgaatccaaacttatcaattcaacactggattgtaaaacagctcaaaaaaagactaaaaacacagctctacactttaggaggttggggcaggcagattgctcgagctcaggagtgggagacaagtttaggaaacatggaaaaaccctgtctcaaaaaaaaaaaaatttgaattagctgggtatggtggtataagcctgtggttccagcttctcaggaggctgaggtgagaggattgcttgagcctggaaggtgaggctgcagtgagctctgatcacaccactgcattccagcctaggtgatagagtgagaccctgtcttaaaaaaacaaacaaacaaacaaaaaacaaaaacagctctaaacgaatgtggctagaaaagtagctcaagttgttcctgtctggtgaaatacaaacataaatgaattatttatgtgccagtggcttcctgatgctgagagcaaagccagttgttctggcaggttctggaaaaatttatcacctcatggggttcaatgccaatgtcaaatcataaatataataatcaaatctgaaagtgaacccagtttcagagacatccagaagccactgtgtatgaagctcctttcagataaagagaagatattatttgacttcttatctctgttgtctagcacaatgtccagaacacaacagatattccatatgcacagtcacatcctatgtatgtgtgtttcttttccagcaaggactagaggtcctaagctttgtttgtatgacgagccagtgcccaaatgagcaggagggtcttagcacagtcacctacacactcatttcgatgctctgaccccttatcttggctagtcaaagcgtggtctatgagtttgcattttgataggatcccctggtgaatcttgtgcatgtcaaaggaagagaagaactgccctcaaaatatagagcaggtgaactaaattattaacttatagaggtaggctggctatttatttatgtatcttgttgatgggaagattcaaattgatatacataatcacccccataaggatttcaggtaaaaaacaaacaaacaaaggtttagatgttagatatattttacaattaccacaccagtctttttactacagcatctagtaacacatttaccatagatttagatggaaattttcatcccataagcctttgttagtatttttaaaattgaatactcaataaatagtggccaagttgaatctcttagaggaatctcactcaaactacagtcatattttccaataggccccacaaaaatcattgctctagagtaatttaatatatttatccacctctttagacacttaggtaagtataataatacaagttttgtgcgtgtgtgtgtattgtgtaccttgtggcttcttgcccagtttctgcaacacctgaagctgatgcatgtttaatgtaaataatgtccagcaatgttacaaatgttgacttttatgtgcccatcaggaaaaaaaagatgaatgttattgtagaggaaattttcattctggaaaaaatgcatactatttgaatattattttcatgatttccacagatattacacacagatattatattccaaggattatgtttcaaagtcatcaaaaatagaaaatacatctatatttctaactgaaaataataacagtaagtagcccagctttggggaaatgtaataaaaatattaatgaccatcacaactcattaaaagcataaattgtgcaatgatttaaactacatgttcttcatatgaatgtgtgtagaaatatagacacattggataaatgctatttaaagtctgagtgcgttggtaactgattcagtcatctgtaggttgaagtgattacttttatctgccttcatagtgagaattagatttctattctttgtaaagcagggaatatagattgtgcatggagtaaaagaattcaatccttattaataatgatggtagctgcgctgcagaaaagaaagcctgtcagagtaacttattcagttttacatcataatcagaggtgtgtccatctctgttgaaggcagaattaaaaaccccttcaacatttttaaaataatagatgaaaaacatctcaaagtctcctttaaaatttgaattgacgattccacataaaaggaagggaccaaaaatatcttaaagaaatacttcacgatggaagtgatgttttaagtgaaatttcatcaaggagaagtttttccaaaaagtatttttacctcaggaagaatctcattagtttattctgtaaatagttcctagtaaaatgataaagacttgatttttcaaaaacaataaaaaacttacacggtttaatct

SEQ ID NO: 22306 - DNA, 3868 bp, Homo sapiens
tagagaaaagctctcgctatgttacccgggctggtctcgaactcctgggctcaagagatcctctggcctccgcctcccaaagttctgggattacaggtgtgagtccatgtgcccagccctttaattctttacttggggttcaggtgactacatatttcttacttacaaattttacttaatctcgctgatgctgtcacttgaaagctgacccaccttgaatgaagcctcctccaacaagtctggaatccatccgaatttaaattaacaggcgctcctatgaattccatcagagaacacacagtagatgctttagaacctcttcccatgcctccgaagtatctggtttgcattgtggtggccattagtcatccatgggcttctgatgtaaaaaacaaacctgcctcttttgaccctgtgctgtacagcatcagggcagtgattgctggccacatactggacccttgaaacagagggctctgcatccatgtccatgagccttcatgcccatctggccatcaggccttgggaagcagcaccccacagctttggcacagctgcagtgacctccttgcctccgaatggagtcaaatgtgtacacgctgcaattctcatctgcaggaagcactggcctccttcatccttaggctatagtgctgacactggcctccttcatcctcagactgtggtgccggatgtcacccctctgcgaggcccttgggatcgactgagtgaccagcagtgaagttcgtcagccttctgaatggatgccatgatcagatgtgatggagctcagtgggatgctgctgctttccctcccttagctaggatgtccctgataaaggatgacacccaagcctcagcacaactggccaaacttgaggtggtcatcatagcactgatgctgggccaacaattagccccatttgtacctttttacaaactttttgacaattgccaagaatcgtccaccttccctccccattgaattaaatacacttcttgtctcatggatactcagaataccaatcaaggtaacagatgcctttattttaactaaggacacagtacagatctcacagggacactccttatcccttgcagagttccagacactactgatggtcaccaaagcaacatttcatcagaaaacacagtgctgggcttgtgaagaaggtgtccagcagagcttccactgcccctgtaggctgcaggcagctgcttcagttgagagatacactgagctcctcaaagaattcctatttaagtttaggctatgagcatagatggaagaggtggctgctgtattggatcaaggatatgagcagagatggatgaggcagcggctgtaatggatcaaggctatgaacatcttgtgaagtaggatgttaagtctgcaaatatcagagtgaatccaaacttatcaattcaacactggattgtaaaacagctcaaaaaaagactaaaaacacagctctacactttaggaggttggggcaggcagattgctcgagctcaggagtgggagacaagtttaggaaacatggaaaaaccctgtctcaaaaaaaaaaaaatttgaattagctgggtatggtggtataagcctgtggttccagcttctcaggaggctgaggtgagaggattgcttgagcctggaaggtgaggctgcagtgagctctgatcacaccactgcattccagcctaggtgatagagtgagaccctgtcttaaaaaaacaaacaaacaaacaaaaaacaaaaacagctctaaacgaatgtggctagaaaagtagctcaagttgttcctgtctggtgaaatacaaacataaatgaattatttatgtgccagtggcttcctgatgctgagagcaaagccagttgttctggcaggttctggaaaaatttatcacctcatggggttcaatgccaatgtcaaatcataaatataataatcaaatctgaaagtgaacccagtttcagagacatccagaagccactgtgtatgaagctcctttcagataaagagaagatattatttgacttcttatctctgttgtctagcacaatgtccagaacacaacagatattccatatgcacagtcacatcctatgtatgtgtgtttcttttccagcaaggactagaggtcctaagctttgtttgtatgacgagccagtgcccaaatgagcaggagggtcttagcacagtcacctacacactcatttcgatgctctgaccccttatcttggctagtcaaagcgtggtctatgagtttgcattttgataggatcccctggtgaatcttgtgcatgtcaaaggaagagaagaactgccctcaaaatatagagcaggtgaactaaattattaacttatagaggtaggctggctatttatttatgtatcttgttgatgggaagattcaaattgatatacataatcacccccataaggatttcaggtaaaaaacaaacaaacaaaggtttagatgttagatatattttacaattaccacaccagtctttttactacagcatctagtaacacatttaccatagatttagatggaaattttcatcccataagcctttgttagtatttttaaaattgaatactcaataaatagtggccaagttgaatctcttagaggaatctcactcaaactacagtcatattttccaataggccccacaaaaatcattgctctagagtaatttaatatatttatccacctctttagacacttaggtaagtataataatacaagttttgtgcgtgtgtgtgtattgtgtaccttgtggcttcttgcccagtttctgcaacacctgaagctgatgcatgtttaatgtaaataatgtccagcaatgttacaaatgttgacttttatgtgcccatcaggaaaaaaaagatgaatgttattgtagaggaaattttcattctggaaaaaatgcatactatttgaatattattttcatgatttccacagatattacacacagatattatattccaaggattatgtttcaaagtcatcaaaaatagaaaatacatctatatttctaactgaaaataataacagtaagtagcccagctttggggaaatgtaataaaaatattaatgaccatcacaactcattaaaagcataaattgtgcaatgatttaaactacatgttcttcatatgaatgtgtgtagaaatatagacacattggataaatgctatttaaagtctgagtgcgttggtaactgattcagtcatctgtaggttgaagtgattacttttatctgccttcatagtgagaattagatttctattctttgtaaagcagggaatatagattgtgcatggagtaaaagaattcaatccttattaataatgatggtagctgcgctgcagaaaagaaagcctgtcagagtaacttattcagttttacatcataatcagaggtgtgtccatctctgttgaaggcagaattaaaaaccccttcaacatttttaaaataatagatgaaaaacatctcaaagtctcctttaaaatttgaattgacgattccacataaaaggaagggaccaaaaatatcttaaagaaatacttcacgatggaagtgatgttttaagtgaaatttcatcaaggagaagtttttccaaaaagtatttttacctcaggaagaatctcattagtttattctgtaaatagttcctagtaaaatgataaagacttgatttttcaaaaacaataaaaaacttacacggtttaatctaatgttgtgatttcgaaagtgcttcttctgcaatcatagttacgcgtgtgtatttatatgcattttcttagctcattcaaacgccaataaaatactatactatccaggctccttaaaa

SEQ ID NO: 22307 - DNA, 2260 bp, Homo sapiens
tagagaaaagctctcgctatgttacccgggctggtctcgaactcctgggctcaagagatcctctggcctccgcctcccaaagttctgggattacaggtgtgagtccatgtgcccagccctttaattctttacttggggttcaggtgactacatatttcttacttacaaattttacttaatctcgctgatgctgtcacttgaaagctgacccaccttgaatgaagcctcctccaacaagtctggaatccatccgaatttaaattaacaggcgctcctatgaattccatcagagaacacacagtagatgctttagaacctcttcccatgcctccgaagtatctggtttgcattgtggtggccattagtcatccatgggcttctgatgtaaaaaacaaacctgcctcttttgaccctgtgctgtacagcatcagggcagtgattgctggccacatactggacccttgaaacagagggctctgcatccatgtccatgagccttcatgcccatctggccatcaggccttgggaagcagcaccccacagctttggcacagctgcagtgacctccttgcctccgaatggagtcaaatgtgtacacgctgcaattctcatctgcaggaagcactggcctccttcatccttaggctatagtgctgacactggcctccttcatcctcagactgtggtgccggatgtcacccctctgcgaggcccttgggatcgactgagtgaccagcagtgaagttcgtcagccttctgaatggatgccatgatcagatgtgatggagctcagtgggatgctgctgctttccctcccttagctaggatgtccctgataaaggatgacacccaagcctcagcacaactggccaaacttgaggtggtcatcatagcactgatgctgggccaacaattagccccatttgtacctttttacaaactttttgacaattgccaagaatcgtccaccttccctccccattgaattaaatacacttcttgtctcatggatactcagaataccaatcaaggtaacagatgcctttattttaactaaggacacagtacagatctcacagggacactccttatcccttgcagagttccagacactactgatggtcaccaaagcaacatttcatcagaaaacacagtgctgggcttgtgaagaaggtgtccagcagagcttccactgcccctgtaggctgcaggcagctgcttcagttgagagatacactgagctcctcaaagaattcctatttaaggtacaaagcagcgactggatgccctgctggattccactattgccacaggctttgataactctaagttcatgctccttaggaaagtgcactttttacaccaatgttagacagttccctcagttgcctttactggacatcaaggagttcacatttttgacaatctttcagtcctgaactgtccaaggggtggaggtagctccatacaggaagctgcctgctgcgtgtggatcagtaatatcagacttgcccaacagctcactggagacatcaaaaccaatgcatgggggatgcatgacgtcacccaaatatttaccacacgcttttgctgccagagaccccagatcacttttcctgcctcctgctaaacaaatgggagcagtagcttctcatcagcctccacatttcattactcataattgtggccttcctaatgtctcatgcccctaagcacttattacaatgtctcaacagccttctctcagcctctcaaaatattagtcatcattaaaataaatgtctgatgttaaagcatcagggtcaattgtactgtgacacctaaaatttcatgctgcatcccaccaggtcctcagcctaatggctttcatgcccccaacagactgctaaactctttgaattagtcaagcatatccctcaagggacaaggggttaccccaccctctgatttctaccaagcctgcctcccgcaccctgtgctccagagtgaacccccgggtagacctgcacagatgcagtgtcatcccctgttgggctgagtatgcgagatgaataaattacggtgaatttcgtctaaaaaaaaaaaaacaacacaaacacaagggggggcgccaaaattcccccggggccaagtaggccgcccgttttggcaggggcctagggggcataacagccgggcgcgtaacgcgggggaagccgggctctggagcctctggggcaggacccgaaagcgggaacggatggacgcggggggggtaacc

SEQ ID NO: 22308 - DNA, 2619 bp, Homo sapiens
tagagaaaagctctcgctatgttacccgggctggtctcgaactcctgggctcaagagatcctctggcctccgcctcccaaagttctgggattacaggtgtgagtccatgtgcccagccctttaattctttacttggggttcaggtgactacatatttcttacttacaaattttacttaatctcgctgatgctgtcacttgaaagctgacccaccttgaatgaagcctcctccaacaagtctggaatccatccgaatttaaattaacaggcgctcctatgaattccatcagagaacacacagtagatgctttagaacctcttcccatgcctccgaagtatctggtttgcattgtggtggccattagtcatccatgggcttctgatgtaaaaaacaaacctgcctcttttgaccctgtgctgtacagcatcagggcagtgattgctggccacatactggacccttgaaacagagggctctgcatccatgtccatgagccttcatgcccatctggccatcaggccttgggaagcagcaccccacagctttggcacagctgcagtgacctccttgcctccgaatggagtcaaatgtgtacacgctgcaattctcatctgcaggaagcactggcctccttcatccttaggctatagtgctgacactggcctccttcatcctcagactgtggtgccggatgtcacccctctgcgaggcccttgggatcgactgagtgaccagcagtgaagttcgtcagccttctgaatggatgccatgatcagatgtgatggagctcagtgggatgctgctgctttccctcccttagctaggatgtccctgataaaggatgacacccaagcctcagcacaactggccaaacttgaggtggtcatcatagcactgatgctgggccaacaattagccccatttgtacctttttacaaactttttgacaattgccaagaatcgtccaccttccctccccattgaattaaatacacttcttgtctcatggatactcagaataccaatcaaggtaacagatgcctttattttaactaaggacacagtacagatctcacagggacactccttatcccttgcagagttccagacactactgatggtcaccaaagcaacatttcatcagaaaacacagtgctgggcttgtgaagaaggtgtccagcagagcttccactgcccctgtaggctgcaggcagctgcttcagttgagagatacactgagctcctcaaagaattcctatttaaggtacaaagcagcgactggatgccctgctggattccactattgccacaggctttgataactctaagttcatgctccttaggaaagtgcactttttacaccaatgttagacagttccctcagttgcctttactggacatcaaggagttcacatttttgacaatctttcagtcctgaactgtccaaggggtggaggtagctccatacaggaagctgcctgctgcgtgtggatcagtaatatcagacttgcccaacagctcactggagacatcaaaaccaatgcatgggggatgcatgacgtcacccaaatatttaccacacgcttttgctgccagagaccccagatcacttttcctgcctcctgctaaacaaatgggagcagtagcttctcatcagcctccacatttcattactcataattgtggccttcctaatgtctcatgcccctaagcacttattacaatgtctcaacagccttctctcagcctctcaaaatattagtcatcattaaaataaatgtctgatgttaaagcatcagggtcaattgtactgtgacacctaaaatttcatgctgcatcccaccaggtcctcagcctaatggctttcatgcccccaacagactgctaaactctttgaattagtcaagcatatccctcaagggacaaggggttaccccaccctctgatttctaccaagcctgcctcccgcaccctgtgctccagagtgaacccccgggtagacctgcacagatgcagtgtcatcccctgttgggctgagtatgcgagatgaataaattacggtgaatttcgtctactcagtgtttgttgtgtctgcagccatcctcagaattctagggcaagactaatttcttcaccaatgacgtgaacaggaaggaacccaactaggaattgccttttttaaaaaatcccttcccaccctcttaattatgtagtgcatgcattttatagcttttttgctcattccattatctgaggtcaggcactgatatttaacccatctttagcctcggaggagggcagaggaacagtggtcatatttatttccctaagtggcaaagacatgatttcctcctgtgccactcaaattcactccttctttaacttgatgctcagtaggttgtgtttcacttgtctatgcagattgttaggaagacgagactcagctttcatttttgatgttgtcatagagaagactctatggtaatgcttattttcacagtcaactttcctcttcttttcccccagacagaaattgcaaactcaggtgagtgacagctttctggagtctgcaaacatagattattttccctcttttgatggcaaatttcttatatccc

SEQ ID NO: 22309 - DNA, 235 bp, Homo sapiens
  misc_feature (224)..(224): n is a, c, g, or t
aatgctttcttaaaaattgctttatgacctcatactctcaggtagcttgcaaggttcctatatacaactctgtgacatatactgactcacgtctttgaagtttagaagtagaggagactgtctgattccattttctcattttatagatgacacagagacccagaaaatttgcatcacttgtctaaaatcatataggccatccaatgtcgacgcggccgcgaatntagtagtagta

SEQ ID NO: 22310 - DNA, 696 bp, Homo sapiens
gaaggttaatccaatatcaaagtttttgtgttagtttaagtgttgttaaatatgacaaagatcttcttttggcatttctgagtatgtgatgtaaattaggtgttgagatgggtcaactgtattacatagtaagaattcgttttctggatattagtggaagatattcccaaatctttagcatgagttgattaaataatatatctgtttgttcatatttactgtaaacacttgaattgcttatggcaagtccacctttaaagagtatgtattaacaaaattggtctttctatgcaataaagcttcaaaatgcaacattttgttgttaccaaggagcattctacggtagtgttgtgtatgatataaagcaaatttatgggaattgtctctgccatatgaaagtttaaaatatattattgaataaatgatgctattttgaaaatagaatgtacttaagtgcattttttaaaagcatatacatattgaaatttgtaaaatattttaaaaatactctgaaaagaaactgcaaaaagtttttggtgaagtaatggaatacagagttcttgtcaatataaaaattgtagacattaatcacttagagtttatatgctttattacctctaatagaaacatgattctttgggatttgtgatactcgatatagtatgtaaaatatttaataaattgctatatcatttg

SEQ ID NO: 22311 - DNA, 382 bp, Homo sapiens
atttcaaatggataaataaactaaaaagtgtttaatactccaaaatgattagaagtgtattgttaaataccaaaaagaaaataattctggggtgtttcaggcatgttattctgttaacgtagttcacgttgagtgtttgtattcatttgttgtttgtttgtttgtaagtaacaggttttgactaaaattccacggactgtggaacaacacacactggggtctatcggagggtggaaagtgggtggagggagtgggtcaggaaaaataactaatgtatactaggcttaatacctgggtgataagatagtctttacaacaaacccccatgacacaagtttacctatataacaaacctgccattgtacacctgaacttaagtaaa

SEQ ID NO: 22312 - DNA, 411 bp, Homo sapiens
gtgtatattggccatgattattattggcttcttggtaatgaaagcatcaaatactaagggcagcttttagtatattatttctgatcttgtgtgatcagaaataccacatttttgagaatgtattattttccaaagaattaaatgactctcagaggggaatggataaacccacagaggttctggaaatggagcagtttcctgtaagtatcatgacttccaattaagcccctttgtctgttttatccctgtcacttgtactcactgtgtagatcatgagctaattttgcttggactctcccctcccgccatctcttagagcccagcagtgctatgcatgcatgggttaaaaatttcaaactgtccaaatgaattgcatttattggcaatttaatgctgaaactcaaagaggga

SEQ ID NO: 22313 - DNA, 475 bp, Homo sapiens
ttccaccttccattcatgtctgtgcccaactactctgtatgtccacttaaggagtgacatttgaaactgtcaaactgttgcctccacgtggtgttggagtgcctgaggaattagatttaaagcagataactaacatgaatatcagaagtgaagatgttgaagaattaagcaagcatagaaatcaagaaaacaaattcacattacagacaaatttaagtgtaagtaaaggagaaccaagacataggcaagaagaaaaatgcacactacacactatgatgggcttcaattcctgaaactggataatctactataacacaaaactcttgaagaaaaagcaatttttttccttgactcagtgttctacataacagcattccttttctatcaagaaaaatatacttccatcactgcaatgaatatgcatgactattttacatagtaagcatgcaataaatacttcttgaattaatgaata

SEQ ID NO: 22314 - DNA, 510 bp, Homo sapiens
agtttaggttgccccaatacccatgcagagaacttggagctaaaaggttccacagcttcaaacctaggcatacttgtgaatgcgtggtggccacccattgattatcccttggtgctggtgcttgtacctgccattgcggggacctgtaggtgggcatgctaggtccagccccacccattatggtccccacccctccagtgcctagcagggagttcagaccactgtaaattacataggtcagccatttcttgaggcaacaagaatcctttggtgaataaaggagtatcaagaatatacccagccacatgagctacagctggctcttacctataagtaccatctactggcttgttggttgaactgcgcagcccaatattaagcctaccaaaagaagtggatagggctatagaagcaaagacaaaagactctacccagtattctctatcacataaggaagaaggaaaagggaaagagaaagagcaagaaaaaacccacaaagtattatagggg

SEQ ID NO: 22315 - DNA, 385 bp, Homo sapiens
gctcctactctcatgagagaaatcaacagttttgataattgctacaaaagtagtaacaatcctcccaaaatgactttagacaaacaagagcaacaaaaccaagatttaacattatcattatgattaacgaaatttatgcaacccataaggctaactctcaggtggaaagaaaattctattgaaaactaacaactctggtctcagttctttttaaaatcggagttaaagagcataattggattgtttgcaactcacttgataaatgctcgaggaggtaaatacctggttcttcatgatgtgtttatttcacagtgcactcctgtatcaaacatctcatgtaccccataaatatatatacctactgtgtacccacaaacatgaaaat

SEQ ID NO: 22316 - DNA, 362 bp, Homo sapiens
agtatcttctcattttagctttttcctagtacttacctacactgaaataattttttgtatacttcaagaatgaaatcagaaggcaattccccaatgcacccagacatagcaacacatagacctcactttggaggaaaaaaaaaaaacttttacactctaggatctatttgctttttacattaaaattcgtttctccaattgctggctataaaataaaataatcttcacagttgtatttattctacctggtttcaagtgcctaaaaagtcattatttttcactgcaaagaactgaaaaaataaacgtatatacctagaatttgacagaacaaagatccaagtgccagtctttttctttttctc

SEQ ID NO: 22317 - DNA, 3506 bp, Homo sapiens
ggcacgagggcccgagaagctggggagcatggaccagaccccgcagcgctggcaccatgacgctcgcccgcttcgtgctagccctgatgttaggggcgctccccgaagtggtcggctttgattctgtcctcaatgattccctccaccacagccaccgccattcgccccctgcgggtccgcactacccctattaccttcccacccagcagcggcccccgacgacgcgtccgccgccgcctctcccgcgcttcccgcgccccccgcgggcgctccctgcccagcgcccgcacgccctccaggccgggcacacgccccggccgcacccctggggctgccccgccggcgagccatgggtcagcgtgacggacttcggcgccccgtgtctgcggtgggcggaggtgccacccttcctggagcggtcgcccccagcgagctgggctcagctgcgaggacagcgccacaacttttgtcggagccccgacggcgcgggcagaccctggtgtttctacggagacgcccgtggcaaggtggactggggctactgcgactgcagacacggatcagtacgacttcgtggcggcaaaaatgagtttgaaggcacagtggaagtatatgcaagtggagtttggggcactgtctgtagcagccactgggatgattctgatgcatcagtcatttgtcaccagctgcagctgggaggaaaaggaatagcaaaacaaaccccgttttctggactgggccttattcccatttattggagcaatgtccgttgccgaggagatgaagaaaatatactgctttgtgaaaaagacatctggcagggtggggtgtgtcctcagaagatggcagctgctgtcacgtgtagcttttcccatggcccaacgttccccatcattcgccttgctggaggcagcagtgtgcatgaaggccgggtggagctctaccatgctggccagtggggaaccgtttgtgatgaccaatgggatgatgccgatgcagaagtgatctgcaggcagctgggcctcagtggcattgccaaagcatggcatcaggcatattttggggaagggtctggcccagttatgttggatgaagtacgctgcactgggaatgagctttcaattgagcagtgtccaaagagctcctggggagagcataactgtggccataaagaagatgctggagtgtcctgtacccctctaacagatggggtcatcagacttgcaggtgggaaaggcagccatgagggtcgcttggaggtatattacagaggccagtggggaactgtctgtgatgatggctggactgagctgaatacatacgtggtttgtcgacaattgggatttaaatatggtaaacaagcatctgccaaccattttgaagaaagcacagggcccatatggttggatgacgtcagctgctcaggaaaggaaaccagatttcttcagtgttccaggcgacagtggggaaggcatgactgcagccaccgcgaagatgttagcattgcctgctaccctggcggcgagggacacaggctctctctgggttttcctgtcagactgatggatggagaaaataagaaagaaggacgagtggaggtttttatcaatggccagtggggaacaatctgtgatgatggatggactgataaggatgcagctgtgatctgtcgtcagcttggctacaagggtcctgccagagcaagaaccatggcttactttggagaaggaaaaggacccatccatgtggataatgtgaagtgcacaggaaatgagaggtccttggctgactgtatcaagcaagatattggaagacacaactgccgccacagtgaagatgcaggagttatttgtgattattttggcaagaaggcctcaggtaacagtaataaagagtccctctcatctgtttgtggcttgagattactgcaccgtcggcagaagcggatcattggtgggaaaaattctttaaggggtggttggccttggcaggtttccctccggctgaagtcatcccatggagatggcaggctcctctgcggggctacgctcctgagtagctgctgggtcctcacagcagcacactgtttcaagaggtatggcaacagcactaggagctatgctgttagggttggagattatcatactctggtaccagaggagtttgaggaagaaattggagttcaacagattgtgattcatcgggagtatcgacccgaccgcagtgattatgacatagccctggttagattacaaggaccagaagagcaatgtgccagattcagcagccatgttttgccagcctgtttaccactctggagagagaggccacagaaaacagcatccaactgttacataacaggatggggtgacacaggacgagcctattcaagaacactacaacaagcagccattcccttacttcctaaaaggttttgtgaagaacgttataagggtcggtttacagggagaatgctttgtgctggaaacctccatgaacacaaacgcgtggacagctgccagggagacagcggaggaccactcatgtgtgaacggcccggagagagctgggtggtgtatggggtgacctcctgggggtatggctgtggagtcaaggattctcctggtgtttataccaaagtctcagcctttgtaccttggataaaaagtgtcaccaaactgtaattcttcatggaaacttcaaagcagcatttaaacaaatggaaaactttgaacccccactattagcactcagcagagatgacaacaaatggcaagatctgtttttgctttgtgttgtggtaaaaaattgtgtaccccctgctgcttttgagaaatttgtgaacattttcagaggcctcagtgtagtggaagtgataatccttaaatgaacattttctaccctaatttcactggagtgacttattctaagcctcatctatcccctacctatttctcaaaatcattctatgctgattttacaaaagatcatttttacatttgaactgagaaccccttttaattgaatcagtggtgtctgaaatcatattaaatacccacatttgacataaatgcggtaccctttactacactcatgagtggcatatttatgcttaggtcttttcaaaagacttgacaagaaatcttcatattctctgtagcctttgtcaagtgaggaaatcagtggttaaagaattccactataaacttttaggcctgaataggagtagtaaagcctcaaggacatctgcctgtcacaatatattctcaaagtgatctgatatttggaaacaagtatccttgttgagtaccaagtgctacagaaaccataagataaaaatactttctacctacagcgtataaactagcaaaatttgaaaggatttctggtaactaaatgccagctggacatacaacctattttatccaacacattaacatatctactatatttgcttttaacaagcacctcatcatagtccacgttccccgaccatgatgtaagag

SEQ ID NO: 22318 - DNA, 1255 bp, Homo sapiens
ctcattttaaactacactaatgccacaacagggattttattttcataactattacatgctcagtaactgttaaatgttgcgatggttatctggaatgccactaatcagatgtttggtctgagtaggacgagcctattcaagaacactacaacaagcagccattcccttacttcctaaaaggttttgtgaagaacgttataagggtcggtttacagggagaatgctttgtgctggaaacctccatgaacacaaacgcgtggacagctgccagggagacagcggaggaccactcatgtgtgaacggcccggagagagctgggtggtgtatggggtgacctcctgggggtatggctgtggagtcaaggattctcctggtgtttataccaaagtctcagcctttgtaccttggataaaaagtgtcaccaaactgtaattcttcatggaaacttcaaagcagcatttaaacaaatggaaaactttgaacccccactattagcactcagcagagatgacaacaaatggcaagatctgtttttgctttgtgttgtggtaaaaaattgtgtaccccctgctgcttttgagaaatttgtgaacattttcagaggcctcagtgtagtggaagtgataatccttaaatgaacattttctaccctaatttcactggagtgacttattctaagcctcatctatcccctacctatttctcaaaatcattctatgctgattttacaaaagatcatttttacatttgaactgagaaccccttttaattgaatcagtggtgtctgaaatcatattaaatacccacatttgacataaatgcggtaccctttactacactcatgagtggcatatttatgcttaggtcttttcaaaagacttgacaagaaatcttcatattctctgtagcctttgtcaagtgaggaaatcagtggttaaagaattccactataaacttttaggcctgaataggagtagtaaagcctcaaggacatctgcctgtcacaatatattctcaaagtgatctgatatttggaaacaagtatccttgttgagtaccaagtgctacagaaaccataagataaaaatactttctacctacagcgtataaactagcaaaatttgaaaggatttctggtaactaaatgccagctggacatacaacctattttatccaacacattaacatatctactatatttgcttttaacaagcacctcatcatagtccacgttccccgaccatgatgtaagag

SEQ ID NO: 22319 - DNA, 3383 bp, Homo sapiens
ggcacgagggcccgagaagctggggagcatggaccagaccccgcagcgctggcaccatgacgctcgcccgcttcgtgctagccctgatgttaggggcgctccccgaagtggtcggctttgattctgtcctcaatgattccctccaccacagccaccgccattcgccccctgcgggtccgcactacccctattaccttcccacccagcagcggcccccgacgacgcgtccgccgccgcctctcccgcgcttcccgcgccccccgcgggcgctccctgcccagcgcccgcacgccctccaggccgggcacacgccccggccgcacccctggggctgccccgccggcgagccatgggtcagcgtgacggacttcggcgccccgtgtctgcggtgggcggaggtgccacccttcctggagcggtcgcccccagcgagctgggctcagctgcgaggacagcgccacaacttttgtcggagccccgacggcgcgggcagaccctggtgtttctacggagacgcccgtggcaaggtggactggggctactgcgactgcagacacggatcagtacgacttcgtggcggcaaaaatgagtttgaaggcacagtggaagtatatgcaagtggagtttggggcactgtctgtagcagccactgggatgattctgatgcatcagtcatttgtcaccagctgcagctgggaggaaaaggaatagcaaaacaaaccccgttttctggactgggccttattcccatttattggagcaatgtccgttgccgaggagatgaagaaaatatactgctttgtgaaaaagacatctggcagggtggggtgtgtcctcagaagatggcagctgctgtcacgtgtagcttttcccatggcccaacgttccccatcattcgccttgctggaggcagcagtgtgcatgaaggccgggtggagctctaccatgctggccagtggggaaccgtttgtgatgaccaatgggatgatgccgatgcagaagtgatctgcaggcagctgggcctcagtggcattgccaaagcatggcatcaggcatattttggggaagggtctggcccagttatgttggatgaagtacgctgcactgggaatgagctttcaattgagcagtgtccaaagagctcctggggagagcataactgtggccataaagaagatgctggagtgtcctgtacccctctaacagatggggtcatcagacttgcaggtgggaaaggcagccatgagggtcgcttggaggtatattacagaggccagtggggaactgtctgtgatgatggctggactgagctgaatacatacgtggtttgtcgacaattgggatttaaatatggtaaacaagcatctgccaaccattttgaagaaagcacagggcccatatggttggatgacgtcagctgctcaggaaaggaaaccagatttcttcagtgttccaggcgacagtggggaaggcatgactgcagccaccgcgaagatgttagcattgcctgctaccctggcggcgagggacacaggctctctctgggttttcctgtcagactgatggatggagaaaataagaaagaaggacgagtggaggtttttatcaatggccagtggggaacaatctgtgatgatggatggactgataaggatgcagctgtgatctgtcgtcagcttggctacaagggtcctgccagagcaagaaccatggcttactttggagaaggaaaaggacccatccatgtggataatgtgaagtgcacaggaaatgagaggtccttggctgactgtatcaagcaagatattggaagacacaactgccgccacagtgaagatgcaggagttatttgtgattattttggcaagaaggcctcaggtaacagtaataaagagtccctctcatctgtttgtggcttgagattactgcaccgtcggcagaagcggatcattggtgggaaaaattctttaaggtatggcaacagcactaggagctatgctgttagggttggagattatcatactctggtaccagaggagtttgaggaagaaattggagttcaacagattgtgattcatcgggagtatcgacccgaccgcagtgattatgacatagccctggttagattacaaggaccagaagagcaatgtgccagattcagcagccatgttttgccagcctgtttaccactctggagagagaggccacagaaaacagcatccaactgttacataacaggatggggtgacacaggacgagcctattcaagaacactacaacaagcagccattcccttacttcctaaaaggttttgtgaagaacgttataagggtcggtttacagggagaatgctttgtgctggaaacctccatgaacacaaacgcgtggacagctgccagggagacagcggaggaccactcatgtgtgaacggcccggagagagctgggtggtgtatggggtgacctcctgggggtatggctgtggagtcaaggattctcctggtgtttataccaaagtctcagcctttgtaccttggataaaaagtgtcaccaaactgtaattcttcatggaaacttcaaagcagcatttaaacaaatggaaaactttgaacccccactattagcactcagcagagatgacaacaaatggcaagatctgtttttgctttgtgttgtggtaaaaaattgtgtaccccctgctgcttttgagaaatttgtgaacattttcagaggcctcagtgtagtggaagtgataatccttaaatgaacattttctaccctaatttcactggagtgacttattctaagcctcatctatcccctacctatttctcaaaatcattctatgctgattttacaaaagatcatttttacatttgaactgagaaccccttttaattgaatcagtggtgtctgaaatcatattaaatacccacatttgacataaatgcggtaccctttactacactcatgagtggcatatttatgcttaggtcttttcaaaagacttgacaagaaatcttcatattctctgtagcctttgtcaagtgaggaaatcagtggttaaagaattccactataaacttttaggcctgaataggagtagtaaagcctcaaggacatctgcctgtcacaatatattctcaaagtgatctgatatttggaaacaagtatccttgttgagtaccaagtgctacagaaaccataagataaaaatactttctacctacagcgtataaactagcaaaatttgaaaggatttctggtaactaaatgccagctggacatacaacctattttatccaacacattaacatatctactatatttgcttttaacaagcacctcatcatagtccacgttccccgaccatgatgtaagag

SEQ ID NO: 22320 - DNA, 3585 bp, Homo sapiens
ttaatcagataagcatttcaccttttttaaaatttaatgccagtttgtacacagcagaggttacttacaaaaatatgtggattagatgagctaaaagcagaacccgtctgtatgctattattttcattttttcttttaaaaatactctcctggtgttaggaaagagatgcatgttgctatgttattaattggtttcaaaggcttgctagcaaatactatatacagtgtaaggttttaaaaattataaatggattgcctcccgtgatattattgtgcttagatgtagtaataataattttgaaaatgctagcctagaatgttagagtcagaaagaatcttcaagcatccagatttttcttttgacacattagaagacaaagccttcgagttacttgcagcttggcatgacttttagctgagcccagactggagtccaagcctcactgaagctcgtgacacacctcttgcacacagccttactttttatgtctgcagtacttggccattttcttctaaatcagtcattggtggtaaaggcacataaagtagttatttaagattgatgaaaagaattccataagtaggcaaaccacgttgtgatctgatgttttgatttccttgaaactgatgtagtcttttgtgtttttcttctttctttctttgtttcttccatattcatctttgttgatttcttccattttttttcaaatccaaatgttttgataaaaagttttgcctacatttgataaacctaatatcgctcattgtacttccagaggaaaaggaatagcaaaacaaaccccgttttctggactgggccttattcccatttattggagcaatgtccgttgccgaggagatgaagaaaatatactgctttgtgaaaaagacatctggcagggtggggtgtgtcctcagaagatggcagctgctgtcacgtgtagcttttcccatggcccaacgttccccatcattcgccttgctggaggcagcagtgtgcatgaaggccgggtggagctctaccatgctggccagtggggaaccgtttgtgatgaccaatgggatgatgccgatgcagaagtgatctgcaggcagctgggcctcagtggcattgccaaagcatggcatcaggcatattttggggaagggtctggcccagttatgttggatgaagtacgctgcactgggaatgagctttcaattgagcagtgtccaaagagctcctggggagagcataactgtggccataaagaagatgctggagtgtcctgtacccctctaacagatggggtcatcagacttgcaggtgggaaaggcagccatgagggtcgcttggaggtatattacagaggccagtggggaactgtctgtgatgatggctggactgagctgaatacatacgtggtttgtcgacaattgggatttaaatatggtaaacaagcatctgccaaccattttgaagaaagcacagggcccatatggttggatgacgtcagctgctcaggaaaggaaaccagatttcttcagtgttccaggcgacagtggggaaggcatgactgcagccaccgcgaagatgttagcattgcctgctaccctggcggcgagggacacaggctctctctgggttttcctgtcagactgatggatggagaaaataagaaagaaggacgagtggaggtttttatcaatggccagtggggaacaatctgtgatgatggatggactgataaggatgcagctgtgatctgtcgtcagcttggctacaagggtcctgccagagcaagaaccatggcttactttggagaaggaaaaggacccatccatgtggataatgtgaagtgcacaggaaatgagaggtccttggctgactgtatcaagcaagatattggaagacacaactgccgccacagtgaagatgcaggagttatttgtgattattttggcaagaaggcctcaggtaacagtaataaagagtccctctcatctgtttgtggcttgagattactgcaccgtcggcagaagcggatcattggtgggaaaaattctttaaggggtggttggccttggcaggtttccctccggctgaagtcatcccatggagatggcaggctcctctgcggggctacgctcctgagtagctgctgggtcctcacagcagcacactgtttcaagaggtatggcaacagcactaggagctatgctgttagggttggagattatcatactctggtaccagaggagtttgaggaagaaattggagttcaacagattgtgattcatcgggagtatcgacccgaccgcagtgattatgacatagccctggttagattacaaggaccagaagagcaatgtgccagattcagcagccatgttttgccagcctgtttaccactctggagagagaggccacagaaaacagcatccaactgttacataacaggatggggtgacacaggacgagcctattcaagaacactacaacaagcagccattcccttacttcctaaaaggttttgtgaagaacgttataagggtcggtttacagggagaatgctttgtgctggaaacctccatgaacacaaacgcgtggacagctgccagggagacagcggaggaccactcatgtgtgaacggcccggagagagctgggtggtgtatggggtgacctcctgggggtatggctgtggagtcaaggattctcctggtgtttataccaaagtctcagcctttgtaccttggataaaaagtgtcaccaaactgtaattcttcatggaaacttcaaagcagcatttaaacaaatggaaaactttgaacccccactattagcactcagcagagatgacaacaaatggcaagatctgtttttgctttgtgttgtggtaaaaaattgtgtaccccctgctgcttttgagaaatttgtgaacattttcagaggcctcagtgtagtggaagtgataatccttaaatgaacattttctaccctaatttcactggagtgacttattctaagcctcatctatcccctacctatttctcaaaatcattctatgctgattttacaaaagatcatttttacatttgaactgagaaccccttttaattgaatcagtggtgtctgaaatcatattaaatacccacatttgacataaatgcggtaccctttactacactcatgagtggcatatttatgcttaggtcttttcaaaagacttgacaagaaatcttcatattctctgtagcctttgtcaagtgaggaaatcagtggttaaagaattccactataaacttttaggcctgaataggagtagtaaagcctcaaggacatctgcctgtcacaatatattctcaaagtgatctgatatttggaaacaagtatccttgttgagtaccaagtgctacagaaaccataagataaaaatactttctacctacagcgtataaactagcaaaatttgaaaggatttctggtaactaaatgccagctggacatacaacctattttatccaacacattaacatatctactatatttgcttttaacaagcacctcatcatagtccacgttccccgaccatgatgtaagag

SEQ ID NO: 22321 - DNA, 2128 bp, Homo sapiens
attttttcctgcttaaacgagagttaaagactatcatgattttttgatgtgccattaaatgtaagtttcttagaaaaagctaaattagaggcaagtgatgtaataaagtagctgtggagtatgggaaagtatagttaataccttttttatttaattttttttgacagtcatgaaacaaatggtttttagcacatgcagatgctaattttaatatgtaaaaattaaggaataaaattgaatacatgttgtgatttattcagatatatgactgactgattcttcacatgattaagaatgttctgtcttcaggggtcctgccagagcaagaaccatggcttactttggagaaggaaaaggacccatccatgtggataatgtgaagtgcacaggaaatgagaggtccttggctgactgtatcaagcaagatattggaagacacaactgccgccacagtgaagatgcaggagttatttgtgattattttggcaagaaggcctcaggtaacagtaataaagagtccctctcatctgtttgtggcttgagattactgcaccgtcggcagaagcggatcattggtgggaaaaattctttaaggggtggttggccttggcaggtttccctccggctgaagtcatcccatggagatggcaggctcctctgcggggctacgctcctgagtagctgctgggtcctcacagcagcacactgtttcaagaggtatggcaacagcactaggagctatgctgttagggttggagattatcatactctggtaccagaggagtttgaggaagaaattggagttcaacagattgtgattcatcgggagtatcgacccgaccgcagtgattatgacatagccctggttagattacaaggaccagaagagcaatgtgccagattcagcagccatgttttgccagcctgtttaccactctggagagagaggccacagaaaacagcatccaactgttacataacaggatggggtgacacaggacgagcctattcaagaacactacaacaagcagccattcccttacttcctaaaaggttttgtgaagaacgttataagggtcggtttacagggagaatgctttgtgctggaaacctccatgaacacaaacgcgtggacagctgccagggagacagcggaggaccactcatgtgtgaacggcccggagagagctgggtggtgtatggggtgacctcctgggggtatggctgtggagtcaaggattctcctggtgtttataccaaagtctcagcctttgtaccttggataaaaagtgtcaccaaactgtaattcttcatggaaacttcaaagcagcatttaaacaaatggaaaactttgaacccccactattagcactcagcagagatgacaacaaatggcaagatctgtttttgctttgtgttgtggtaaaaaattgtgtaccccctgctgcttttgagaaatttgtgaacattttcagaggcctcagtgtagtggaagtgataatccttaaatgaacattttctaccctaatttcactggagtgacttattctaagcctcatctatcccctacctatttctcaaaatcattctatgctgattttacaaaagatcatttttacatttgaactgagaaccccttttaattgaatcagtggtgtctgaaatcatattaaatacccacatttgacataaatgcggtaccctttactacactcatgagtggcatatttatgcttaggtcttttcaaaagacttgacaagaaatcttcatattctctgtagcctttgtcaagtgaggaaatcagtggttaaagaattccactataaacttttaggcctgaataggagtagtaaagcctcaaggacatctgcctgtcacaatatattctcaaagtgatctgatatttggaaacaagtatccttgttgagtaccaagtgctacagaaaccataagataaaaatactttctacctacagcgtataaactagcaaaatttgaaaggatttctggtaactaaatgccagctggacatacaacctattttatccaacacattaacatatctactatatttgcttttaacaagcacctcatcatagtccacgttccccgaccatgatgtaagag

SEQ ID NO: 22322 - DNA, 1079 bp, Homo sapiens
cactgacacttccctgtaactgacttatacctgcaggttttcccaagcccaacctgatacaatccaatcttaaaatatactagtcaaaatgctttcctggcctacacattgaaaagttctaatacatacagcagttataacatatgccaggcactgcattaggcagctttgcacatcactgacaatttgcaaaaggccagtaaatcttatggtagtagcccttgttttcaaatgggggaaaacaggcttgcctcaaagtgagaccagttggtgaaactgattccaaactccagaaaaaatgctgatttttttccccatggttctcctacctaaatgattggtttccctatggctatttctccaagagttaagggatagctgcttaactatgcacctttacagaacattcttagcagtaatgctcaaatttaaaaggcacactcaagatacttccatgtcatggatccttccccaggtcccagtagtataaatatagggaagaggttagcatgaacttacaaattgttttaagtaatcctcttgaatgccagtcattaaaggactttgcccttctacatcaaattacatccttttcacaaatccccatttctgtaataactggtgcaaacctaaaggtgctttatagttttactactttgcagatttgcaatgctgcatataatgcagaagagcattaaaaacttttgtaaaaactcatgattttgataaacttttaaagtagcgtttatatgtaaatagaactacacatggcacacacacttgcacaagggcttcagaaaaacgtgcaatataggtgagaaaaatgtctattgaaactttctcacaggctgcccttataattaaactagtgttggggcaagcaacatctgtttcaagtagatcagggactagcaaacctaaaaggcagcaagcagcctgcagtttgctcaatccttaagaatacatggttcatacaacatgcttttactatgtcttaagtgtgacttttgaaagatacaagtgttctgtgcatatttgtgtaaataaatacataattttccaccttgtaaaaaaaaaaa

SEQ ID NO: 22323 - DNA, 2655 bp, Homo sapiens
ggcacgagggcccgagaagctggggagcatggaccagaccccgcagcgctggcaccatgacgctcgcccgcttcgtgctagccctgatgttaggggcgctccccgaagtggtcggctttgattctgtcctcaatgattccctccaccacagccaccgccattcgccccctgcgggtccgcactacccctattaccttcccacccagcagcggcccccgacgacgcgtccgccgccgcctctcccgcgcttcccgcgccccccgcgggcgctccctgcccagcgcccgcacgccctccaggccgggcacacgccccggccgcacccctggggctgccccgccggcgagccatgggtcagcgtgacggacttcggcgccccgtgtctgcggtgggcggaggtgccacccttcctggagcggtcgcccccagcgagctgggctcagctgcgaggacagcgccacaacttttgtcggagccccgacggcgcgggcagaccctggtgtttctacggagacgcccgtggcaaggtggactggggctactgcgactgcagacacggatcagtacgacttcgtggcggcaaaaatgagtttgaaggcacagtggaagtatatgcaagtggagtttggggcactgtctgtagcagccactgggatgattctgatgcatcagtcatttgtcaccagctgcagctgggaggaaaaggaatagcaaaacaaaccccgttttctggactgggccttattcccatttattggagcaatgtccgttgccgaggagatgaagaaaatatactgctttgtgaaaaagacatctggcagggtggggtgtgtcctcagaagatggcagctgctgtcacgtgtagcttttcccatggcccaacgttccccatcattcgccttgctggaggcagcagtgtgcatgaaggccgggtggagctctaccatgctggccagtggggaaccgtttgtgatgaccaatgggatgatgccgatgcagaagtgatctgcaggcagctgggcctcagtggcattgccaaagcatggcatcaggcatattttggggaagggtctggcccagttatgttggatgaagtacgctgcactgggaatgagctttcaattgagcagtgtccaaagagctcctggggagagcataactgtggccataaagaagatgctggagtgtcctgtacccctctaacagatggggtcatcagacttgcaggtgggaaaggcagccatgagggtcgcttggaggtatattacagaggccagtggggaactgtctgtgatgatggctggactgagctgaatacatacgtggtttgtcgacaattgggatttaaatatggtaaacaagcatctgccaaccattttgaagaaagcacagggcccatatggttggatgacgtcagctgctcaggaaaggaaaccagatttcttcagtgttccaggcgacagtggggaaggcatgactgcagccaccgcgaagatgttagcattgcctgctaccctggcggcgagggacacaggctctctctgggttttcctgtcagactgatggatggagaaaataagaaagaaggacgagtggaggtttttatcaatggccagtggggaacaatctctgatacaatccaatcttaaaatatactagtcaaaatgctttcctggcctacacattgaaaagttctaatacatacagcagttataacatatgccaggcactgcattaggcagctttgcacatcactgacaatttgcaaaaggccagtaaatcttatggtagtagcccttgttttcaaatgggggaaaacaggcttgcctcaaagtgagaccagttggtgaaactgattccaaactccagaaaaaatgctgatttttttccccatggttctcctacctaaatgattggtttccctatggctatttctccaagagttaagggatagctgcttaactatgcacctttacagaacattcttagcagtaatgctcaaatttaaaaggcacactcaagatacttccatgtcatggatccttccccaggtcccagtagtataaatatagggaagaggttagcatgaacttacaaattgttttaagtaatcctcttgaatgccagtcattaaaggactttgcccttctacatcaaattacatccttttcacaaatccccatttctgtaataactggtgcaaacctaaaggtgctttatagttttactactttgcagatttgcaatgctgcatataatgcagaagagcattaaaaacttttgtaaaaactcatgattttgataaacttttaaagtagcgtttatatgtaaatagaactacacatggcacacacacttgcacaagggcttcagaaaaacgtgcaatataggtgagaaaaatgtctattgaaactttctcacaggctgcccttataattaaactagtgttggggcaagcaacatctgtttcaagtagatcagggactagcaaacctaaaaggcagcaagcagcctgcagtttgctcaatccttaagaatacatggttcatacaacatgcttttactatgtcttaagtgtgacttttgaaagatacaagtgttctgtgcatatttgtgtaaataaatacataattttccaccttgtaaaaaaaaaaa

SEQ ID NO: 22324 - DNA, 3624 bp, Homo sapiens
  misc_feature (48)..(48): n is a, c, g, or t
  misc_feature (51)..(51): n is a, c, g, or t
  misc_feature (59)..(59): n is a, c, g, or t
  misc_feature (61)..(61): n is a, c, g, or t
  misc_feature (71)..(71): n is a, c, g, or t
  misc_feature (78)..(78): n is a, c, g, or t
  misc_feature (83)..(83): n is a, c, g, or t
  misc_feature (87)..(87): n is a, c, g, or t
  misc_feature (94)..(95): n is a, c, g, or t
  misc_feature (113)..(113): n is a, c, g, or t
  misc_feature (115)..(119): n is a, c, g, or t
  misc_feature (121)..(121): n is a, c, g, or t
  misc_feature (125)..(125): n is a, c, g, or t
  misc_feature (128)..(128): n is a, c, g, or t
  misc_feature (130)..(131): n is a, c, g, or t
  misc_feature (139)..(139): n is a, c, g, or t
  misc_feature (148)..(148): n is a, c, g, or t
  misc_feature (157)..(159): n is a, c, g, or t
  misc_feature (164)..(164): n is a, c, g, or t
  misc_feature (173)..(174): n is a, c, g, or t
  misc_feature (176)..(176): n is a, c, g, or t
  misc_feature (179)..(179): n is a, c, g, or t
  misc_feature (182)..(182): n is a, c, g, or t
  misc_feature (190)..(190): n is a, c, g, or t
  misc_feature (197)..(197): n is a, c, g, or t
  misc_feature (199)..(199): n is a, c, g, or t
  misc_feature (201)..(202): n is a, c, g, or t
  misc_feature (211)..(211): n is a, c, g, or t
  misc_feature (213)..(213): n is a, c, g, or t
  misc_feature (218)..(218): n is a, c, g, or t
  misc_feature (220)..(222): n is a, c, g, or t
  misc_feature (226)..(227): n is a, c, g, or t
  misc_feature (234)..(235): n is a, c, g, or t
  misc_feature (237)..(238): n is a, c, g, or t
  misc_feature (241)..(244): n is a, c, g, or t
  misc_feature (246)..(249): n is a, c, g, or t
  misc_feature (252)..(253): n is a, c, g, or t
  misc_feature (256)..(261): n is a, c, g, or t
  misc_feature (274)..(274): n is a, c, g, or t
  misc_feature (280)..(280): n is a, c, g, or t
  misc_feature (282)..(282): n is a, c, g, or t
  misc_feature (284)..(284): n is a, c, g, or t
  misc_feature (295)..(296): n is a, c, g, or t
  misc_feature (303)..(304): n is a, c, g, or t
  misc_feature (307)..(307): n is a, c, g, or t
  misc_feature (312)..(314): n is a, c, g, or t
  misc_feature (316)..(318): n is a, c, g, or t
  misc_feature (320)..(321): n is a, c, g, or t
  misc_feature (329)..(329): n is a, c, g, or t
  misc_feature (331)..(333): n is a, c, g, or t
  misc_feature (336)..(336): n is a, c, g, or t
  misc_feature (339)..(339): n is a, c, g, or t
  misc_feature (346)..(347): n is a, c, g, or t
  misc_feature (353)..(353): n is a, c, g, or t
  misc_feature (356)..(357): n is a, c, g, or t
  misc_feature (367)..(367): n is a, c, g, or t
  misc_feature (370)..(370): n is a, c, g, or t
  misc_feature (374)..(374): n is a, c, g, or t
  misc_feature (377)..(378): n is a, c, g, or t
  misc_feature (382)..(382): n is a, c, g, or t
  misc_feature (387)..(387): n is a, c, g, or t
  misc_feature (391)..(393): n is a, c, g, or t
  misc_feature (401)..(401): n is a, c, g, or t
  misc_feature (412)..(412): n is a, c, g, or t
  misc_feature (418)..(418): n is a, c, g, or t
gcaaggcaccagcggcgggaggcaaggttggggaggcgagggcggtcngcntgcagggncnggaaggggcngggggantcganggangcggcannccgcccccgccccctccncnnnnncnctcnaancnngaaaagcnggggagcanggaccaaannncgcancgctggcannangangcncgcacgcntcgtgcnancnntaaagtaangngcgcncnnngaannggtcggnntnnaannnntnnnnaannaannnnnnaaaaaaaacaaangcaaanancnccctgcaggtnngcaaaannccnaaaannntnnnanncaacaacngnnnccnaanaaacgtnngcagcngcnnctaccgcacntanagcncanncaanaggcncacnnngcacaaancaagcaagcanacaaanaagggaacaaacaccggccgcacccctggggctgccccgccggcgagccatgggtcagcgtgacggacttcggcgccccgtgtctgcggtgggcggaggtgccacccttcctggagcggtcgcccccagcgagctgggctcagctgcgaggacagcgccacaacttttgtcggagccccgacggcgcgggcagaccctggtgtttctacggagacgcccgtggcaaggtggactggggctactgcgactgcagacacggatcagtacgacttcgtggcggcaaaaatgagtttgaaggcacagtggaagtatatgcaagtggagtttggggcactgtctgtagcagccactgggatgattctgatgcatcagtcatttgtcaccagctgcagctgggaggaaaaggaatagcaaaacaaaccccgttttctggactgggccttattcccatttattggagcaatgtccgttgccgaggagatgaagaaaatatactgctttgtgaaaaagacatctggcagggtggggtgtgtcctcagaagatggcagctgctgtcacgtgtagcttttcccatggcccaacgttccccatcattcgccttgctggaggcagcagtgtgcatgaaggccgggtggagctctaccatgctggccagtggggaaccgtttgtgatgaccaatgggatgatgccgatgcagaagtgatctgcaggcagctgggcctcagtggcattgccaaagcatggcatcaggcatattttggggaagggtctggcccagttatgttggatgaagtacgctgcactgggaatgagctttcaattgagcagtgtccaaagagctcctggggagagcataactgtggccataaagaagatgctggagtgtcctgtacccctctaacagatggggtcatcagacttgcaggtgggaaaggcagccatgagggtcgcttggaggtatattacagaggccagtggggaactgtctgtgatgatggctggactgagctgaatacatacgtggtttgtcgacaattgggatttaaatatggtaaacaagcatctgccaaccattttgaagaaagcacagggcccatatggttggatgacgtcagctgctcaggaaaggaaaccagatttcttcagtgttccaggcgacagtggggaaggcatgactgcagccaccgcgaagatgttagcattgcctgctaccctggcggcgagggacacaggctctctctgggttttcctgtcagactgatggatggagaaaataagaaagaaggacgagtggaggtttttatcaatggccagtggggaacaatctgtgatgatggatggactgataaggatgcagctgtgatctgtcgtcagcttggctacaagggtcctgccagagcaagaaccatggcttactttggagaaggaaaaggacccatccatgtggataatgtgaagtgcacaggaaatgagaggtccttggctgactgtatcaagcaagatattggaagacacaactgccgccacagtgaagatgcaggagttatttgtgattattttggcaagaaggcctcaggtaacagtaataaagagtccctctcatctgtttgtggcttgagattactgcaccgtcggcagaagcggatcattggtgggaaaaattctttaaggggtggttggccttggcaggtttccctccggctgaagtcatcccatggagatggcaggctcctctgcggggctacgctcctgagtagctgctgggtcctcacagcagcacactgtttcaagaggtatggcaacagcactaggagctatgctgttagggttggagattatcatactctggtaccagaggagtttgaggaagaaattggagttcaacagattgtgattcatcgggagtatcgacccgaccgcagtgattatgacatagccctggttagattacaaggaccagaagagcaatgtgccagattcagcagccatgttttgccagcctgtttaccactctggagagagaggccacagaaaacagcatccaactgttacataacaggatggggtgacacaggacgagcctattcaagaacactacaacaagcagccattcccttacttcctaaaaggttttgtgaagaacgttataagggtcggtttacagggagaatgctttgtgctggaaacctccatgaacacaaacgcgtggacagctgccagggagacagcggaggaccactcatgtgtgaacggcccggagagagctgggtggtgtatggggtgacctcctgggggtatggctgtggagtcaaggattctcctggtgtttataccaaagtctcagcctttgtaccttggataaaaagtgtcaccaaactgtaattcttcatggaaacttcaaagcagcatttaaacaaatggaaaactttgaacccccactattagcactcagcagagatgacaacaaatggcaagatctgtttttgctttgtgttgtggtaaaaaattgtgtaccccctgctgcttttgagaaatttgtgaacattttcagaggcctcagtgtagtggaagtgataatccttaaatgaacattttctaccctaatttcactggagtgacttattctaagcctcatctatcccctacctatttctcaaaatcattctatgctgattttacaaaagatcatttttacatttgaactgagaaccccttttaattgaatcagtggtgtctgaaatcatattaaatacccacatttgacataaatgcggtaccctttactacactcatgagtggcatatttatgcttaggtcttttcaaaagacttgacaagaaatcttcatattctctgtagcctttgtcaagtgaggaaatcagtggttaaagaattccactataaacttttaggcctgaataggagtagtaaagcctcaaggacatctgcctgtcacaatatattctcaaagtgatctgatatttggaaacaagtatccttgttgagtaccaagtgctacagaaaccataagataaaaatactttctacctacagcgtataaactagcaaaatttgaaaggatttctggtaactaaatgccagctggacatacaacctattttatccaacacattaacatatctactatatttgcttttaacaagcacctcatcatagtccacgttccccgaccatgatgtaagag

SEQ ID NO: 22325 - DNA, 2729 bp, Homo sapiens
ggcacgagggcccgagaagctggggagcatggaccagaccccgcagcgctggcaccatgacgctcgcccgcttcgtgctagccctgatgttaggggcgctccccgaagtggtcggctttgattctgtcctcaatgattccctccaccacagccaccgccattcgccccctgcgggtccgcactacccctattaccttcccacccagcagcggcccccgacgacgcgtccgccgccgcctctcccgcgcttcccgcgccccccgcgggcgctccctgcccagcgcccgcacgccctccaggccgggcacacgccccggccgcacccctggggctgccccgccggcgagccatgggtcagcgtgacggacttcggcgccccgtgtctgcggtgggcggaggtgccacccttcctggagcggtcgcccccagcgagctgggctcagctgcgaggacagcgccacaacttttgtcggagccccgacggcgcgggcagaccctggtgtttctacggagacgcccgtggcaaggtggactggggctactgcgactgcagacacggatcagtacgacttcgtggcggcaaaaatgagtttgaaggcacagtggaagtatatgcaagtggagtttggggcactgtctgtagcagccactgggatgattctgatgcatcagtcatttgtcaccagctgcagctgggaggaaaaggaatagcaaaacaaaccccgttttctggactgggccttattcccatttattggagcaatgtccgttgccgaggagatgaagaaaatatactgctttgtgaaaaagacatctggcagggtggggtgtgtcctcagaagatggcagctgctgtcacgtgtagcttttcccatggcccaacgttccccatcattcgccttgctggaggcagcagtgtgcatgaaggccgggtggagctctaccatgctggccagtggggaaccgtttgtgatgaccaatgggatgatgccgatgcagaagtgatctgcaggcagctgggcctcagtggcattgccaaagcatggcatcaggcatattttggggaagggtctggcccagttatgttggatgaagtacgctgcactgggaatgagctttcaattgagcagtgtccaaagagctcctggggagagcataactgtggccataaagaagatgctggagtgtcctgtacccctctaacagatggggtcatcagacttgcaggtgggaaaggcagccatgagggtcgcttggaggtatattacagaggccagtggggaactgtctgtgatgatggctggactgagctgaatacatacgtggtttgtcgacaattgggatttaaatatggtaaacaagcatctgccaaccattttgaagaaagcacagggcccatatggttggatgacgtcagctgctcaggaaaggaaaccagatttcttcagtgttccaggcgacagtggggaaggcatgactgcagccaccgcgaagatgttagcattgcctgctaccctggcggcgagggacacaggctctctctgggttttcctgtcagactgatggatggagaaaataagaaagaaggacgagtggaggtttttatcaatggccagtggggaacaatctgtgatgatggatggactgataaggatgcagctgtgatctgtcgtcagcttggctacaacattatttgcaatagccaagatgtggaaacagcctaaatgaatggatgaagaaaatgtgaggctttcaaactttggaggaatgcactgcggtaggatttggagtgagtgcaagatatgctttttgtgaagtgagagaagagaaattttgaaagagaagtttgatcttgatagcagcaagattatttttaagaaataatatatgtgaaatttgaggatataaaaattgattcacttacagcctgtgtatcccttggaaagttattatctaccaggagcacttgacatccagtttaaagactaattatcagaaagtgttgtgtcattgaaattttcagctatgaattactagattcagtaaaccagtgagaagcctttcccttttttctatggatggcagagtccttaattgtttaaagaaagagtagtcaaaagaaaatgtattagatttcactatatcaatgagaatttaatcatgtgctgttatttgttaaaatgttctctaatttctacttattgatatatctaaaatggtgcttttttttagtttgtgcaagttgatcagttgctaagaaatgatccttttggtttctttaagtgagttaaattttactttctgtatgtctacttctacctgccatctacttttatgttatttatcatgctttattttctgttttttgtgtaatcatctgttttttgattttcatgattaattcaattttcaattttcatcttttctcagtggtctagaaattcaacattcttattgtttttctggaagttctctttaaatttttagcaaacatactgaaacatactttcttaataatttcaaaaattattatctgtaacttccccttcctgaaaaagataaagacatttaacatattgttgtttactttctacctccacccattctcacctctgaaacttctgggaatcatctggaatttttgtttccaaattctattaattttttattgtcttcaaattatgccgatttgaatttcaaatttctttacattatacctatacattatc

SEQ ID NO: 22326 - DNA, 542 bp, Homo sapiens
ttggcggtggtcacagactttatgctcagggagaaacttattatcctgaattaggttggtagccatctgccagctcaactatttttggtaccagaacttagtgatgccatctctttaatgaccaaaagtcaccatgtctctactatcttgcctttgtgaggctctgcttacattgggcgggggttgccatgctaacctgaaaactcttgggcatttctgcatatcctaatatcatggatggttggactgaaagaaggaggaattaaaatatttaatttatatataagatacagtgtagtatagatgtatgtgtgtgtatgtctatgtgtatgtatgtatatatgtttgcacacatatataaatgtgtgcgtctgtgtatagactgtgtataccaaatccaaaatctcaaatgcttcaaattccaaaactttttgagtgtgaatatgatgctcaaaggaaatgtttattggagcatttcaaattttggatttccagattagagatgctcaactcgtgtaatgcaaatacttcaaaatctgaaa

SEQ ID NO: 22327 - DNA, 196 bp, Homo sapiens
gtaatttacaaagaaaagagatttaattgactaacagttctgcatggctagggaggcctcaggaaacttacaatcatggtggaaggcgcctcttcacaaggcggcagtagagagaatgagtaccaggaaatgtgggacacttataaaaccatcagatctcatgagaactcactcactatcacaagaacaggctagg

SEQ ID NO: 22328 - DNA, 1404 bp, Homo sapiens
gtctccctgagtcttggcccaagagctgtctgagaaaccagggagaaaccctcgtcatgggccccgtccctcttcatttttcatcccggaatccccgtcccagaactggactccctgcctcccactccttacctatttccctgaactcttctagaaaaaaactcaccccagggagcttggtgacagagagggagctcgccgccagagagggagctcgccctgggaatggaggcgtagagacaggtttttgttttttttttctttaaatccggaaaagttgtgcctgagtacatgagacagcatagagacaagttttctctttattaactacagtgggtagcagaatcttggcaacccctaaatgatcaggaatctaatcggtaaaaaatgtaactttggccccttgatctataaatgtgtctgaaagcattacaacaggactcacaaagctactaagtttgactttcccagacaatgtatctgtgactcccgcttgttttttacatttaccttcattccacagccctgagttactgggtgagtccaagacatctcctcaatataaagtagcacactgcgttactatatgttgcaaccgggagccagtacagactttattcacctcacagttgcaagtgttcaatgcagtcacaatgcccctcagcagtgctcatgtgctgcctgtttttaggaagtattcacgtctaagtggtgtgtatatcttataggaatacttagtatttttaaaacctgattaattaaaaaaaattagtttctaggcagtcccaaatatagtattaaaggccaactgcaaagaaggaacactaagtattttttaaaccttattaacataaaaaaacattagtttttaggcagtcctacattaggtattaaaggccaactgcaaagaacactgagcgaggctctgtagatggatgtaataaaaatctataaaacaatgtgtttaaacctaagaattctactgctttccaattccttccctctgctccttttcctaacctcctgcttctccagcccttccctctgtccctttcacccctcaggccctcctctccccttagtccccaccaccctgtcacttctaaattgtggctctagcattgtcccattacctgctatgtgactgttctctccacagtggtcctgctcctgtgagtcagagtgtgtcatttcctcacctaaaacactccagtggctccacctcggtcttgtgaagcttctagaatgtcaggcacgtgagcatatgagggcatacctggttcatcttaggcactaaattaatttttgttgactgaatgaatgaaatatgaatgtattaaattgcatcacagaaagttataaaatgtaaaacactgaaaaattaagaaatattttatcttatgt

SEQ ID NO: 22329 - DNA, 524 bp, Homo sapiens
gtctccctgagtcttggcccaagagctgtctgagaaaccagggagaaaccctcgtcatgggccccgtccctcttcatttttcatcccggaatccccgtcccagaactggactccctgcctcccactccttacctatttccctgaactcttctagaaaaaaactcaccccagggagcttggtgacagagagggagctcgccgccagagagggagctcgccctgggaatggaggcgtagagacagtgggtagcagaatcttggcaacccctaaatgatcagtggtcctgctcctgtgagtcagagtgtgtcatttcctcacctaaaacactccagtggctccacctcggtcttgtgaagcttctagaatgtcaggcacgtgagcatatgagggcatacctggttcatcttaggcactaaattaatttttgttgactgaatgaatgaaatatgaatgtattaaattgcatcacagaaagttataaaatgtaaaacactgaaaaattaagaaatattttatcttatgt

SEQ ID NO: 22330 - DNA, 342 bp, Homo sapiens
ctcccatgtcccaggtgacatccatgctgctggtccaggaaccacactttggtggcaagaatgtgagtcattgtgtgtgttgctatcattagtcttcctggtattggacttgagaccttcttagtcatctttgtatctccaacacttataaggtgaccaacgtcaagttgagttaacacatagttacagaataaatacatctttacagaataaatacatcttagcctttctttctctaaaaaacggtgagagcaactctctcaggtatggatgggataatatccaaaagtatccacgcttcttcagggttgaaagaagaccttcgaaagaaaatctaaagaa

SEQ ID NO: 22331 - DNA, 1176 bp, Homo sapiens
  misc_feature (273)..(273): n is a, c, g, or t
gacaaagaagtgtcaggacagtttgccaagaatgttgtttcttcttgtacaacacaaagcaaggaaacctctgtattttatggctttgaggttttaaaaaatgttctgcagtttgattgatatggcttttaaattcagtgaatcactttcatgaatactgaagtaggtataatcttcagaactagtaatcattatagttacagataggattccatcgcatgtcctgctcaaatgaagacctgttctcattaatcaatactgcatgaaaatatnactggctcacactaaaattaggagcatcaggtgtccagagttttcctgttggggttcagatataaaatctaagtttctattgaggttaataagctggaagcatttgtttcctttaagccttggagaggtcattttcttactcattgatagcttatgtctactgaatgcaatattcttttctgttcagggattttggctgcattatgatttggttatgacataactcagttaaggaatatatttactaatttccaatgtagtctatgaggttcatttaatgtttttaaattttctatgtgtgtggctagaaggcatttgtagatatgcaaatatttgttataatcctgatcccttttataatttgagttattttcttgccctgggggtttacaaggacacgagtgcaacactctttatatggagaagacaggaaatagaccttgagctctaaacctttgcctgaccccctcttctgtgggcctgtgtttctggacaatggggaggtttacagccagtatgagcagagcagactgggagcacctcaatcctcatgcttatattagaaaatgccttagcaatgttgatgggctccttgtagcactggagcatggggagggaacaagctcactgatgtcatttatgcctattgtcttcagtaacttagaacttattatggtatattaaatcaataaaatgttggtgatgaaaaatgtgttttgtaaccataaggctgaaagggacttccaggaatatccaatctatttctctcactttttataaagatttgtctaagcaactactctaaacacatatttattatctccatacttaagaatatctacgggaagcatatttgaaaagcatcattggaaatccacctcaatactagtgataggcctggag

SEQ ID NO: 22332 - DNA, 205 bp, Homo sapiens
ttttttggctgcaaggcaaactgaaaggatatagctctagaaataaaactgtcaaggtaaataggaatggtatgatatccactcacattgatgagggcaggtcttctttactcagtccactgattcaaatgctaatctcttctagagacatgctcacactctcagaaatgtttcactagctatttggtaaaaatattgtttaaaa

SEQ ID NO: 22333 - DNA, 399 bp, Homo sapiens
ggaagagtaccttgctctgtgtccctctgattcaacttcacccctatgtatctccagatgaagggatgaaattgaaaattcatcctcgagcttcaagcacagtcccttttctgatatggctaacagtagtttggataacacaatattgactgtgggttgcgaaattaatgcaacacattagcagttctgaatcagacgagcggtcaaaatggaggaactgaggcaaatttatgtgctggaagactgaaggactacaaacaagaaacaaagaactgtggcaaggtggcaagtattgaaaaatttgggcaatgttaattaatgatgaggaagtaaaaaagtgttgcctgccaaagaaggggatttgaaagtcttgattcattcttggaaatgcgggactac

SEQ ID NO: 22334 - DNA, 1189 bp, Homo sapiens
gggcggaagatggcggcggcgaaaggagctggtgcctgtgcaagttgttgagataatcaccatggccacagccctgaagagagaatcatctatggtgtagagaatagtagcacatttttggaatgcagtccgaagtcgcagagagcgctggtctattggcaattccagaggcgaaatgaagagcgaaaagaagagatcagagtggatgatcatatcatcaggacagatcaaggccttctgctacgtagtctacaacagaaggattcaggcaattacctctgccatgcggtggaacatgggttcatacaaactcttcttaaggtaaccctggaagtcattgacacagagcatttggaagaacttcttcataaagatgatgatggagatggctctaagaccaaagaaatgtccaatagcatgacacctagccagaaggtctggtacagagacttcatgcagctcatcaaccaccccaatctcaacacgatggatgagttctgtgaacaagtttggaaaagggaccgaaaacaacgtcggcaaaggccaggacataccccaggaacagtaacaaatggaagcacttacaagaaaataagaaaggtagaaacaggaggacccacgaatttgagagggcacccaggagtgtctgagctgcattacctctagaaacctcaaacaagtagaaacttgcctagacaataactggaaaaacaaatgcaatatacatgaacttttttcatggcattatgtggatgtttacaatggtgggaaattcagctgagttccaccaattataaattaaatccatgagtaactttcctaataggctttttttcctaataccaccacctaacagagaacacaggtgaatgcagatgttcactttagcagacttaatgtttcctatgagatttcactgtacaggtttgtctttcttctttgcctgagaaataaaaatgtcatttgccatattgccatctaaaggagaaaaactgcatcagcaaagccattgtattgaactaaaagtttaaaatgaactgcatggatttactaagctgatgaatattccaaaacgtggttggattcaaggatatattttgtctaccggccctcatgtttgtatgtacttgaggagtaaaatgagtaaaatgatactgaatgaaatgttctgtggatattaaaaaaaaaa

SEQ ID NO: 22335 - DNA, 1459 bp, Homo sapiens
aaggagacttggtatgatttagaagaggttctgctggaagaaatgacagtttttcgggaaccgactgctatttcagcaatggagctttccactaagcagcaacaactatatattggttcaacggctggggttgcccagctccctttacaccggtgtgatatttacgggaaagcgtgtgctgagtgttgcctcgcccgagacccttactgtgcttgggatggttctgcatgttctcgctattttcccactgcaaagagacgcacaagacgacaagatataagaaatggagacccactgactcactgttcagacttacaccatgataatcaccatggccacagccctgaagagagaatcatctatggtgtagagaatagtagcacatttttggaatgcagtccgaagtcgcagagagcgctggtctattggcaattccagaggcgaaatgaagagcgaaaagaagagatcagagtggatgatcatatcatcaggacagatcaaggccttctgctacgtagtctacaacagaaggattcaggcaattacctctgccatgcggtggaacatgggttcatacaaactcttcttaaggtaaccctggaagtcattgacacagagcatttggaagaacttcttcataaagatgatgatggagatggctctaagaccaaagaaatgtccaatagcatgacacctagccagaaggtctggtacagagacttcatgcagctcatcaaccaccccaatctcaacacgatggatgagttctgtgaacaagtttggaaaagggaccgaaaacaacgtcggcaaaggccaggacataccccaggaacagtaacaaatggaagcacttacaagaaaataagaaaggtagaaacaggaggacccacgaatttgagagggcacccaggagtgtctgagctgcattacctctagaaacctcaaacaagtagaaacttgcctagacaataactggaaaaacaaatgcaatatacatgaacttttttcatggcattatgtggatgtttacaatggtgggaaattcagctgagttccaccaattataaattaaatccatgagtaactttcctaataggctttttttcctaataccaccacctaacagagaacacaggtgaatgcagatgttcactttagcagacttaatgtttcctatgagatttcactgtacaggtttgtctttcttctttgcctgagaaataaaaatgtcatttgccatattgccatctaaaggagaaaaactgcatcagcaaagccattgtattgaactaaaagtttaaaatgaactgcatggatttactaagctgatgaatattccaaaacgtggttggattcaaggatatattttgtctaccggccctcatgtttgtatgtacttgaggagtaaaatgagtaaaatgatactgaatgaaatgttctgtggatattaaaaaaaaaa

SEQ ID NO: 22336 - DNA, 373 bp, Homo sapiens
ctgaaaggaaggcctcaccctggggatggcacctgtctcttctcggttaaacaggcctgtctccctcccttccccaccgccatcctttctggtcttctgagaatgctggcttccctactgcacagtcaagagcaagcaaagcaaaactctttggtctcgagctgctgcactcttctcgaaactaaaccatgatctgctcccaggagagcaggagaaagtaaatgtaaaagattctgtgagaaccctgagatactgtatcagacgatgaggaactggcagtagtacaatgaacggtgtagtgaagcgtctccagccatgaatataggacacaacctagatctgtggataactaaataaaaataaagccccgttc

SEQ ID NO: 22337 - DNA, 435 bp, Homo sapiens
gactttaaaatttttcagtctgcttatattacctattttaaataattttttaaaaagaggctcgaagattattaatagtaagtatggttattttatgatagttgttggatgacaaatgacctttgtacatacacttttcaatttagcaaacttaaacaatttcaactattaacatgttttttaataaatatttcaaattaaatatatctgtttaaaaatctttgacctcagattgtagaataatagcctaaaatgtagttgttgatatgttttgatttaaaattttctggaaattttaaattatgttataaatttaaatccatttggaatcagaagcaggaatatttgttactaagcgaatcttacatacgttttgatatgtaatgatgctttacaaaatggcctttggtctagccttgcatagcttgttttata

SEQ ID NO: 22338 - DNA, 328 bp, Homo sapiens
ggctctgctgcttactacctgttgtgaactctttctgacttagttttgtcatctgtaaagtagggaaaattttagtagtatcgtgaggatgaaaggtaaaggcaaagtacttggatcagggccttccattagtaagtattcaagaaatattaataacattcataaaaataataagcacattcttatgttgcctatgaaatcaggtccttctgcatttggacacaggacaagctggcatggaaactttcaatggttcattcgttcataaaagctcttagtgacttaccaactagtgcaagagacagtattttggaacaaattggcaaaa

SEQ ID NO: 22339 - DNA, 95 bp, Homo sapiens
ttgggaaatatggtaacattagatagtgggattccaaaagtgaggggggatcgcaggctaaaaaacttcctcttggatactatgtccactatctg

SEQ ID NO: 22340 - DNA, 212 bp, Homo sapiens
ctggaaacaagactctggcaagaagggccttctgagcaaggtcagcatctcctcccaacagctctttctcccaacaatgccaggggatctttcaaaattgccactgctgctgctaagctccagaagagaggtttctgaacttcaatgtctttatcatagctcactctctgggttctcagatagatatatatatatcagggttgtcttcatct

SEQ ID NO: 22341 - DNA, 361 bp, Homo sapiens
tttttttttttgagacggagtctcactctgtcacccaggctggagtgcagtggcacgatctcggctcactgcaagctccatctcccgggttcacaccattctcctgcctcagcctcccgagtagctgggactacaggcgcccgccaccacacccggctaattttttgtatttttagtagagacagggtttcaccatgttagccaggatggtctcgatctcctgatcttgtgatccacccaccttggcctcccaaagtgctgggattacaggcgtgagccaccacgcccagcctccatttttttattctcatgcttcatgactgcctaacgcaacataagttatcacaaacagaacactagc

SEQ ID NO: 22342 - DNA, 264 bp, Homo sapiens
taagcatgtgtttccttaacagtgagggagatcggtgccaaatagtgcagaggtggtatggcagacagcacatgtgatcccaggaaaacgctgtgccctcaacccctctagctctgagatgtttggaaaaccgcttgtgaagcttagctgacacttgtggcgtgttccctcaatgtgtttgatttttggagtccaaatggttaaaattgcccagataataagtcgccaaaaatcagctgtgcagagtatgctggtggagggaat

SEQ ID NO: 22343 - DNA, 429 bp, Homo sapiens
acagtttcttcagctatagtcaacatcagcaatgcctgtgtgtgcctcaatggcttaggctgtagagatttgtatggctattccacctacttgggctctgctcctcggggggttgggtgctgggctggtccacgctttggagaagtgaggggctggtaaatcagtggcttgagtcagctcaggctctgctcctcacattaaatcttgaaagatgtgaatttcattacctcttagttacataaagccatatacaaactctttgttgtttgttttaaatcttatctctgacttggttataaatgattgcacttttctactatttctaactacagtatagcagtgctgaaacatctggggggcaaaagaaagttagataggctagtaacaccaaagtaatgctgaaacctggaaggaaagaaaacacattac

SEQ ID NO: 22344 - DNA, 470 bp, Homo sapiens
actggaatgatttctaccaatagaatcctgtatagatattgattcactatggaaactgtggaatcctgtataaatatcgattctttcttctggagcacaatggcagtttaccagcccaaataggcagtaacagctactaagctcccaagatgtcattgtatgctggtggagctaaaccacagcagcattacactgtttctgatgaaatcagactttcattacttctgcatcatatcagaatcatctgatgactcttccaaagcatacatgcttgggccgccattcttggtgaatctgtttcagtagatttgagaatggaacacaacacatgtattttgaaagagctctccaagtgattctcatatacttcgtaattcaggtgaatgcaaaaaaataagtggttagcttatgcacatgctgctaaaagggagaacttaactatattaataacctagagttctgaagagacc

SEQ ID NO: 22345 - DNA, 379 bp, Homo sapiens
ctgtaaactaaaatttattattattacttatggattttgcaggtgggctagattcagacaggcagttatctctcagagtctctcttgattgttcagtaactggtcttaaagtcatctgaagcaaaaagcgaaattggattctactctcagtgggaggaagagcaaacaatgtgctaccttctttaatgtatcataatggtctttccagaaagaaatgctgagcattcaataagagctcagtatgcaggcattgaagaaatacttggttacagacaatgaactcagtgtgagttcacctccaaatgaagatctaaaacacagttcagagactgtctccgtaagggcttttaatacagatattgtatagatgagggcattg

SEQ ID NO: 22346 - DNA, 448 bp, Homo sapiens
caagccagtgacttgagagatctagtgcgtagtttgaccttttgacctggggttttacacgttggcatacttctggggtcttgcttttggggctttgcattacttctctcctgattcttcccttagagtgagctgtccacaggcgcatacttgagcccacttgcccaactcctaagatcttatcgggaagctgctgatcaacagttcaagtgttttctattgggagactgcctttccctggtgccggctgtgaccaactattattttagagagacaattaacaaccacctgaccatcacctgatggctgcctgacattcctgatgtgtgtgtgtatgagggggagccctctcctgccctgctcatgcctgactagctacctactgtaacaccttaaccagattttctttgtcatggcttttcttctcaaatttatctctctttaccta

SEQ ID NO: 22347 - DNA, 384 bp, Homo sapiens
ttaagagatttaaagcagtgcaaaaagagatacagtgaaaagtatttctgtaccctatctactttgtcctctccatgccaaatagataactagtttcttatactgtcttttgttgcttaaccacaggaatgtgtgttctgaggaatgcatccttagatgattttgttgttgtggaccatgatagattgcacttaaacatacctggatggtgcagccggcttgctgtacacataggctaggtgatatagcctgttgctgctaggctacaaacctagacagcatgttgcaaagccagagtacatgttaccatactgagtactgtaggcagttgtaacacaatggtaagtattttgtgtatttaaacatagaaaaagcacaataaaa

SEQ ID NO: 22348 - DNA, 564 bp, Homo sapiens
aagagggtagttgtatctatactgaacatgtagactttttttcttgtcattattccctaaacaatacagtataacaactatctacatagcctttacattgtattataagtaatctagacattaaagtgtatgggaggatgtatgtaggttacatgcaaatacttgtgtcattttatatcagggactggagcatctggggatcttgatatccaagggggtcctggatccacttcccctaagatatgcgaagtaaccgtactttcctctccaccaccacctcagtcccagcactttgggaggccaaggtgggaggattgcttgagctccggagttcgagaccaatctcggcaacatggcgagaccccatctctataaataaaacaaaagtaaatgcattaaatggaaggttgacagtttatcataaacctacaaagatgtttgtaaaattttgttttagtcattttctttgaactcacatcattataccatcttcatttttgtatggagctggttcaattctaagtcctctagactttccctgcctatctttgttgttgttgttgt

SEQ ID NO: 22349 - DNA, 123 bp, Homo sapiens
tgctagagtttcataattacaaattgggatataaaaatagaataattatttgaattttgtatttctctccaggggatcaaaagtaatatataaacttttaataaatattgatatagcttcacg

SEQ ID NO: 22350 - DNA, 2382 bp, Homo sapiens
aaatcagttgtcttagtttaagctactataacaaggtactgtagactgatggcttataagcaacagaaacttatttctcagttctgtagtctggaggtccaagatcaaggtgacactgtggtcaggttctgatgagggccctcttctgggttataaactacggacttcttgtatccttacatggcagaaagagcgacagagctctctgtagtcccttttataagctcactaatcccattcatgagggccctaccctcatgacccaattacctcccaaatgcccctcctccaaacaccaccactttgggggttaagatttcaacagatgaattttgaagggacacaaacattcagtccatagcatcacttatcaagctagtatttaatacctcttaggccccgtggaagggaaaatagataggaacctgccctgaaagatgcttcagttggggagaaaaggtgaaattccattgttagacaatttgtttaagacaatacatcttgcttgagaaggaatagaagggaaatgaaatggggggagggagtggtaggagatggaggctttgaaagaaaataaccagatttagaaacatgggtatagaaagcatcctccagtacttctgtaacaatttatcaagacctacaggaagtcagttttggatttgctcctccgagatttgcgagccagaggaaaatacttagactatcaggttggaaagttcacacttggaccaggaaaagaccaagcagttgctatagtctcctggattgtgactaatctggaggaagcaagtccctgtatccttggcaaagcttgaaaggcaggcaaatgtcttctctgtgttttctgacaggtggttgggtggtgggggttggtctctgtacctcctgttctttaccttgcttaccaagcccttccaccgactcactcctgcctccccagctaaaaattggctgtgttgcttttaccacagttaccaaggtctgagttttataaaatccaggatcacatctgacctcacctggtagatatctaggccaataaagtctaaagggctaaaaagaaggtacctctccatcctgtctcctcgaggccaggcagcacatgtgcagttaagaggcctcctggatccattgtcctcctgttgcttttcgttctaagtgatccaaactctattgctgatagggaataaaagcagggcaggctagtagtgggcaagtgctttgatggagcgtatctccaagcagggcccaagtttaggaggaggaagacctgatacaatgaatgaacagtgcgtcctcccaacccaaccaagaagtgtaattgtgttccgtctttaaccctggcatggaatggggagggaagaggcatggacatttattacatagtgcacattatctacattctctgcatgtgacccagatgtcagcccttccgcttcctgcgaaggttacctctaatgcacgttgccccaggccctgctgagctagttcctcaccgcagctacttaactcaccatgaattcctagaaccctcagcctctgagagtgctgggatctggcgggagaacaggcagtacttccctcactaacctacccgcacgccataccatcattgtgcaaagctgcctcatgctggaaggtctggtttacgtaaaagtgacaagttggaattgagcgtccgactctcgggtacctgccccaggcatttctcatcagccccatttcccacacagctctctcctaggcgcagccctccttcaccaccaccacccccaccccaatcacctttaggtattttctcccctaaagcctcacctgttggcattttacatctttttaagaccttattttgtattttaaatgtatgagaaaaattatggaggatgatgcaagatgagtgagtccataatggtaataattggacactaaaaacaatgaaaacttgtctcaagtatttgtgttgaaatctcaattaactgggcgactgctcccgttccattttattctgtaaaatatgtggcatcctttgtgttgaggcggcatttactaaacacccccaaggtgcaaggctgcaagagaatcgagcgccgcaaggcgagcttatcttccacacctggtacagtgcccaggacagagaaggtgtttagcaagtttctgctgaatggaagagtgagcgagaagggaaagtgcatctaaaaagcacagggaacctacaaaatatttgggaaagggtttcatcagttcgggtgaaatcttgaacgtgcaaagcaccatgggggtggctggacaggcttgttggagtcgtataatgcaatgaataaaaacttacggctgccttaaatgcaaatgtcaagcccttaaataaaatttaacaaagtc

SEQ ID NO: 22351 - DNA, 2328 bp, Homo sapiens
aaatcagttgtcttagtttaagctactataacaaggtactgtagactgatggcttataagcaacagaaacttatttctcagttctgtagtctggaggtccaagatcaaggtgacactgtggtcaggttctgatgagggccctcttctgggttataaactacggacttcttgtatccttacatggcagaaagagcgacagagctctctgtagtcccttttataagctcactaatcccattcatgagggccctaccctcatgacccaattacctcccaaatgcccctcctccaaacaccaccactttgggggttaagatttcaacagatgaattttgaagggacacaaacattcagtccatagcatcacttatcaagctagtatttaatacctcttaggccccgtggaagggaaaatagataggaacctgccctgaaagatgcttcagttggggagaaaaggtgaaattccattgttagacaatttgtttaagacaatacatcttgcttgagaaggaatagaagggaaatgaaatggggggagggagtggtaggagatggaggctttgaaagaaaataaccagatttagaaacatgggtatagaaagcatcctccagtacttctgtaacaatttatcaagacctacaggaagtcagttttggatttgctcctccgagatttgcgagccagaggaaaatacttagactatcaggttggaaagttcacacttggaccaggaaaagaccaagcagttgctatagtctcctggattgtgactaatctggaggaagcaagtccctgtatccttggcaaagcttgaaaggcaggcaaatgtcttctctgtgttttctgacaggtggttgggtggtgggggttggtctctgtacctcctgttctttaccttgcttaccaagcccttccaccgactcactcctgcctccccagctaaaaattggctgtgttgcttttaccacagttaccaaggtctgagttttataaaatccaggatcacatctgacctcacctggtagatatctaggccaataaagtctaaagggctaaaaagaaggtacctctccatcctgtctcctcgaggccaggcagcacatgtgcagttaagaggcctcctggatccattgtcctcctgttgcttttcgttctaagtgatccaaactctattgctgatagggaatcagggcccaagtttaggaggaggaagacctgatacaatgaatgaacagtgcgtcctcccaacccaaccaagaagtgtaattgtgttccgtctttaaccctggcatggaatggggagggaagaggcatggacatttattacatagtgcacattatctacattctctgcatgtgacccagatgtcagcccttccgcttcctgcgaaggttacctctaatgcacgttgccccaggccctgctgagctagttcctcaccgcagctacttaactcaccatgaattcctagaaccctcagcctctgagagtgctgggatctggcgggagaacaggcagtacttccctcactaacctacccgcacgccataccatcattgtgcaaagctgcctcatgctggaaggtctggtttacgtaaaagtgacaagttggaattgagcgtccgactctcgggtacctgccccaggcatttctcatcagccccatttcccacacagctctctcctaggcgcagccctccttcaccaccaccacccccaccccaatcacctttaggtattttctcccctaaagcctcacctgttggcattttacatctttttaagaccttattttgtattttaaatgtatgagaaaaattatggaggatgatgcaagatgagtgagtccataatggtaataattggacactaaaaacaatgaaaacttgtctcaagtatttgtgttgaaatctcaattaactgggcgactgctcccgttccattttattctgtaaaatatgtggcatcctttgtgttgaggcggcatttactaaacacccccaaggtgcaaggctgcaagagaatcgagcgccgcaaggcgagcttatcttccacacctggtacagtgcccaggacagagaaggtgtttagcaagtttctgctgaatggaagagtgagcgagaagggaaagtgcatctaaaaagcacagggaacctacaaaatatttgggaaagggtttcatcagttcgggtgaaatcttgaacgtgcaaagcaccatgggggtggctggacaggcttgttggagtcgtataatgcaatgaataaaaacttacggctgccttaaatgcaaatgtcaagcccttaaataaaatttaacaaagtc

SEQ ID NO: 22352 - DNA, 611 bp, Homo sapiens
tgtgtgtgtgtgtgaatgaatgcttctccatgaccagtgtactcccctgagagcaaccctctctgcctgtcttccacttacagtgactgagtgggagccaattggggaagctgctttctttgagttggcatctttcagtgacctggcggtacctggtccaataaaaagatgtgattttctgaaatccagtatatacctgtatgttttgaggctgtcttcccaaggtgacttgagaatacgtctacacacacagaatattgggatattgttttctaactgcctattgcattgtgttaaattacaaactaattccccagatgatgggataagttatttttttctctgccaagtcacaatattaataatgcagctaaatttagctctgctgtaaaagagtttaattttcaaagccaattagacaatttgatggctgacttgctgcatttgtctctaactactcagttgataccatgttgccaccctaacagattcttgctgatagtcaaaggagagatgagttgtgggaagtataaagcttttcaattaatttatgatcctattaggtgtaaagcctataaattacctgcggttgttgcctctgccaaaaaaga

SEQ ID NO: 22353 - DNA, 511 bp, Homo sapiens
cacaatgttaaacagttgtaagactgccatgttgaggtcactggatagattttacatctacttttggccttttggaaatggaatcttctgttttcatgcaataagctaatttggggataattatatgtgagttatgtcaatatttaaaaaaatcttttgaagttttggttgaatttcttatttggcattggagggtggctcttatttgaagtttagtgtcaggctgcttatcccaaagtaattcttgcaattcttggacccttagtgagatgttcccatcagtaatactttgcattttttggctgatagattaaacttttctcagctcctggagatcctttttctgcttttccttatttttaaataataatttaatgttgttgttttttgatttatctattttaaatattctttactgatttcatataacatggatgaaagttgagcatttttagaccaagctcctgccaccccctcctgactgaccctcctcccaatgtagttctatgac

SEQ ID NO: 22354 - DNA, 479 bp, Homo sapiens
ggtttttctttagtaaaaatcctataaaaatactagtatttttctctgagtttaaaattcaacacatgcctactgatatggttaggctttgtatccccacctaaatctcatcttgaattgtaatccccatagcccccataatccccacatgtcaagggagagaccaggtggaggtaattgaatcatgggggcagtttcccccgtgctcttcttgtgatagtgagttctcacaagatttgatggttttataagggattatttcccctttgctcggcacttctccttcatgctgccttgtgaagaagctgccttgcttcccctttgtcttccgccatgattgtagatttcctgtggcctcccaagctgtactgaactgtgagccaattaaacttctttcctttataaattacccagtcttgggcagttctttatagcagtatgaaaacagacaaatacacctactatataaaacttaaaat

SEQ ID NO: 22355 - DNA, 651 bp, Homo sapiens
gctttgataggtgaaacgcacgttttgaacaactctggtaacaaagaaaaacattaaattgattataggtatgttatatttaaagaccagttgtgaaattagctatattgtgctcaaagtatgttactgacatttctccgtcgttaaaaggaactgctccattctagttttttataatagtctgtattatgtatatagcctgatagtgctgaatttctgaattgaccttcatcttatttactcaataatattcatttgacaaatacttattaagtgcatatatgtgtcaggaactgtactagatgctgaggatatagcagtaagcgcaacagaccaagctaacagcttagtaaagggtgaggtaaaacaaaacaaaaaagtattcaaaaaaataaactaatttttatcttaatttaaaaaattacaaatttttaaaaatcacaaattggtatccatgtataattcatttccgtgcattttcttgtgtgaagaaagctcagtaaaagtatttcttaggtttctgtaattctagttctctactcgattttcttctgcaattttctgagccagaacccttcttagaaggcatattagagactttaaaagttaaataataaaataaatctcttctttaaacagcattgtactacg

SEQ ID NO: 22356 - DNA, 424 bp, Homo sapiens
ccatatcccctactagtctgtaagcatcttcagggcagggatacctctcatctctgtatccccaggctcaagcacagtgcagtaagcagacaataaatatttaactgaaatcaaatgttttattgctggcttgtcttttctaagttggctttaacccttagtctctttcttgcttcacaggaatgagctaatcctaacagtgatactgcctgtcccaggattacaagaaatatcacaaaatataagagagtgtagcataagacatgaaggccaccagaagtgctactatgatttaagattggccgggcagtggtggctcatgcctacaatcccagcactttgggaggccgaggtgggggaaatcaattgaagctaagagttcaagactaggctgggcaacatagaaagacccctgtctctacca

SEQ ID NO: 22357 - DNA, 775 bp, Homo sapiens
tctaaaacttcactggtcattaacgcttcttttggcaatttgaaaaaaaaaagttacatttaatagactattacacattttcttttgctatgttcaactactaaacttctaattctgttacaaaaggtatcttgaatttttaatgttcctttatgtaaataggataaacttgtacctggacatatctatattattaaccttaagatccctaaataaatgggtttgataaagggttgaatttgggggaatcattaaaattatcaaacctttcgtataaccagatgctcagttttttcagaagtaaatattagatggctttttcatactgtgagatgaggcatttctttttctcctcaagctgatctcagaaacaaatcagtctctcatcagtaaccaagctgtactgtggtaaattatgaagaaggtagatgcgactggtccaatgggcccactgttttgtatattcacacaaggaggcatctttgaaacactatacctatctctttctctaaaaaaaaaaaaaaaaaaaaaaaaaaaacctttccaataaatgttcattctgagtacattaatttttagtgagaaaaagaaacaatcatagagaccccactagagaacctagtgtctgctcagcaaacccatattgagctgtagagcatactttaacagccatctcaaccagctcacccaacgtgtaaattcccttcccatttgggcatagaagttgacagcctagagtgtcaggacggccgagtggtctgaggctccagactca

SEQ ID NO: 22358 - DNA, 250 bp, Homo sapiens
tttttttgagagagtctctgtcgcccaggagtgcagtggtgtgatcttggctcactgcaacgtccacctcccagattcaagtgattcccctgcctcagcctcccaagtagctgggattacaggcttgcaccaccacacccagctaatttttgtatttttagtagagatggggtttcaccatgttgccacagtgcctggcctgaactttctcttttacagccacatgcaaattacctgaactatctggctt

SEQ ID NO: 22359 - DNA, 1154 bp, Homo sapiens
cgcgactcgggcgccggtggcgccatcttactcggttgcgggaggggtcacaggtcagtgccggagcctccgcgagtgaaggaagacgaagtgcgtgacccgaccggctgtggtgttccagtccccactgaccagtaggagcagcagggcgtcggcttgtgaggtggcttttcctcggggcaacccaggaaggccccaagaggacaatggattctggaactcgcccagttggtagctgctgtagcagccccgctgggctctcacgggagtacaaactagtgatgctgggtgctggtggtgtagggaagagtgccatgaccatgcagttcatcagccaccgattcccagaagatcatgatcccaccattgaagatgcttataagatcaggatccgtattgatgatgagcctgccaatctggacattttggatacagctggacaggcagagtttacagccatgcgggaccagtatatgagggcaggagaagggtttatcatctgttactctatcacggatcgtcgaagtttccatgaagttcgtgagtttaaacagcttatttatcgagtccgacgtactgacgatacacctgtggttcttgtgggaaacaagtcagacctcaaacagctaagacaggtcaccaaggaagaaggattggccttggcccgagaattcagctgtcccttttttgagacatctgctgcataccgctactatattgatgatgttttccatgcccttgtacgggagatacgtaggaaagaaaaggaggcagtactggccatggagaaaaaatctaagcccaaaaacagtgtatggaagaggctaaaatcaccattccggaagaagaaagattcagtaacttgaagagaagatgtgaagtgtttatctgtgaactgcagtgctgtatcaaagcagtccagtaacctgcagtactgagtatggtgcttgctctttcacttaactgataagagggacatgcctactaggagtttttaatgatgtggtatttaaagtattgtctcttagttaagtatgatttattaacccagtggagcactgtctgcttttaaattgtcacattagaatttgttctaccaatgttttgggttctgttgcgctattaattaatgtaaatttgtttatacccaggag

SEQ ID NO: 22360 - DNA, 323 bp, Homo sapiens
tgattattgaagaattaatatatataagttacttagtataatgtctggtagataataacaatttaataaatggtaaagttacttttcaggcctaattttttttttcccctaagagatggggtctcggctgagtgcagtggcccacacctgtaataccagcactttgggaggccaaggcaggaggattgtttcaacccaggagttcgagactagcctggacaacattgcaaaatcctatgtctaccaaaaatacaaaaaaattagccagacatggtggcagtcaccactgtgcccagatagcctaatttttttaagaaagacat

SEQ ID NO: 22361 - DNA, 1688 bp, Homo sapiens
cgcgactcgggcgccggtggcgccatcttactcggttgcgggaggggtcacaggtcagtgccggagcctccgcgagtgaaggaagacgaagtgcgtgacccgaccggctgtggtgttccagtccccactgaccagtaggagcagcagggcgtcggcttgtgaggtggcttttcctcggggcaacccaggaaggccccaagaggacaatggattctggaactcgcccagttggtagctgctgtagcagccccgctgggctctcacgggagtacaaactagtgatgctgggtgctggtggtgtagggaagagtgccatgaccatgcagttcatcagccaccgattcccagaagatcatgatcccaccattgaagatgcttataagatcaggatccgtattgatgatgagcctgccaatctggacattttggatacagctggacaggcagagtttacagccatgcgggaccagtatatgagggcaggagaagggtttatcatctgttactctatcacggatcgtcgaagtttccatgaagttcgtgagtttaaacagcttatttatcgagtccgacgtactgacgatacacctgtggttcttgtgggaaacaagtcagacctcaaacagctaagacaggtcaccaaggaagaaggattggccttggcccgagaattcagctgtcccttttttgagacatctgctgcataccgctactatattgatgatgttttccatgcccttgtacgggagatacgtaggaaagaaaaggaggcagtactggccatggagaaaaaatctaagcccaaaaacagtgtatggaagaggctaaaatcaccattccggaagaagaaagattcagtaacttgaagagaagatgtgaagtgtttatctgtgaactgcagtgctgtatcaaagcagtccagtaacctgcagtactgagtatggtgcttgctctttcacttaactgataagagggacatgcctactaggagtttttaatgatgtggtatttaaagtattgtctcttagttaagtatgatttattaacccagtggagcactgtctgcttttaaattgtcacattagaatttgttctaccaatgttttgggttctgttgcgctattaattaatgtaaatttgtttatacccaggagaatatgtataccatgtgtgtttgactaagttcacaagggaagtttttggctctgcactccacattatcctttaatttcaatttcctgggactatcccagagaaagacctcagtctcttctattcacactatgcttcctagagacagaacaaaaatcatgtagggaaattggggctaatgagatcagtgccaaatttcagcagatacctgtgaggctgacacctgttgcagactatggagtggtgagatttgggaaagttgggctatatgtttgcagggacttaaaaaggtaggttcagaacagtattctcagtacaagcttcgcttttctaagaagtacacatttggcccaaattcaccgggataagtgagaacagccagaagcataaaatgtgatgaaggtttctcctgggaaccttattttactcttcatttcagggttttctttttttttttaccttcaaaggtagacattttgggaatcataactgtattactaaacgtgtttaatcaaaattcatagttggatcagcca

SEQ ID NO: 22362 - DNA, 601 bp, Homo sapiens
gcctactactactactaaattagcggccgctcgacctgtggttcttgtgggaaacaagtcagacctcaaacagctaagacaggtcaccaaggaagaaggattggccttggcccgagaattcagctgtcccttttttgagacatctgctgcataccgctactatattgatgatgttttccatgcccttgtacgggagatacgtaggaaagaaaaggaggcagtactggccatggagaaaaaatctaagcccaaaaacagtgtatggaagaggctaaaatcaccattccggaagaagaaagattcagtaacttgaagagaagatgtgaagtgtttatctgtgaactgcagtgctgtatcaaagcagtccagtaacctgcagtactgagtatggtgcttgctctttcacttaactgataagagggacatgcctactaggagtttttaatgatgtggtatttaaagtattgtctcttagttaagtatgatttattaacccagtggagcactgtctgcttttaaattgtcacattagaatttgttctaccaatgttttgggttctgttgcgctattaattaatgtaaatttgtttatacccaggag

SEQ ID NO: 22363 - DNA, 329 bp, Homo sapiens
aaaaagtagactagaaatagaatcatatcatttgaaggcagaataagaaaccttagaagtaatctagcctaaaattacaaaaattagtgctgtatgcttgaacacctccagaattgagaagctttctttgtgttaaggtggtggtgcattcaggtttttggacaatttaattgtttttcactgttatcttttctcacattttgcccttaaaggtcaccaaggaagaaggattggccttggcccgagaattcagctgtcccttttttgagacatctgctgcataccgctactatattgatgatgttttccatgcccttgtacgggagata

SEQ ID NO: 22364 - DNA, 395 bp, Homo sapiens
agcctaatttttttaagaaagacatcttctcagaatccttttttagcttagaattgtaggtgaaatcttcagctgtgaataaactacatcatcacctatgtggaaaaaaaaacttcagttgaagactcagtttatgtatctcagtggatttagcatgcttcctgagaaaatgtgggcatttaatgaatttggatacaatgtactactctgtaagatgagttttaaataggcatttcttccggcatttatgactttatagtacacctttcttccctcctgtagaagatgcttataagatcaggatccgtattgatgatgagcctgccaatctggacattttggatacagctggacaggtattaaatcccagaatgttatgagtaaaggctttttta

SEQ ID NO: 22365 - DNA, 1005 bp, Homo sapiens
cgcgactcgggcgccggtggcgccatcttactcggttgcgggaggggtcacaggtcagtgccggagcctccgcgagtgaaggaagacgaagtgcgtgacccgaccggctgtggtgttccagtccccactgaccagtaggagcagcagggcgtcggcttgtgagccatgaccatgcagttcatcagccaccgattcccagaagatcatgatcccaccattgaagatgcttataagatcaggatccgtattgatgatgagcctgccaatctggacattttggatacagctggacaggcagagtttacagccatgcgggaccagtatatgagggcaggagaagggtttatcatctgttactctatcacggatcgtcgaagtttccatgaagttcgtgagtttaaacagcttatttatcgagtccgacgtactgacgatacacctgtggttcttgtgggaaacaagtcagacctcaaacagctaagacaggtcaccaaggaagaaggattggccttggcccgagaattcagctgtcccttttttgagacatctgctgcataccgctactatattgatgatgttttccatgcccttgtacgggagatacgtaggaaagaaaaggaggcagtactggccatggagaaaaaatctaagcccaaaaacagtgtatggaagaggctaaaatcaccattccggaagaagaaagattcagtaacttgaagagaagatgtgaagtgtttatctgtgaactgcagtgctgtatcaaagcagtccagtaacctgcagtactgagtatggtgcttgctctttcacttaactgataagagggacatgcctactaggagtttttaatgatgtggtatttaaagtattgtctcttagttaagtatgatttattaacccagtggagcactgtctgcttttaaattgtcacattagaatttgttctaccaatgttttgggttctgttgcgctattaattaatgtaaatttgtttatacccaggag

SEQ ID NO: 22366 - DNA, 395 bp, Homo sapiens
ataccatcttaatttaaataaagagttgtgtgggattgcaagttaagttatttcaaaaacggtgacccttggcaaggtactcatctctatgaatcaggattttctctatagcaggcaacaaaaagaaaatgcgttaaataaatcggaagctggaacatgtgtgactgcaacagtcatccataattccagaattcaagtttttatatttatcaaaatcttactcactgtctttgaattctcattcactgtctttgaactctcattcactgactttgaactacataattgctataaatttgaacttataaaataagtgtagcaatacaacacaacttttttcttgtttatatagcagaactctaagatttttttgggaaaggaatgattctatagtt

SEQ ID NO: 22367 - DNA, 532 bp, Homo sapiens
ggaagactccatctcaaaaataataacaggcaaggtagtggtgaatttgggaagaagggagtaactgggtggggagctcgctggggacttccaggatgtcctatttcttgatctcattatttgggaggacttttaaggtgggaacctattatttctcctcttttgtgtatgtatgttaggtgtcaacaaaaagcttttttagaataatcatcatcataaaccatccttcacaatatcctattgtctgatctctgtctggaaatgtgagacaggctccgagggagagaaggctggggctgggccccccattttgactgcagtgccatctcagggaagggcaatgaggcctgagttaaggacagcctgccccctaggctggccccttggggaggatgcaggctgcttccaggaggtgccctatgccacccctcagagccatgcctgagttctgctgccagcccctccggcaggaggttggccttgactccacacttctcgggcttccgcgttctcctctcttgtcagccctgcg

SEQ ID NO: 22368 - DNA, 3516 bp, Homo sapiens
aaaaacttattagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaa

SEQ ID NO: 22369 - DNA, 3450 bp, Homo sapiens
aaaaacttattagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaa

SEQ ID NO: 22370 - DNA, 396 bp, Homo sapiens
aaaaacttattagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcaagcaagcctttgaaaaccctttaa

SEQ ID NO: 22371 - DNA, 1875 bp, Homo sapiens
ttcccaatgtcccaggtgtggccgtccctatcctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaa

SEQ ID NO: 22372 - DNA, 3825 bp, Homo sapiens
aaaaacttattagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgtaagtctctcctctcttacagagcagctgtgctttcgatctggggccacagacgagcaatggtcatgcctgacttggctgtatggaacctctcgctgatgtgaacacctgttcccatgtttagatccaggccgatggcctgtgaattttgttcttctctcattcctattccttcataggatcaccagtgcatgatagaaggtggggagttcacaagaaggggcttttggatgctggcacttgtggagctagccgggaaggttgaagttggacctgtcaaccgtgttgccatttgtgattcttttgtaggttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaa

SEQ ID NO: 22373 - DNA, 1594 bp, Homo sapiens
agattgactaagttctgtatttccagctgattcctgggcgatgttggtgccactggtctgaccaccctttgacaactgctgctccagataattcaagtcggggtataacacaaccagtgagatgtaaaccaaagacgattccacggttagattctcaagaatgacttgttctgccgggcgcggtggctcacgcctgtcatcccagcactctgggaggccgaggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgtaagtctctcctctcttacagagcagctgtgctttcgatctggggccacagacgagcaatggtcatgcctgacttggctgtatggaacctctcgctgatgtgaacacctgttcccatgtttagatccaggccgatggcctgtgaattttgttcttctctcattcctattccttcataggatcaccagtgcatgatagaaggtggggagttcacaagaaggggcttttggatgctggcacttgtggagctagccgggaaggttgaagttggacctgtcaaccgtgttgccatttgtgattcttttgtaggttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaa

SEQ ID NO: 22374 - DNA, 1350 bp, Homo sapiens
gtgggcggatcacaaggtcaggagtctgagaccagcctggccaaaatggtgaaaccccatctctactaaaaatacaaaacttagctgggcatggtggtgtatgcctgtaatcccagctactcggaaggctggggcacaagaatcgcgtgaaaccaggaggcggaggttgaagtgagccaccgtgccagctgagaatccttcttacttctccaacttctgttggccacctgcattccttggcttgtggcccttcctccaacttcagcagagcatcttcaaacgttgccctggctcccttatcacgtcacctcctgctggctttgactctcagctccctcttatgaggatccctgtgattgctggacctacccaaataaaccaggatataaaccatcttaagatgctcagtcacctctacgaggtcccttttgctcgcaggtgccaggagttgggacttggacatctttaggggaggccattcttctgtccaccacaccaccccatgattccatttccatgtcaccactgtctctaagtgtgtctaacccacggctcaagagtcaaaggtgcatcacagcagtgagaactcacaggttcgggtttgctttcttcctgtggttgatttctaggctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaa

SEQ ID NO: 22375 - DNA, 2844 bp, Homo sapiens
aaaaacttattagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccagaatcccttggggtctagtggagtgaagatgctgtttgaaaccttgacatgttccagtggcaccctccggacactcaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaa

SEQ ID NO: 22376 - DNA, 3115 bp, Homo sapiens
aaaaacttattagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaa

SEQ ID NO: 22377 - DNA, 3340 bp, Homo sapiens
aaaaacttattagagctttctcaacctgcagccctcatctccgccggcgagtagggccaggtgttgggagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagagaagcagctttgaaatcctttaataaaaggaagcctctatcattagggataacacggaaagaacgaccacctctagacgtggacgaaatgctggagcgcttcaaaacagaagcacaagcgtttacagaaacgaaaggaaatgtcatctgcctgggtaaagaagtctttaaaggaaaaaagccagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggttgtaagtccgtgctggctgcctgtgtgcgtgggtgtatatgcacacgccccccacctccgggtttgagtagggtggttatgagaacacttaattcctctaaaagttccaagcatgatgctaatgacaactggtaagacctgggtagatgatggtaggaaaaaagtataagtagtagtagagtagtagtaatattctatagggatttggggaatgtagctggttttcgggtttttttttttttcctctttatgtatgtatgtattttagagatgggatctcgccgtgttgcctaggctggtctcaaactcctgagctcaagagatctgcctgccttggcctcccagggtgctagaattacaggcatgagccatgtcaccccatgctgtgttttctcttaatctgtgttcttagaactataactgtaacataaattgcacgcaattggttgtaaatggaatcatttacttattttttaatgaatgatttgcagtgagctgagatggcaccactgaagtccagtctggccaatagagcaagactctct

SEQ ID NO: 22378 - DNA, 215 bp, Homo sapiens
tgcacaaagtaaccttttcttcccccattgtaccccaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgat

SEQ ID NO: 22379 - DNA, 221 bp, Homo sapiens
tgcatcctctctcccttccctcctcaccaatgataaagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcag

SEQ ID NO: 22380 - DNA, 408 bp, Homo sapiens
tgtctaagaagaataggttctttctcctgtgatgcttcttgggtgttgagttgtctgatggtggtgctaataagtgattacatggtccagctttcaattgtactcatttgtcaggggtatatgcccagagaaaccctaaatacttcagccgtgatggacacacatttggtgtaaccctttcttctcttccctatagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgtaagtagaaactaattcatgaactcaaatccttagggtat

SEQ ID NO: 22381 - DNA, 860 bp, Homo sapiens
tggtaaaagtgactaatggtgcagcaaccatttcttcaccagcccttcctcagctctcctctccactccctcctcctcaggattatagggtccttcttgctgctgtatcaggtctcagctcattagttgtttgaggaaagggcctgccatgccatgttcatcacttcagccacaaaggatggcttttactcagcaatcatgtgctgaacatctgctacattccactcttagcactagtgaaacaaacgcgtagaaccagagccccaggcctcaaagctcacaatggaggtaactggtttccaggttaagtgcactaaactgtgtggaaggtgttatgatagtacctctacaggttctgatggaagcatcagtgatggatttggcttttccatttgggagaggaggctataaaaaaccttcctggaggacgtgggctcattctgattcacagacaggtccagccccttcacttcttactttgaactactccatctggaatcatagaaactcattagcagctaagtgagtcgtagaccctgttcctacagtttcaacaaaccctgatggtggcatttcagtttatcgtagaggtttcttttcccctacaagggtcattctctcttgcccaattttggctgagaagggaggaatatcatggccgttttggctgtatggtgttactgtataatgatatggggattggtgagtgaaaaataaaatgaaccctcacttgcttaggtaccagttttatgtaagaagaaactcacagcttttgcacattatttgagatttgcttcttctgtttaacatatttgtggtactttcctaaaaagttttgttatagacagctgtagagatta

SEQ ID NO: 22382 - DNA, 790 bp, Homo sapiens
gcagaatggtttctttgcctcagctctgcccagtaccagtgaccatcctttagaataatcttagaatacaggagatgaaggggacaagcatcaaaagttcttccttcctcatccccattttccagatgggaaaaccaggctcagagatattaactgtcttggaaaatgagtaaaatatagagaaaacaaaactcttaccttgtgcaggttcaagttcaaatccagtaaataccatagtttaaagcatccctttacacaatggatttggttattttgcaaaacagatattagccccatgtgtcagtaatctacagtcatttgtaccttaacataaaatgccaaagcacagtaatatattcttagtgtaaaaaaaaaaaaaaaattcaaggctgggggtggtggctcacacctgtaatcccagcattttgggaggccgaggtgggaggatcacttgagctcaggagttcaagaccagcctgggcaacatagtgagacctagtctcttaaaaaaattaaccatatgattatgtttaaaaggaatagccccttgcttactgttcctctaaattccactccccagaggcatctattgttcacagtttttggttctgctatccttattttgaatgcacaggtattctcattgataactacctttatccatattagtctccttgcttcctggaagcaacacacagaaatctgtattccagcctttgtttatgctctttcctctgctaacgcacccgctccttcttctctgcctatacgaagagtttccattctttaa

SEQ ID NO: 22383 - DNA, 274 bp, Homo sapiens
taagatgctactactttattttaaatgtgaaagtccaggttgtagaggcaaagatgcaaaggaagtgaaacaaggaagataggaagacgcagggttggccatgagatgcatttctgcttggtcctagcagtaaaccaagctatgaagaaacacagccggtggccctcaggcttgtttacttggcacatagatttcctataggatagtaaggaagagctgccctttagggtagtcataaagaaagagaaagggagggaactttatttgtgtttcc

SEQ ID NO: 22384 - DNA, 1110 bp, Homo sapiens
ttttttctatacaaatttgttacatgtcagtgagacctttttcaaaggaacatattcaatttggctttttgtggctgaaaaaacataactgttagacccaaagcattttatgctccgttccatcttaaggagccatccttaagtctgctcccaccctcagtagaatttattttctacaaagtggtagtaatttttttttaaattgcaaatgtaatttttgccaattagagaaaccaaccggtgtcagtaaaattctgtgagaaatgccatccctgctgggaatgttgaagttacttaatgttgatctatcccttggggaaagtaaaagtgactgtgagtggtgccattgtgtgatgtcagcatgacgttgttttgaatgtggcattatgttctggtgctcatgtttcctggattgtattatctgctttcctttaccaaggcagacagaactgctgccttagcctgacaaccggttgtcctcaaagcaaatgaacttaagcatttgggattgagggacagaaggattctgagggggctctgcgagggacggtgtgtgacatgtcatgcctggagaaggaacaaggctatttgaaaacagaaggcaggtcaagggtagaagttaaaggagaatctgaaggcaggtcagggaaaagaagaactggaaatgaaacagaggacaggtgacaaccacctcgaagagctcccagagattgtagaaagagtccagtgtaaccagcttagtaaccagagtatctggattacccaggaaggttgagctgctgagatttcagtggtgcaatgtctttaaaaaaacaggctttgttgggagggtatttccattttgaactttgaggactgttggtcagaaaatgggctcaaaagtgagtttgcttaatgaagacatttaacggttgtgctgtttatagtaaaataaaactccctaccttgcttcagttaaaaatgaagcacttggtttcttccatcctcctcctccccttaatggattgtggcagttgaaataatccatcggatgacccacctgtagtgagatgtactgtcgatgtagtgcccggtgtatctcagtggccatctgccatggtgaggtgagcg

SEQ ID NO: 22385 - DNA, 771 bp, Homo sapiens
atctgaagcatccgcagttggtcttttctcttcctttttctccttgtttttcacctcaataacctgaaaaaacaaaaacaaagaaaaaaggtgtttggggaattagtgtccaatgtgaagtaagctgagaatggaggtgttgacagggtgggacctccgagagggggtggtgatgatggagatgggtcagacccgggggaggtggcgggggaccctgggactggtgatttagtgggaagaggcagccttcacacagaatccgcaggcctctggtgtggttggtttcagttccctttatgttcacagacccccacccccacacaacagatttcctgacatttaatatttgttttggcttttttggactgtggggtctccttgtatcagtccaatgtggagtcgccccaggatggaagtgcccttctggtaaaatcacacgttcaatctgaggaactggcttgtgattttaaaaggccgctaggacttgggatgtggcctgactctctttggacagtgcacggaagtgaagggatggatgtaacattggcaccaggtttagacattggcttcatggagaatttactccatgggaattttgaaacttgaaacctgtcactttttgtgcacaggcagctgtagggtcttaactcaggggactttggagtgtttgctagggtcattcctctgccccatgctgtggctgaccccatgatctcaaccttgtatttattccattggtttatctccagcttctagaatgaagacctttac

SEQ ID NO: 22386 - DNA, 922 bp, Homo sapiens
  misc_feature (636)..(636): n is a, c, g, or t
  misc_feature (806)..(806): n is a, c, g, or t
  misc_feature (859)..(859): n is a, c, g, or t
  misc_feature (877)..(877): n is a, c, g, or t
  misc_feature (889)..(889): n is a, c, g, or t
atctgaagcatccgcagttggtcttttctcttcctttttctccttgtttttcacctcaataacctgaaaaaacaaaaacaaagaaaaaaggtgtttggggaattagtgtccaatgtgaagtaagctgagaatggaggtgttgacagggtgggacctccgagagggggtggtgatgatggagatgggtcagacccgggggaggtggcgggggaccctgggactggtgatttagtgggaagaggcagccttcacacagaatccgcaggcctctggtgtggttggtttcagttccctttatgttcacagacccccacccccacacaacagatttcctgacatttaatatttgttttggcttttttggactgtggggtctccttgtatcagtccaatgtggagtcgccccaggatggaagtgcccttctggtaaaatcacacgttcaatctgaggaactggcttgtgattttaaaaggccgctaggacttgggatgtggcctgactctctttggacagtgcacggaagtgaagggatggatgtaacattggcaccaggtttagacattggcttcatggagaatttactccatggggttaggtctgggcttcaatctacttctcccgccgcaggaaaaaanaggcgggagaagtcccggcagaattgaagctgcttctttgaatttgcaattcaacatgatattcaccacggaactggcaaaaagagggcttaacctctgtctttagatttacagtctaatgcttactcagccattttacctatgttcgtaaatcgttgactatactcaanaaaccacaaagacatcggcaccctgtacctactatttggtgcctgagcaggantaggggcactgcttgagnctactaattcgngctgactaggtcagccgggaaccttattgggat

SEQ ID NO: 22387 - DNA, 634 bp, Homo sapiens
  misc_feature (348)..(348): n is a, c, g, or t
  misc_feature (518)..(518): n is a, c, g, or t
  misc_feature (571)..(571): n is a, c, g, or t
  misc_feature (589)..(589): n is a, c, g, or t
  misc_feature (601)..(601): n is a, c, g, or t
cactcagattattcttgagtatcattgtcatcacgactatcagctgaagatttaatatttgttttggcttttttggactgtggggtctccttgtatcagtccaatgtggagtcgccccaggatggaagtgcccttctggtaaaatcacacgttcaatctgaggaactggcttgtgattttaaaaggccgctaggacttgggatgtggcctgactctctttggacagtgcacggaagtgaagggatggatgtaacattggcaccaggtttagacattggcttcatggagaatttactccatggggttaggtctgggcttcaatctacttctcccgccgcaggaaaaaanaggcgggagaagtcccggcagaattgaagctgcttctttgaatttgcaattcaacatgatattcaccacggaactggcaaaaagagggcttaacctctgtctttagatttacagtctaatgcttactcagccattttacctatgttcgtaaatcgttgactatactcaanaaaccacaaagacatcggcaccctgtacctactatttggtgcctgagcaggantaggggcactgcttgagnctactaattcgngctgactaggtcagccgggaaccttattgggat

SEQ ID NO: 22388 - DNA, 909 bp, Homo sapiens
agggctggctcttctatgtactcacgctgtgaagaaaaacttaaaaaaaattaaacaaaaaaaccttgtacgaaagcaaaggaagaagacaaatttagcagcagttctcttgaatttcctggctttgttgatttcgaaccacaaggttaacattaaaacacaaagactcacatttaaatatttcttttgaaatcagaaaaacaatagctctttgaaatgacgctggaacgcacacaatagattctactgggtcaatgtattatttatatactcatctgaactttcaaaagaagttaaatgggagatattctcaacaggcaaaaataagatattccaatctattgttcaagtttatggctccgatataaataatgggctataaacccgtatctggaaaacagttgcgcagtgcgtgcttaatggccagccaatgaaaaccaacgtctcattctactccgtctttcagcacgtcaaggacatcccactccgcctttttttttttttctttttaaagaggccaaccgctggggacacctggttttggcacctttatgaggcctcccagcagcacaggagctctaaggggcacgctctgcagttgagctatttgcagagctccatgatcgctcaaagccgagcacgcgcacgggtttgctactggcaccagcacaaggctttagacaggcacttcccacggctgagttctaggcatcccctttttgaaacgtgttctctccaccctgcaagggtggggtgagaaatctcactttcgaagggcttgcaaggaggaagagagtcggcgccttgcggattccccggccgagcccacccattcctccccgcagtcatcgcccttaccgcgcggctcctacctatctccccttttatactaatagtcttataaaaaaa

SEQ ID NO: 22389 - DNA, 2944 bp, Homo sapiens
agggctggctcttctatgtactcacgctgtgaagaaaaacttaaaaaaaattaaacaaaaaaaccttgtacgaaagcaaaggaagaagacaaatttagcagcagttctcttgaatttcctggctttgttgatttcgaaccacaaggttaacattaaaacacaaagactcacatttaaatatttcttttgaaatcagaaaaacaatagctctttgaaatgacgctggaacgcacacaatagattctactgggtcaatgtattatttatatactcatctgaactttcaaaagaagttaaatgggagatattctcaacaggcaaaaataagatattccaatctattgttcaagtttatggctccgatataaataatgggctataaacccgtatctggaaaacagttgcgcagtgcgtgcttaatggccagccaatgaaaaccaacgtctcattctactccgtctttcagcacgtcaaggacatcccactccgcctttttttttttttctttttaaagaggccaaccgctggggacacctggttttggcacctttatgaggcctcccagcagcacaggagctctaaggggcacgctctgcagttgagctatttgcagagctccatgatcgctcaaagccgagcacgcgcacgggtttgctactggcaccagcacaaggctttagacaggcacttcccacggctgagttctaggcatcccctttttgaaacgtgttctctccaccctgcaagggtggggtgagaaatctcactttcgaagggcttgcaaggaggaagagagtcggcgccttgcggattccccggccgcgcttcaaggttcacacgccgcgtggcagctcggatgcagcccggttccgaggcggtcggcggtcgagactggggcctcgagccgagaagcgaagaacaaagcggccgcgttagcccgccgccccgagggacagcccgggcgcgcccgccgctccgcccacaccccgcccctcggccgcgcgaaatggcggcggccgcaccacaaaatggcagtcgctcggtcgcggagaagcacctgctaaatgccgtgactccctccccctgccctgccccgctagcgccaacgtcgttctccccgcccaggcgccccggtcttcccacgccgccccgcccaggggcaacagggtccggagcccgccaacaacgcggcgcctttgtgcgggcgcacgccacctttactcagccacacgggcccctctccggggggctttttcttaaaggggcaaccgctggaagaaacggagcaccgccgcccgggacgcccctcaggcccggggttactacggtttccccaactcgcagcgttagcgtcaggccaccaaagtgaagatgggtggtgaaaggaccacagagcccgataggagagaaaacctaggaaaaattagtgaaagacgcccccaaccaatgctttggcggccacgctgagtcctaacgtactgagcccactcgacggggcccgtgcgcacaggcggctccaaagggcgggtttcggctttccttccacctcgcaaaagtccagtgagcgctctaggtttctcatggctaccccctgccctctccccgtgctggggagtctcgggggctgagcagtggcagagggaggagcgctgccgcggtccctgtgctttttctctggcgtgagggtctcagtggccttgggctctgcttgggccgtggctcgaaggttggaggtgtcgcggtgcgcttgggttttttcgctttctttcaaacgcttgcttcctggcgctccccaccccccagcgtccctttggctccatctttccagaaacttctctgagaaactcagcaaaaagcatccaatttcgccactgcttccccctccgcgcatgcgcgagacgccaagcggaaagcctttggcgcgccggagtgtgagagtggtgcgtgagcgcgcgcgcgctcgccgtgcgggggcggttctctctgacaatgaagggaaagaattccccctcccctcaacattccgtcctcgcgcaagcgcgtcggagccacttccttggcctttgagggaagggggaggggtcgtcccgaagcgcgctagtcgtgtttccgcgcgcctgcgcacggggccgttttcgtctcgctgtgttgtccgcgagtctttgctgtgaagtgcgtctgaacagctcgcttgtgcccgacctactttttccttaaggcccactcgcggaaactagtttcttgtggggttatcgattctgtaccccgagtttcctggagattagtctcccctttgtgccccggggatgaggctggacggcgtcgcgctggcttgtcttccaccccttcccgcgccatgtttggaacggctgttgactggatcccgtgtggagtgtgatggagccttctcgaaacgggaaaacagtcctggccgaaggcttgggtggtgcctgggccggcttatattaggcactgcgtagaatgtttgctcactaagcccaaagaaaggtgtctcttttttttttttttttttgagacgggagtctcttgtcatccaggctgtagtgcagtggcgcagtctcggctcactgcaaccttcgcctcccgggttcaagcgattctcctgcctcagcctcccatgtagctgggactacaggcgcccgccaatacgctcgggtaatttttgtatgtttagtagagatgggtttcaccatgttggtcaggctggtctcgaactcctgagctcaggtgatccgcccacctcggcctcccaaagtgctggaattacaggcgtgagccaccgagcccggctttgcccccagcctgggaacggggtcttgctgtgttgcccaactgttttggaagtcctgacgtcaagagatccttccgccagggccttccaaagtgctgagattacaggtgtgagccgccacgcccggccttt

SEQ ID NO: 22390 - DNA, 2218 bp, Homo sapiens
aaccacctggtgctggccattccactgagggtgctggtggttctgtgggccttcgtcttgggcctatccagggtcatgctggggcggcacaatgtcaccgacgtagcttttggcttttttctgggctacatgcagtacagcatcgtggactattgctggctctcaccccataatgctccggtcctctttttactgtggagtcaacgatgacaccatctcattgattatggcaccaggaagtctgaaggtttccacattcgatgatgtcaacctaaaccagcagccatcccgcttgtccctcttaggcatttcaggcttcctttgggatttcaggtgtcccatgatcttgatgtgctgctaggctggagcacacactggccattactgaacacagccatattagggaaagcaaaaaaacccaaaaaatcctctattgtatatttattcaacaactgtttatgtttccaggacaactgcaaagaaaacaagctgaggtggttatactgttgctgttaaaagttggtatcagtaagatttgtgttttgtgataatccctaaatcaacataccacttgtaaactgaacttcgagaaagaaacatgatgttcattctgtaaatatacatgcagacaggtcatgtactaatcctagtccttttcctgaggtagattttaaacagtatttttaaagtccaagacataggtttttctagtttattccctgaagatctgttgccacagttgggagatttcttcttaatcctgattttcttggtaagcttttttactttattatctctataatttattatctctatccatatttgtggatcgggtagtgggaaaagagattataatacttgtctttctctcctctccctccatccctcaaaagatctttatgcatttcccactactcccttactgtcttttagcattcagagaaaaagccaacttgcttaaagaggaatcacttaaaaggtaggcatatctaagatgctcatagaagaggaagaatgggacatggccccatgcttatttttgtttacaacgtaacatggcatgagagagggcagagaaactaagttgctggggaaagttagaggaactgaaagtttgggaataggctgaccacatattatgccagtgaccagtatgacaggagatggggccctgctgccagtcatctccactgaataaagaataatgctcctctttcagggtaataaagtggggaaaaggaacgtcttctcaatgcaagaacataagctttctcgtatatacctgtatgctacagtttttcacatggaattccgttttctgaggtacagcacattttaggtaacagtatttaacttgaaattcatcatgggagtctgctgctataccaggcacaagataaaactccaaaatttctgtttacattgacctttacatttaaagctgttcatccatggtgcctccccaaatcataagaccaaagaccaccaaacgcagggtggactctgctcattattctttgacccagaaagactggagaaggtatgtgctttaagtgctgctctacctgaaaagaaatcctttaaattacctatggaagtgatgtcctcagataatcttaatgactattttggcatttataaatagaaatgattatggactttgatctgccatacggaggttcggaacctggagaacggctgtgataagtaggttttgattgagtgaaagcatgagcttgttcagagtgaggggcatagtgaaaaaggaacagccatgcctcaaaatcaaatcatttgcattcccacagcatcctgaataccgactacctcttcacttgctaaagcagctaaactgtgaagctctaagtggtttgggtttgttgtttaaccttagcgagatcctttaactgcagcaatattcaagccagatatttggaagcaaatgatatttcctcttgcagtgtccacaaatctgaatattaggggcatgaaattaggcttaccatctgatttgtaattacaattttggaattctctgttttagttgctgaggcctgagttttctggctcttaaagcatagatcatttcacctgatgtttttgaagcatcctaagtacagtagagtagaaaactgatttctttgttaattgtacactgaataatgccttttaaaaatcaaaataaaattaacaaataatggtgaatgaagtgagatga

SEQ ID NO: 22391 - DNA, 2100 bp, Homo sapiens
aaccacctggtgctggccattccactgagggtgctggtggttctgtgggccttcgtcttgggcctatccagggtcatgctggggcggcacaatgtcaccgacgtagcttttggcttttttctgggctacatgcagtacagcatcgtggactattgctggctctcaccccataatgctccggtcctctttttactgtggagtcaacgatgacaccatctcattgattatggcaccaggaagtctgaaggtttccacattcgatgatgtcaacctaaaccagcagccatcccgcttgtccctcttaggcatttcaggcttcctttgggatttcaggtgtcccatgatcttgatgtgctgctaggctggagcacacactggccatatactgttgctgttaaaagttggtatcagtaagatttgtgttttgtgataatccctaaatcaacataccacttgtaaactgaacttcgagaaagaaacatgatgttcattctgtaaatatacatgcagacaggtcatgtactaatcctagtccttttcctgaggtagattttaaacagtatttttaaagtccaagacataggtttttctagtttattccctgaagatctgttgccacagttgggagatttcttcttaatcctgattttcttggtaagcttttttactttattatctctataatttattatctctatccatatttgtggatcgggtagtgggaaaagagattataatacttgtctttctctcctctccctccatccctcaaaagatctttatgcatttcccactactcccttactgtcttttagcattcagagaaaaagccaacttgcttaaagaggaatcacttaaaaggtaggcatatctaagatgctcatagaagaggaagaatgggacatggccccatgcttatttttgtttacaacgtaacatggcatgagagagggcagagaaactaagttgctggggaaagttagaggaactgaaagtttgggaataggctgaccacatattatgccagtgaccagtatgacaggagatggggccctgctgccagtcatctccactgaataaagaataatgctcctctttcagggtaataaagtggggaaaaggaacgtcttctcaatgcaagaacataagctttctcgtatatacctgtatgctacagtttttcacatggaattccgttttctgaggtacagcacattttaggtaacagtatttaacttgaaattcatcatgggagtctgctgctataccaggcacaagataaaactccaaaatttctgtttacattgacctttacatttaaagctgttcatccatggtgcctccccaaatcataagaccaaagaccaccaaacgcagggtggactctgctcattattctttgacccagaaagactggagaaggtatgtgctttaagtgctgctctacctgaaaagaaatcctttaaattacctatggaagtgatgtcctcagataatcttaatgactattttggcatttataaatagaaatgattatggactttgatctgccatacggaggttcggaacctggagaacggctgtgataagtaggttttgattgagtgaaagcatgagcttgttcagagtgaggggcatagtgaaaaaggaacagccatgcctcaaaatcaaatcatttgcattcccacagcatcctgaataccgactacctcttcacttgctaaagcagctaaactgtgaagctctaagtggtttgggtttgttgtttaaccttagcgagatcctttaactgcagcaatattcaagccagatatttggaagcaaatgatatttcctcttgcagtgtccacaaatctgaatattaggggcatgaaattaggcttaccatctgatttgtaattacaattttggaattctctgttttagttgctgaggcctgagttttctggctcttaaagcatagatcatttcacctgatgtttttgaagcatcctaagtacagtagagtagaaaactgatttctttgttaattgtacactgaataatgccttttaaaaatcaaaataaaattaacaaataatggtgaatgaagtgagatga

SEQ ID NO: 22392 - DNA, 554 bp, Homo sapiens
aaccacctggtgctggccattccactgagggtgctggtggttctgtgggccttcgtcttgggcctatccagggtcatgctggggcggcacaatgtcaccgacgtagcttttggcttttttctgggctacatgcagtacagcatcgtggactattgctggctctcaccccataatgctccggtcctctttttactgtggagtcaacgatgacaccatctcattgattatggcaccaggaagtctgaaggtttccacattcgatgatgtcaacctaaaccagcagccatcccgcttgtccctcttaggcatttcaggcttcctttgggatttcaggtgtcccatgatcttgatgtgctgctaggctggagcacacactggccattactgaacacagccatattagggaaagcaaaaaaacccactggagccgacacaggccccttacggggctggcaaaagctcctgggggggccctgtaccaaattcaccctatactgaggtggttacatttcacgggcccttgtttacaagtcttgcctggaacaccctgtttt

SEQ ID NO: 22393 - DNA, 1627 bp, Homo sapiens
acacgcagcttgggtaagccttctcaggcagcgcgtgtgagaactcaccaggactggggccaaatcaggatgggtggcctcgagaggtcactgcccagtttcctctagcagggaaaacccagagcccggtggctgtgttccaagcccttctccccactcctgccctggggccactgggtggcgaggtgaggtgcctcatgccaggttcatttcccggcgcctacatgcttggcatccagcggggtccgaactcctcctgctgagcggttgtctttctctcctctccctccatccctcaaaagatctttatgcatttcccactactcccttactgtcttttagcattcagagaaaaagccaacttgcttaaagaggaatcacttaaaaggtaggcatatctaagatgctcatagaagaggaagaatgggacatggccccatgcttatttttgtttacaacgtaacatggcatgagagagggcagagaaactaagttgctggggaaagttagaggaactgaaagtttgggaataggctgaccacatattatgccagtgaccagtatgacaggagatggggccctgctgccagtcatctccactgaataaagaataatgctcctctttcagggtaataaagtggggaaaaggaacgtcttctcaatgcaagaacataagctttctcgtatatacctgtatgctacagtttttcacatggaattccgttttctgaggtacagcacattttaggtaacagtatttaacttgaaattcatcatgggagtctgctgctataccaggcacaagataaaactccaaaatttctgtttacattgacctttacatttaaagctgttcatccatggtgcctccccaaatcataagaccaaagaccaccaaacgcagggtggactctgctcattattctttgacccagaaagactggagaaggtatgtgctttaagtgctgctctacctgaaaagaaatcctttaaattacctatggaagtgatgtcctcagataatcttaatgactattttggcatttataaatagaaatgattatggactttgatctgccatacggaggttcggaacctggagaacggctgtgataagtaggttttgattgagtgaaagcatgagcttgttcagagtgaggggcatagtgaaaaaggaacagccatgcctcaaaatcaaatcatttgcattcccacagcatcctgaataccgactacctcttcacttgctaaagcagctaaactgtgaagctctaagtggtttgggtttgttgtttaaccttagcgagatcctttaactgcagcaatattcaagccagatatttggaagcaaatgatatttcctcttgcagtgtccacaaatctgaatattaggggcatgaaattaggcttaccatctgatttgtaattacaattttggaattctctgttttagttgctgaggcctgagttttctggctcttaaagcatagatcatttcacctgatgtttttgaagcatcctaagtacagtagagtagaaaactgatttctttgttaattgtacactgaataatgccttttaaaaatcaaaataaaattaacaaataatggtgaatgaagtgagatga

SEQ ID NO: 22394 - DNA, 472 bp, Homo sapiens
gttattattaactaatgtgcatagatttcattagagtttactctttgtgttgtagaatctatgggttttggaagatatataatggcacatattcacccgtaccgtatcatacagaacactttcactgacctaaaaatctcctgcactccaccattgatctctcactcccttcccccaagccccagggaaccacggatctatttactgtctctatagttttaccttttccaaaatgtcagatagttgaaattattagagaatgcagccttttcagattggtttctttcacgtagcaatatgcatttaagtttcctccatgtcttttgtggcttgataactcatttctttttgttgctcaataatattccattgtatggatgtagtacagtttttatgtattcacctattgaaggacatcttggttaatttcagatttgggaaattataataaatgctgtaaatattcttgcac

SEQ ID NO: 22395 - DNA, 472 bp, Homo sapiens
ctggaactcagcaaacattcaggatggaaatgcacacttgcaaagcagtttctagaactttgtgtgacaagaacactaggaattcttcaagggatatctagccatacatatggcctccgaagaattcacccctagagggtgttcatagtgatcacttaacttgtgcaggtggcctgtagtggtgtaagcatggacatttaagcatgacacctaaagtattttatagaaatgttgaaggaattagagaaagtttatatcattttttaattggtttattactgacagcattttgatagggtattattagaactcaggtcttgtgactcaaaatcaatgccttcccagtataccactgactccccatagctggaaaaccccatgggggctctctgtttgcccttatatcaggctgaaagacatattatcaacaaaagtttatgacattaaaaccacggacccactgatcattcag

SEQ ID NO: 22396 - DNA, 664 bp, Homo sapiens
  misc_feature (557)..(557): n is a, c, g, or t
  misc_feature (560)..(560): n is a, c, g, or t
  misc_feature (587)..(587): n is a, c, g, or t
  misc_feature (597)..(597): n is a, c, g, or t
  misc_feature (625)..(625): n is a, c, g, or t
gggcacctgtaatcccagctactcaggaggctgaggcgggagaattgcttgaacccgagaggcggaggttacagtgagatgagattgcaccgctgtgctccagcctgggtgacaataacaacaacaacaaactcatttcttcaataaaattcaagaatgcacatgtactgaggcttttgtttccaagcaagatgacaggactaatcgcactgaccgccacagccacacacacaaatatctgatggggtaactttataaacacagcatgggacatccagacaatgaactattactcagtactaaaaatggagccttttcaagcaagccttgaaaagatgcagaggaaacattactaagagccaacctgaacgttgctacctactgtatagcacgctgtgtgagtccaacattctgaaaagccaaaaacccgggagacagaagaaagatcaggggttgccaggacttagggggagggagggaggaacggcagagcacacggaggatttttccagcagtgaaactcttctgtacgacactgcaaagatggatcactgtcnctntatgttgtccaaaagctgcagaatacncaagtgcaanaatgaaccctaatgggaactatggactntgggtgataatgatgtgtcaggtaagttcctcaattata

SEQ ID NO: 22397 - DNA, 356 bp, Homo sapiens
cacttgaataatgtcttgcttacagtcatttaaatctggtaatttcaataattcttttgaaaaggccaattgtggctggacgcagtggctcaagcctgtaatccccagcactctgggaggctgaggcgggtggatcacctgaggttaggagttcaagaccagcctggccaacatggtgaaaccccatctctactaaaagtataaaactagccaggcatggtggcacgtgcctgtagtcccagctacttgggaggctgaggcatgagaatcacttgaacccaggagccgaggttgtggtgagccgaaactgcgccactgcactccagcctgggtgacagagcaagactctgtctcaa

SEQ ID NO: 22398 - DNA, 243 bp, Homo sapiens
attcacgtaattctcacgacggctccatgagagaggaataagcgcttcatttagagatggagaaactgaggcacaacggagctaagttgctggcccagttcacacagctgggagtagccaggtcaggactccaatccaggcaaagcagagagaaaaatactggtgaggaggagggaggaggaagtgggacgttccagctgaggagaggtcttttttccttaatctgatgttaggggccaccca

SEQ ID NO: 22399 - DNA, 2392 bp, Homo sapiens
agctttgtggggaggtcgcgggtgagcatgcgcagagagactgtgggcgcgtggtgcagtccctggagggttctcacgctttggctgtctggacttttaagtttttccgctttttcaggaaggcgaccggcagcctcgggcaggggagacaggactgtatgtcagagaagagacggcgcttggacgccaggaatcctctgaagcaggagactgccctatccaggaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcgtaagcagctggtggctggtgacatcgtcctggacaagctaggggaaaggctagccatcctcctcaaggtgcgagacatggtcagcagccatgtggagcgagtgtttcagatctatgagcaacacgcagacacagttggcattgatgctgtcctgcagccttcagcagtgagcccctctgtggctgacatgttggaatggttgcaggatattgagagacattatcgaaagtcgtacctgaagagaaagtatcttctttcgtctatccagtggggagacttggcaaacatacaagctttgcccaaggcctgggaccgaatttcaaaagacgaacaccaagatcttgtacaagatatcctattgaatgtttccttcttcctggaagagtaaggaagctatgcgtatctggagaccacgggcaccacagttgaagactgacattctgaaccctgatgtttctaaagaaacgtcagtatttcagtctgacatatttgaaacatcagtgccttgaaccttaggactgggtcttggggaggattagcgcctagatgtctgattttggagctgcagcatgccaggccgtggctgagagtatgtgagccatgccttgcccttttctgaggctcagggaagtggatggagctagagagacaacaggaaagacggtgctgaagaacatagtgtctttcctctattgtggacctaaagaggtggggaagcaaggacaagaggcaaagagccacactgcccttggcatcatccaaagcattgtctggttgacaccaggtcctggttttgtgtcttttgtcaatacctgaatccttgacaaaagaaaaagtggttttgatgatttaaagaaataagggtgattttgacagaaaatatattttaaaaattttgaccaattgcaatagttatcctcaagccaatttccagaacctgccaccagggggaggtggtgcagcatgaatcattctgaatgctttgtctttgaagtgttcccctattgctgttaccatctcagaggaagtaactgggcatggtgagactcctaaaatgatcggagtttttttggccaaagctggcatctgacttgccacattcctctgagtctggagtagccgcaggggtgggagaatgccagcccagagtcagtccatcggggttacatttccaaggtctgctgccttcatctatgtaatggccgtgttactttcagatctttcagcttcccagagtgttgtgggaatcttggtcattgaatgtaaagggacttagtaaagggtatagatatttttcaaaaatgaaaataactttttttcttataagtgataagcttttataaagatcataggaaaactagaaaaaatgtaaaatgtagaaaattgtaaaacaaacttcattagagatattttgatagataccttttcagtgtctatttacaaattttttcttttaatatagatagggtctcactatattgcccagctcactcctgagctcaagggatcctcccaccatagcctcccaaaatattggaaatacaggcatgagccactgctcctgaccaattcacaaatttttttaaagaacaaacgtgctatcatcgatacatactgttaggttgtctttttttaaaaaacctaatgtaatttgttcatctttttatatctgtaaatatagctcaacacagttatattctttttgtgaatgtattatatctacaatttaccttttttcttagattttacatgcattttcccaaatctttgtgtttgcctatctgtaaaggtaatacattctgattacaaaaaatgaaaatgttacatagaaatgtaccgttatccatctaccagataactattattaataatgtgtatttatttttccaggaattaaaaaacatctatcatataagtattgcaaataaaacttaaaaagca

SEQ ID NO: 22400 - DNA, 735 bp, Homo sapiens
agctttgtggggaggtcgcgggtgagcatgcgcagagagactgtgggcgcgtggtgcagtccctggagggttctcacgctttggctgtctggacttttaagtttttccgctttttcaggaaggcgaccggcagcctcgggcaggggagacaggactgtatgtcagagaagagacggcgcttggacgccaggaatcctctgaagcaggagactgccctatccaggttacccttcccgaggggaaaccagggtctccttcagaaagctgaggcaggccgggcgcggtggctcacgcctgtaatcccagcactttggaagaccgaggcgggcggatcacctgaggaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcgtaagcagctggtggctggtgacatcgtcctggacaagctaggggaaaggctgtaagcagctccctagtgctgtttcttggtggaaggattttaaaacgaggtgttttatatgtagctagtgtcagtccagaaggtgtttttctccttgaaagcgtggcatgtggag

SEQ ID NO: 22401 - DNA, 823 bp, Homo sapiens
agctttgtggggaggtcgcgggtgagcatgcgcagagagactgtgggcgcgtggtgcagtccctggagggttctcacgctttggctgtctggacttttaagtttttccgctttttcaggaaggcgaccggcagcctcgggcaggggagacaggactgtatgtcagagaagagacggcgcttggacgccaggaatcctctgaagcaggagactgccctatccaggttacccttcccgaggggaaaccagggtctccttcagaaagccggcttattttcccttttaaatgcattggtagcagtagtagtaacagcaacaggagcatgggcagaaggagcaagagctgcggctgacattactaagcacttgctatgtgctagaatgtttacacagtcacttgtcaagtcctttccttctgtttccctggtgcttctttgattttccctctccgtccccatcccctctgttgcttacatggcttcttagctctcacttggactcttaattgcctcttgacagttttctctgtctagtttctttccttctaagctgactccaatgaatgacctctatatctgcaggaagtctggttctgatcctgatacttaggatcagaattgttctgtactgtataggaatagctcctgttgctaatgggataaagttcagagccctgcgttggtacttggtgttctttctgttctggctcagcccacctttcagcctttctgactgctctccatgtggcgtccatgctgagcagactggaagatttgctttccctgaattcattctatgcatctccacctctgtgcctttgttca

SEQ ID NO: 22402 - DNA, 654 bp, Homo sapiens
tgtggcggctctgcaataccccaagctctggagggctgggggcctactaggtcaggaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcgtaagcagctggtggctggtgacatcgtcctggacaagctaggggaaaggctagccatcctcctcaaggtgcgagacatggtcagcagccatgtggagcgagtgtttcagatctatgagcaacacgcagacacagttggcattgatgctgtcctgcagccttcagcagtgagcccctctgtggctgacatgttggaatggttgcaggatattgagagacattatcgaaagtcgtacctgaagagaaagtatcttctttcgtctatccagtggggagacttggcaaacatacaagctttgcccaaggcctgggaccgaatttcaaaagacgaacaccaagatcttgtacaaggtactggtttgtgttcttcct

SEQ ID NO: 22403 - DNA, 2869 bp, Homo sapiens
  misc_feature (2800)..(2800): n is a, c, g, or t
  misc_feature (2857)..(2857): n is a, c, g, or t
agctttgtggggaggtcgcgggtgagcatgcgcagagagactgtgggcgcgtggtgcagtccctggagggttctcacgctttggctgtctggacttttaagtttttccgctttttcaggaaggcgaccggcagcctcgggcaggggagacaggactgtatgtcagagaagagacggcgcttggacgccaggaatcctctgaagcaggagactgccctatccaggttacccttcccgaggggaaaccagggtctccttcagaaagctgaggcaggccgggcgcggtggctcacgcctgtaatcccagcactttggaagaccgaggcgggcggatcacctgaggaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcgtaagcagctggtggctggtgacatcgtcctggacaagctaggggaaaggctagccatcctcctcaaggtgcgagacatggtcagcagccatgtggagcgagtgtttcagatctatgagcaacacgcagacacagttggcattgatgctgtcctgcagccttcagcagtgagcccctctgtggctgacatgttggaatggttgcaggatattgagagacattatcgaaagtcgtacctgaagagaaagtatcttctttcgtctatccagtggggagacttggcaaacatacaagctttgcccaaggcctgggaccgaatttcaaaagacgaacaccaagatcttgtacaagatatcctattgaatgtttccttcttcctggaagagtaaggaagctatgcgtatctggagaccacgggcaccacagttgaagactgacattctgaaccctgatgtttctaaagaaacgtcagtatttcagtctgacatatttgaaacatcagtgccttgaaccttaggactgggtcttggggaggattagcgcctagatgtctgattttggagctgcagcatgccaggccgtggctgagagtatgtgagccatgccttgcccttttctgaggctcagggaagtggatggagctagagagacaacaggaaagacggtgctgaagaacatagtgtctttcctctattgtggacctaaagaggtggggaagcaaggacaagaggcaaagagccacactgcccttggcatcatccaaagcattgtctggttgacaccaggtcctggttttgtgtcttttgtcaatacctgaatccttgacaaaagaaaaagtggttttgatgatttaaagaaataagggtgattttgacagaaaatatattttaaaaattttgaccaattgcaatagttatcctcaagccaatttccagaacctgccaccagggggaggtggtgcagcatgaatcattctgaatgctttgtctttgaagtgttcccctattgctgttaccatctcagaggaagtaactgggcatggtgagactcctaaaatgatcggagtttttttggccaaagctggcatctgacttgccacattcctctgagtctggagtagccgcaggggtgggagaatgccagcccagagtcagtccatcggggttacatttccaaggtctgctgccttcatctatgtaatggccgtgttactttcagatctttcagcttcccagagtgttgtgggaatcttggtcattgaatgtaaagggacttagtaaagggtatagatatttttcaaaaatgaaaataactttttttcttataagtgataagcttttataaagatcataggaaaactagaaaaaatgtaaaatgtagaaaattgtaaaacaaacttcattagagatattttgatagataccttttcagtgtctatttacaaattttttcttttaatatagatagggtctcactatattgcccagctcactcctgagctcaagggatcctcccaccatagcctcccaaaatattggaaatacaggcatgagccactgctcctgaccaattcacaaatttttttaaagaacaaacgtgctatcatcgatacatactgttaggttgtctttttttaaaaaacctaatgtaatttgttcatctttttatatctgtaaatatagctcaacacagttatattctttttgtgaatgtattatatctacaatttaccttttttcttagattttacatgcattttcccaaatctttgtgtttgcctatctgtaaaggtaatacattctgattacaaaaaatgaaaatgttacatagaaatgtaccgttatccatctaccagataactattattaataatgtgtatttatttttccaggaattaaaaaacatctatcatataagtattgcaaataaaacttaaaaagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaacacaaaaaaaaccaaaaaaaaacaaaaaaaaaacacaacaaaacacaaaaacaacacaccacacacacacacacacccaaaccaaccccccccacccacaccaacccaccaccacccacacaccccaaacacccacacaaataccccaanacacaccacaaaaaccccataaaaccaccacaccaccccccaaataaatcacaccancccaacttctaa

SEQ ID NO: 22404 - DNA, 3083 bp, Homo sapiens
  misc_feature (3014)..(3014): n is a, c, g, or t
  misc_feature (3071)..(3071): n is a, c, g, or t
agctttgtggggaggtcgcgggtgagcatgcgcagagagactgtgggcgcgtggtgcagtccctggagggttctcacgctttggctgtctggacttttaagtttttccgctttttcaggaaggcgaccggcagcctcgggcaggggagacaggactgtatgtcagagaagagacggcgcttggacgccaggaatcctctgaagcaggagactgccctatccaggttacccttcccgaggggaaaccagggtctccttcagaaagctgaggcaggccgggcgcggtggctcacgcctgtaatcccagcactttggaagaccgaggcgggcggatcacctgaggtcaggaaccccgtctactaaaaatacaaaaattagccaggcgtgtaggcgggcacctgtattcccagctactcgggaggctgaggcaggagaattgcttgaacccgggatgcggaggttgcagtgagccgagatagcgccactgcactccagcctgggcgacattgagactccgtctcgaaaaaaaaacaaaaaaaaaaccctgcttctggaggaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcgtaagcagctggtggctggtgacatcgtcctggacaagctaggggaaaggctagccatcctcctcaaggtgcgagacatggtcagcagccatgtggagcgagtgtttcagatctatgagcaacacgcagacacagttggcattgatgctgtcctgcagccttcagcagtgagcccctctgtggctgacatgttggaatggttgcaggatattgagagacattatcgaaagtcgtacctgaagagaaagtatcttctttcgtctatccagtggggagacttggcaaacatacaagctttgcccaaggcctgggaccgaatttcaaaagacgaacaccaagatcttgtacaagatatcctattgaatgtttccttcttcctggaagagtaaggaagctatgcgtatctggagaccacgggcaccacagttgaagactgacattctgaaccctgatgtttctaaagaaacgtcagtatttcagtctgacatatttgaaacatcagtgccttgaaccttaggactgggtcttggggaggattagcgcctagatgtctgattttggagctgcagcatgccaggccgtggctgagagtatgtgagccatgccttgcccttttctgaggctcagggaagtggatggagctagagagacaacaggaaagacggtgctgaagaacatagtgtctttcctctattgtggacctaaagaggtggggaagcaaggacaagaggcaaagagccacactgcccttggcatcatccaaagcattgtctggttgacaccaggtcctggttttgtgtcttttgtcaatacctgaatccttgacaaaagaaaaagtggttttgatgatttaaagaaataagggtgattttgacagaaaatatattttaaaaattttgaccaattgcaatagttatcctcaagccaatttccagaacctgccaccagggggaggtggtgcagcatgaatcattctgaatgctttgtctttgaagtgttcccctattgctgttaccatctcagaggaagtaactgggcatggtgagactcctaaaatgatcggagtttttttggccaaagctggcatctgacttgccacattcctctgagtctggagtagccgcaggggtgggagaatgccagcccagagtcagtccatcggggttacatttccaaggtctgctgccttcatctatgtaatggccgtgttactttcagatctttcagcttcccagagtgttgtgggaatcttggtcattgaatgtaaagggacttagtaaagggtatagatatttttcaaaaatgaaaataactttttttcttataagtgataagcttttataaagatcataggaaaactagaaaaaatgtaaaatgtagaaaattgtaaaacaaacttcattagagatattttgatagataccttttcagtgtctatttacaaattttttcttttaatatagatagggtctcactatattgcccagctcactcctgagctcaagggatcctcccaccatagcctcccaaaatattggaaatacaggcatgagccactgctcctgaccaattcacaaatttttttaaagaacaaacgtgctatcatcgatacatactgttaggttgtctttttttaaaaaacctaatgtaatttgttcatctttttatatctgtaaatatagctcaacacagttatattctttttgtgaatgtattatatctacaatttaccttttttcttagattttacatgcattttcccaaatctttgtgtttgcctatctgtaaaggtaatacattctgattacaaaaaatgaaaatgttacatagaaatgtaccgttatccatctaccagataactattattaataatgtgtatttatttttccaggaattaaaaaacatctatcatataagtattgcaaataaaacttaaaaagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaacacaaaaaaaaccaaaaaaaaacaaaaaaaaaacacaacaaaacacaaaaacaacacaccacacacacacacacacccaaaccaaccccccccacccacaccaacccaccaccacccacacaccccaaacacccacacaaataccccaanacacaccacaaaaaccccataaaaccaccacaccaccccccaaataaatcacaccancccaacttctaa

SEQ ID NO: 22405 - DNA, 3087 bp, Homo sapiens
  misc_feature (3018)..(3018): n is a, c, g, or t
  misc_feature (3075)..(3075): n is a, c, g, or t
tgtggcggctctgcaataccccaagctctggagggctgggggcctactaggtcaggtcggctgtaggattctgctccaggttggcggctgcttctttctggcctggctgccactgagtagccgaggggccgccgtgaccctctgactgattgactggctggctgcctacgtcggcgctcctcagggccccaagctcctcaggccgaacttcggggttggattgctcaagagttgtgctgagacccagaaggctagaggctagtttcgaagctgtagctcaggctgagtctcaaggcgggcggcgactggacggccagaccggcgagctcttgacgggaaggcgaccggcagcctcgggcaggggagacaggactgtatgtcagagaagagacggcgcttggacgccaggaatcctctgaagcaggagactgccctatccaggttacccttcccgaggggaaaccagggtctccttcagaaagctgaggcaggccgggcgcggtggctcacgcctgtaatcccagcactttggaagaccgaggcgggcggatcacctgaggaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcgtaagcagctggtggctggtgacatcgtcctggacaagctaggggaaaggctagccatcctcctcaaggtgcgagacatggtcagcagccatgtggagcgagtgtttcagatctatgagcaacacgcagacacagttggcattgatgctgtcctgcagccttcagcagtgagcccctctgtggctgacatgttggaatggttgcaggatattgagagacattatcgaaagtcgtacctgaagagaaagtatcttctttcgtctatccagtggggagacttggcaaacatacaagctttgcccaaggcctgggaccgaatttcaaaagacgaacaccaagatcttgtacaagatatcctattgaatgtttccttcttcctggaagagtaaggaagctatgcgtatctggagaccacgggcaccacagttgaagactgacattctgaaccctgatgtttctaaagaaacgtcagtatttcagtctgacatatttgaaacatcagtgccttgaaccttaggactgggtcttggggaggattagcgcctagatgtctgattttggagctgcagcatgccaggccgtggctgagagtatgtgagccatgccttgcccttttctgaggctcagggaagtggatggagctagagagacaacaggaaagacggtgctgaagaacatagtgtctttcctctattgtggacctaaagaggtggggaagcaaggacaagaggcaaagagccacactgcccttggcatcatccaaagcattgtctggttgacaccaggtcctggttttgtgtcttttgtcaatacctgaatccttgacaaaagaaaaagtggttttgatgatttaaagaaataagggtgattttgacagaaaatatattttaaaaattttgaccaattgcaatagttatcctcaagccaatttccagaacctgccaccagggggaggtggtgcagcatgaatcattctgaatgctttgtctttgaagtgttcccctattgctgttaccatctcagaggaagtaactgggcatggtgagactcctaaaatgatcggagtttttttggccaaagctggcatctgacttgccacattcctctgagtctggagtagccgcaggggtgggagaatgccagcccagagtcagtccatcggggttacatttccaaggtctgctgccttcatctatgtaatggccgtgttactttcagatctttcagcttcccagagtgttgtgggaatcttggtcattgaatgtaaagggacttagtaaagggtatagatatttttcaaaaatgaaaataactttttttcttataagtgataagcttttataaagatcataggaaaactagaaaaaatgtaaaatgtagaaaattgtaaaacaaacttcattagagatattttgatagataccttttcagtgtctatttacaaattttttcttttaatatagatagggtctcactatattgcccagctcactcctgagctcaagggatcctcccaccatagcctcccaaaatattggaaatacaggcatgagccactgctcctgaccaattcacaaatttttttaaagaacaaacgtgctatcatcgatacatactgttaggttgtctttttttaaaaaacctaatgtaatttgttcatctttttatatctgtaaatatagctcaacacagttatattctttttgtgaatgtattatatctacaatttaccttttttcttagattttacatgcattttcccaaatctttgtgtttgcctatctgtaaaggtaatacattctgattacaaaaaatgaaaatgttacatagaaatgtaccgttatccatctaccagataactattattaataatgtgtatttatttttccaggaattaaaaaacatctatcatataagtattgcaaataaaacttaaaaagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaacacaaaaaaaaccaaaaaaaaacaaaaaaaaaacacaacaaaacacaaaaacaacacaccacacacacacacacacccaaaccaaccccccccacccacaccaacccaccaccacccacacaccccaaacacccacacaaataccccaanacacaccacaaaaaccccataaaaccaccacaccaccccccaaataaatcacaccancccaacttctaa

SEQ ID NO: 22406 - DNA, 2969 bp, Homo sapiens
  misc_feature (2900)..(2900): n is a, c, g, or t
  misc_feature (2957)..(2957): n is a, c, g, or t
tgtggcggctctgcaataccccaagctctggagggctgggggcctactaggtcaggtcggctgtaggattctgctccaggttggcggctgcttctttctggcctggctgccactgagtagccgaggggccgccgtgaccctctgactgattgactggctggctgcctacgtcggcgctcctcagggccccaagctcctcaggccgaacttcggggttggattgctcaagagttgtgctgagacccagaaggctagaggctagtttcgaagctgtagctcaggctgagtctcaaggcgggcggcgactggacggccagaccggcgagctcttgacgggaaggcgaccggcagcctcgggcaggggagacaggactgtatgtcagagaagagacggcgcttggacgccaggaatcctctgaagcaggagactgccctatccaggaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcgtaagcagctggtggctggtgacatcgtcctggacaagctaggggaaaggctagccatcctcctcaaggtgcgagacatggtcagcagccatgtggagcgagtgtttcagatctatgagcaacacgcagacacagttggcattgatgctgtcctgcagccttcagcagtgagcccctctgtggctgacatgttggaatggttgcaggatattgagagacattatcgaaagtcgtacctgaagagaaagtatcttctttcgtctatccagtggggagacttggcaaacatacaagctttgcccaaggcctgggaccgaatttcaaaagacgaacaccaagatcttgtacaagatatcctattgaatgtttccttcttcctggaagagtaaggaagctatgcgtatctggagaccacgggcaccacagttgaagactgacattctgaaccctgatgtttctaaagaaacgtcagtatttcagtctgacatatttgaaacatcagtgccttgaaccttaggactgggtcttggggaggattagcgcctagatgtctgattttggagctgcagcatgccaggccgtggctgagagtatgtgagccatgccttgcccttttctgaggctcagggaagtggatggagctagagagacaacaggaaagacggtgctgaagaacatagtgtctttcctctattgtggacctaaagaggtggggaagcaaggacaagaggcaaagagccacactgcccttggcatcatccaaagcattgtctggttgacaccaggtcctggttttgtgtcttttgtcaatacctgaatccttgacaaaagaaaaagtggttttgatgatttaaagaaataagggtgattttgacagaaaatatattttaaaaattttgaccaattgcaatagttatcctcaagccaatttccagaacctgccaccagggggaggtggtgcagcatgaatcattctgaatgctttgtctttgaagtgttcccctattgctgttaccatctcagaggaagtaactgggcatggtgagactcctaaaatgatcggagtttttttggccaaagctggcatctgacttgccacattcctctgagtctggagtagccgcaggggtgggagaatgccagcccagagtcagtccatcggggttacatttccaaggtctgctgccttcatctatgtaatggccgtgttactttcagatctttcagcttcccagagtgttgtgggaatcttggtcattgaatgtaaagggacttagtaaagggtatagatatttttcaaaaatgaaaataactttttttcttataagtgataagcttttataaagatcataggaaaactagaaaaaatgtaaaatgtagaaaattgtaaaacaaacttcattagagatattttgatagataccttttcagtgtctatttacaaattttttcttttaatatagatagggtctcactatattgcccagctcactcctgagctcaagggatcctcccaccatagcctcccaaaatattggaaatacaggcatgagccactgctcctgaccaattcacaaatttttttaaagaacaaacgtgctatcatcgatacatactgttaggttgtctttttttaaaaaacctaatgtaatttgttcatctttttatatctgtaaatatagctcaacacagttatattctttttgtgaatgtattatatctacaatttaccttttttcttagattttacatgcattttcccaaatctttgtgtttgcctatctgtaaaggtaatacattctgattacaaaaaatgaaaatgttacatagaaatgtaccgttatccatctaccagataactattattaataatgtgtatttatttttccaggaattaaaaaacatctatcatataagtattgcaaataaaacttaaaaagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaacacaaaaaaaaccaaaaaaaaacaaaaaaaaaacacaacaaaacacaaaaacaacacaccacacacacacacacacccaaaccaaccccccccacccacaccaacccaccaccacccacacaccccaaacacccacacaaataccccaanacacaccacaaaaaccccataaaaccaccacaccaccccccaaataaatcacaccancccaacttctaa

SEQ ID NO: 22407 - DNA, 2741 bp, Homo sapiens
  misc_feature (2672)..(2672): n is a, c, g, or t
  misc_feature (2729)..(2729): n is a, c, g, or t
tgtggcggctctgcaataccccaagctctggagggctgggggcctactaggtcaggtcggctgtaggattctgctccaggttggcggctgcttctttctggcctggctgccactgagtagccgaggggccgccgtgaccctctgactgattgactggctggctgcctacgtcggcgctcctcagggccccaagctcctcaggccgaacttcgggaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcgtaagcagctggtggctggtgacatcgtcctggacaagctaggggaaaggctagccatcctcctcaaggtgcgagacatggtcagcagccatgtggagcgagtgtttcagatctatgagcaacacgcagacacagttggcattgatgctgtcctgcagccttcagcagtgagcccctctgtggctgacatgttggaatggttgcaggatattgagagacattatcgaaagtcgtacctgaagagaaagtatcttctttcgtctatccagtggggagacttggcaaacatacaagctttgcccaaggcctgggaccgaatttcaaaagacgaacaccaagatcttgtacaagatatcctattgaatgtttccttcttcctggaagagtaaggaagctatgcgtatctggagaccacgggcaccacagttgaagactgacattctgaaccctgatgtttctaaagaaacgtcagtatttcagtctgacatatttgaaacatcagtgccttgaaccttaggactgggtcttggggaggattagcgcctagatgtctgattttggagctgcagcatgccaggccgtggctgagagtatgtgagccatgccttgcccttttctgaggctcagggaagtggatggagctagagagacaacaggaaagacggtgctgaagaacatagtgtctttcctctattgtggacctaaagaggtggggaagcaaggacaagaggcaaagagccacactgcccttggcatcatccaaagcattgtctggttgacaccaggtcctggttttgtgtcttttgtcaatacctgaatccttgacaaaagaaaaagtggttttgatgatttaaagaaataagggtgattttgacagaaaatatattttaaaaattttgaccaattgcaatagttatcctcaagccaatttccagaacctgccaccagggggaggtggtgcagcatgaatcattctgaatgctttgtctttgaagtgttcccctattgctgttaccatctcagaggaagtaactgggcatggtgagactcctaaaatgatcggagtttttttggccaaagctggcatctgacttgccacattcctctgagtctggagtagccgcaggggtgggagaatgccagcccagagtcagtccatcggggttacatttccaaggtctgctgccttcatctatgtaatggccgtgttactttcagatctttcagcttcccagagtgttgtgggaatcttggtcattgaatgtaaagggacttagtaaagggtatagatatttttcaaaaatgaaaataactttttttcttataagtgataagcttttataaagatcataggaaaactagaaaaaatgtaaaatgtagaaaattgtaaaacaaacttcattagagatattttgatagataccttttcagtgtctatttacaaattttttcttttaatatagatagggtctcactatattgcccagctcactcctgagctcaagggatcctcccaccatagcctcccaaaatattggaaatacaggcatgagccactgctcctgaccaattcacaaatttttttaaagaacaaacgtgctatcatcgatacatactgttaggttgtctttttttaaaaaacctaatgtaatttgttcatctttttatatctgtaaatatagctcaacacagttatattctttttgtgaatgtattatatctacaatttaccttttttcttagattttacatgcattttcccaaatctttgtgtttgcctatctgtaaaggtaatacattctgattacaaaaaatgaaaatgttacatagaaatgtaccgttatccatctaccagataactattattaataatgtgtatttatttttccaggaattaaaaaacatctatcatataagtattgcaaataaaacttaaaaagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaacacaaaaaaaaccaaaaaaaaacaaaaaaaaaacacaacaaaacacaaaaacaacacaccacacacacacacacacccaaaccaaccccccccacccacaccaacccaccaccacccacacaccccaaacacccacacaaataccccaanacacaccacaaaaaccccataaaaccaccacaccaccccccaaataaatcacaccancccaacttctaa

SEQ ID NO: 22408 - DNA, 2917 bp, Homo sapiens
  misc_feature (2848)..(2848): n is a, c, g, or t
  misc_feature (2905)..(2905): n is a, c, g, or t
tgtggcggctctgcaataccccaagctctggagggctgggggcctactaggtcaggtcggctgtaggattctgctccaggttggcggctgcttctttctggcctggctgccactgagtagccgaggggccgccgtgaccctctgactgattgactggctggctgcctacgtcggcgctcctcagggccccaagctcctcaggccgaacttcggggttggattgctcaagagttgtgctgagacccagaaggctagaggctagtttcgaagctgtagctcaggctgagtctcaaggcgggcggcgactggacggccagaccggcgagctcttgacgggaaggcgaccggcagcctcgggcaggggagacaggactgtatgtcagagaagagacggcgcttggacgccaggaatcctctgaagcaggagactgccctatccaggaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcagccatcctcctcaaggtgcgagacatggtcagcagccatgtggagcgagtgtttcagatctatgagcaacacgcagacacagttggcattgatgctgtcctgcagccttcagcagtgagcccctctgtggctgacatgttggaatggttgcaggatattgagagacattatcgaaagtcgtacctgaagagaaagtatcttctttcgtctatccagtggggagacttggcaaacatacaagctttgcccaaggcctgggaccgaatttcaaaagacgaacaccaagatcttgtacaagatatcctattgaatgtttccttcttcctggaagagtaaggaagctatgcgtatctggagaccacgggcaccacagttgaagactgacattctgaaccctgatgtttctaaagaaacgtcagtatttcagtctgacatatttgaaacatcagtgccttgaaccttaggactgggtcttggggaggattagcgcctagatgtctgattttggagctgcagcatgccaggccgtggctgagagtatgtgagccatgccttgcccttttctgaggctcagggaagtggatggagctagagagacaacaggaaagacggtgctgaagaacatagtgtctttcctctattgtggacctaaagaggtggggaagcaaggacaagaggcaaagagccacactgcccttggcatcatccaaagcattgtctggttgacaccaggtcctggttttgtgtcttttgtcaatacctgaatccttgacaaaagaaaaagtggttttgatgatttaaagaaataagggtgattttgacagaaaatatattttaaaaattttgaccaattgcaatagttatcctcaagccaatttccagaacctgccaccagggggaggtggtgcagcatgaatcattctgaatgctttgtctttgaagtgttcccctattgctgttaccatctcagaggaagtaactgggcatggtgagactcctaaaatgatcggagtttttttggccaaagctggcatctgacttgccacattcctctgagtctggagtagccgcaggggtgggagaatgccagcccagagtcagtccatcggggttacatttccaaggtctgctgccttcatctatgtaatggccgtgttactttcagatctttcagcttcccagagtgttgtgggaatcttggtcattgaatgtaaagggacttagtaaagggtatagatatttttcaaaaatgaaaataactttttttcttataagtgataagcttttataaagatcataggaaaactagaaaaaatgtaaaatgtagaaaattgtaaaacaaacttcattagagatattttgatagataccttttcagtgtctatttacaaattttttcttttaatatagatagggtctcactatattgcccagctcactcctgagctcaagggatcctcccaccatagcctcccaaaatattggaaatacaggcatgagccactgctcctgaccaattcacaaatttttttaaagaacaaacgtgctatcatcgatacatactgttaggttgtctttttttaaaaaacctaatgtaatttgttcatctttttatatctgtaaatatagctcaacacagttatattctttttgtgaatgtattatatctacaatttaccttttttcttagattttacatgcattttcccaaatctttgtgtttgcctatctgtaaaggtaatacattctgattacaaaaaatgaaaatgttacatagaaatgtaccgttatccatctaccagataactattattaataatgtgtatttatttttccaggaattaaaaaacatctatcatataagtattgcaaataaaacttaaaaagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaacacaaaaaaaaccaaaaaaaaacaaaaaaaaaacacaacaaaacacaaaaacaacacaccacacacacacacacacccaaaccaaccccccccacccacaccaacccaccaccacccacacaccccaaacacccacacaaataccccaanacacaccacaaaaaccccataaaaccaccacaccaccccccaaataaatcacaccancccaacttctaa

SEQ ID NO: 22409 - DNA, 2811 bp, Homo sapiens
  misc_feature (2742)..(2742): n is a, c, g, or t
  misc_feature (2799)..(2799): n is a, c, g, or t
agctttgtggggaggtcgcgggtgagcatgcgcagagagactgtgggcgcgtggtgcagtccctggagggttctcacgctttggctgtctggacttttaagtttttccgctttttcaggaaggcgaccggcagcctcgggcaggggagacaggactgtatgtcagagaagagacggcgcttggacgccaggaatcctctgaagcaggagactgccctatccaggttacccttcccgaggggaaaccagggtctccttcagaaagctgaggcaggccgggcgcggtggctcacgcctgtaatcccagcactttggaagaccgaggcgggcggatcacctgaggaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcgtaagcagctggtggctggtgacatcgtcctggacaagctaggggaaaggctagccatcctcctcaaggtgcgagacatggtcagcagccatgtggagcgagtgtttcagatctatgagcaacacgcagacacagttggcattgatgctgtcctgcagccttcagcagtgagcccctctgtggctgacatgttggaatggttgcaggatattgagagacattatcgaaagtcgtacctgaagagaaagtatcttctttcgtctatccagtggggagacttggcaaacatacaagctttgcccaaggcctgggaccgaatttcaaaagacgaacaccaagatcttgtacaagatatcctattgaatgtttccttcttcctggaagagtaaggaagctatgcgtatctggagaccacgggcaccacagttgaagactgacattctgaaccctgatgtttctaaagaaacgtcagtatttcagtctgacatatttgaaacatcagtgccttgaaccttaggactgggtcttggggaggattagcgcctagatgtctgattttggagctgcagcatgccaggccgtggctgagagtatgtgagccatgccttgcccttttctgaggctcagggaagtggatggagctagagagacaacaggaaagacggtgctgaagaacatagtgtctttcctctattgtggacctaaagaggtggggaagcaaggacaagaggcaaagagccacactgcccttggcatcatccaaagcattgtctggttgacaccaggtcctggttttgtgtcttttgtcaatacctgaatccttgacaaaagaaaaagtggttttgatgatttaaagaaataagggtgattttgacagaaaatatattttaaaaattttgaccaattgcaatagttatcctcaagccaatttccagaacctgccaccagggggaggtggtgcagcatgaatcattctgaatgctttgtctttgaagtgttcccctattgctgttaccatctcagaggaagtaactgggcatggtgagactcctaaaatgatcggagtttttttggccaaagctggcatctgacttgccacattcctctgagtctggagtagccgcaggggtgggagaatgccagcccagagtcagtccatcggggttacatttccaaggtctgctgccttcatctatgtaatggccgtgttactttcagatctttcagcttcccagagtgttgtgggaatcttggtcattgaatgtaaagggacttagtaaagggtatagatatttttcaaaaatgaaaataactttttttcttataagtgataagcttttataaagatcataggaaaactagaaaaaatgtaaaatgtagaaaattgtaaaacaaacttcattagagatattttgatagataccttttcagtgtctatttacaaattttttcttttaatatagatagggtctcactatattgcccagctcactcctgagctcaagggatcctcccaccatagcctccaaagaacaaacgtgctatcatcgatacatactgttaggttgtctttttttaaaaaacctaatgtaatttgttcatctttttatatctgtaaatatagctcaacacagttatattctttttgtgaatgtattatatctacaatttaccttttttcttagattttacatgcattttcccaaatctttgtgtttgcctatctgtaaaggtaatacattctgattacaaaaaatgaaaatgttacatagaaatgtaccgttatccatctaccagataactattattaataatgtgtatttatttttccaggaattaaaaaacatctatcatataagtattgcaaataaaacttaaaaagcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaacacaaaaaaaaccaaaaaaaaacaaaaaaaaaacacaacaaaacacaaaaacaacacaccacacacacacacacacccaaaccaaccccccccacccacaccaacccaccaccacccacacaccccaaacacccacacaaataccccaanacacaccacaaaaaccccataaaaccaccacaccaccccccaaataaatcacaccancccaacttctaa

SEQ ID NO: 22410 - DNA, 1962 bp, Homo sapiens
agctttgtggggaggtcgcgggtgagcatgcgcagagagactgtgggcgcgtggtgcagtccctggagggttctcacgctttggctgtctggacttttaagtttttccgctttttcaggaaggcgaccggcagcctcgggcaggggagacaggactgtatgtcagagaagagacggcgcttggacgccaggaatcctctgaagcaggagactgccctatccaggttacccttcccgaggggaaaccagggtctccttcagaaagctgaggcaggccgggcgcggtggctcacgcctgtaatcccagcactttggaagaccgaggcgggcggatcacctgaggaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcgtaagcagctggtggctggtgacatcgtcctggacaagctaggggaaaggctagccatcctcctcaaggtgcgagacatggtcagcagccatgtggagcgagtgtttcagatctatgagcaacacgcagacacagttggcattgatgctgtcctgcagccttcagcagtgagcccctctgtggctgacatgttggaatggttgcaggatattgagagacattatcgaaagtcgtacctgaagagaaagtatcttctttcgtctatccagtggggagacttggcaaacatacaagctttgcccaaggcctgggaccgaatttcaaaagacgaacaccaagatcttgtacaagatatcctattgaatgtttccttcttcctggaagagtaaggaagctatgcgtatctggagaccacgggcaccacagttgaagactgacattctgaaccctgatgtttctaaagaaacgtcagtatttcagtctgacatatttgaaacatcagtgccttgaaccttaggactgggtcttggggaggattagcgcctagatgtctgattttggagctgcagcatgccaggccgtggctgagagtatgtgagccatgccttgcccttttctgaggctcagggaagtggatggagctagagagacaacaggaaagacggtgctgaagaacatagtgtctttcctctattgtggacctaaagaggtggggaagcaaggacaagaggcaaagagccacactgcccttggcatcatccaaagcattgtctggttgacaccaggtcctggttttgtgtcttttgtcaatacctgaatccttgacaaaagaaaaagtggttttgatgatttaaagaaataagggtgattttgacagaaaatatattttaaaaattttgaccaattgcaatagttatcctcaagccaatttccagaacctgccaccagggggaggtggtgcagcatgaatcattctgaatgctttgtctttgaagtgttcccctattgctgttaccatctcagaggaagtaactgggcatggtgagactcctaaaatgatcggagtttttttggccaaagctggcatctgacttgccacattcctctgagtctggagtagccgcaggggtgggagaatgccagcccagagtcagtccatcggggttacatttccaaggtctgctgccttcatctatgtaatggccgtgttactttcagatctttcagcttcccagagtgttgtgggaatcttggtcattgaatgtaaagggacttagtaaagggtatagatatttttcaaaaatgaaaataactttttttcttataagtgataagcttgctatacacagactcatacggcgcgctagcatcccggtagcagtgtagtcctcttg

SEQ ID NO: 22411 - DNA, 444 bp, Homo sapiens
ataacagagatgacgcccaccctcgacccagtgcctccccgactgacttggcaccccaacgtggttattttctgtttttatctttttcagcagaagatgactcaagaccggcctctgcttgccgtgcaggaggcgctgaagaagtgcttccccgtggtggaggagcagcagggcctgtggcagagtgccctgcgggactgccagcccctcctgtcctccctcagcaacctggcggaacagctgcaggccgcacagaacctgcggtttgaggatgtgccggcgcttcgggccttcccagatttaaaagagcggctgaggcgtaagcagctggtggctggtgacatcgtcctggacaagctaggggaaaggctgtaagcagctccctagtgctgtttcttggtggaaggattttaaaacgaggtgttttatatgtagctagtgtca

SEQ ID NO: 22412 - DNA, 216 bp, Homo sapiens
gttattttcaaaatagcattttgatattccaaagttacacattaagagactaaattgctgaataattatttatgaactttaattatttgtaactttcactctcttatggtgatgaaacattggttaaaagatcaagccagacactgtggttcatgcctgtataatcccaacattttgggaggccaaggcaggaggattgcttgagcctcagagttg

SEQ ID NO: 22413 - DNA, 427 bp, Homo sapiens
catttactctcaaacctcctccacccattcccctccatctataacgctttctgcacatctgtaaaaggtatgacttagtgtttggtctgtgaaataaggttaaaaaggaagcatttctttttacattctagctaatgttgatatttttctcatgcttctattagcacataattcagatacattagttttgaagttttgaatcttctctgcttcttgagggctctctgttctagatcaacatgatctgtggaacaccagccaagtcctggggcagaaccctccccgttgtccaaatattactgaatcagttgagttttctctgttgtcaatgaattattccacatgtttctttggctacattttttttggctttctgttcacagtaaatatagcctttgtttttaaaaacttctattatgaaaattcc

SEQ ID NO: 22414 - DNA, 393 bp, Homo sapiens
tgccaggatagtgattgactctgtgtgtgtaaaaatgtgcacacaatttttattttagctgattggggaatacttttccaaagagatgtgatctgagcggagatccagatgataagaaggagcaagccatgaagagatctgaatattttcagagagagggaatagcaagtgcaaagggcctgagatgggaatgagcttggaagtttttcctttgtttctttctttttttttggaacaccaataaggccaattgggctggaacaagaggagtgaagaaaggtgagaatgatatgagatgaagtgggagaataatccaagtctagtgtttacaaggccttgtagccattggccaaagtgtatctatattctagacacctccaaggctgcaagtca

SEQ ID NO: 22415 - DNA, 336 bp, Homo sapiens
caaaattattaaaattgtatacagttactttcaggctatgtgtataagaaacacaaatgaattttgtgtttaaatttgggttctatcccctattcccaaggtgcctgattttatgtatgcagatattccagaatcagaaaaattctgaaatccaaaacacttctggtcccaagctttttgaatatgggatactcaacctgtattgccccatgtttcctttccacttactcttcctaatcatcacctatgtcctttctagggaatagaaagagttaattatgtttttatactggagaatgtttagactgtgattaaacatcacatgaaattatgtga

SEQ ID NO: 22416 - DNA, 2106 bp, Homo sapiens
tgacatgctcccagaatcctggatttggacttcattctggacagcatatgacaaggacgaggacccctattctagccagttaaagctggacagaatttttaaaagcaatgaagccagttccttggatatatccacgggctttgctttgagaaggaactgagtaggcagtgagaagagtcgagtgaagcctggcccgtgagtgcctcaacaactgagatgaacgtcgactcgcttgcaggcaagttgtcactcagcagcgatctgaactatatcctgggttccagaaaaggcagaggttcttaccgaaagcaggggaggaagccgcagcccaaggaggtcgtcacttgccgggaaggtggctcgggccaggctgcactcaaaacccgtgctctgtccacactgctacggggccagagccaaggaagcttccacttcttcccccagacagccccaacagcggctaccccaaggagccagcagccttgtgtcctgggatccccagcccctgcagaatgacccaccaggatctgagcatcacagccaaactcatcaatggaggtgtagcagggctcgtgggggtgacctgcgtgttccccatcgacttggccaagactcgcctgcagaaccagcatgggaaagccatgtacaaaggaatgatcgactgcctgatgaagacggctcgggcggagggcttcttcggcatgtaccgaggggctgcagtgaacctcactctggtcactccagagaaggccatcaagctggcggccaacgactttttccggcggctgctcatggaagatgggatgcagcggaacctgaagatggagatgcttgccgggtgtggggctgggatgtgccaggtcgtggtgacctgtcccatggaaatgctcaagattcagctgcaggatgctggacgcctggccgtccatcatcagggctcggcctcagcaccctccacctccaggtcctacacaactggttcggcttccacccacaggcgcccctctgccaccctcattgcctgggagctgctccgcactcagggcctggctgggctctacaggggcctgggtgccactctcctcagagacattcctttctccatcatctacttcccactgtttgccaaccttaacaacctggggttcaacgagctcgccggtaaggcgtcctttgcacattccttcgtgtcaggctgtgtggcaggttccatagctgcggtcgcagtgacgcctctagatgttctgaaaactcgaatccaaaccctcaagaaaggcctgggcgaggacatgtacagtgggatcaccgactgtgccaggaaactctggattcaggagggaccatctgccttcatgaaaggcgctggctgccgggcactggtcatagcacctctctttgggattgctcaaggggtctattttattgggattggagagcgcatcttaaagtgttttgactagacagagctggaggtcaagtccctgcgcttgccgccctctctctagctgtttcacttagcctagagggggcaagggcaggtggggccactctggcctgcctggtcctctgcgttgtagtgctacctcaatctcgggagaaacagccctatattctaacaagttgagcacagccttcttccccttcgtgtctacactcgttttcctttgtgggcacagctaccaggggcttttggaagcccctaaccacctacttttcaacaaaaatggtactttcgttgtattaattgcaggaccttaacaggtagtcacaatagaagggttgtttctgtattttaacatttctatttcacagtcaaactcggcattcttcagtcagcttgaggatttagcattgttaatcttggactccataacttatgagtcctagcactgattttgaggaaaaggaggatcagaagttcaagggaccgtgaaagccctcagagtcagcacctagtttgagaccaagcaccctttcgaatccctggatggctgagggggctgaggccggctctgactgggcagctcagcccctcccccagagcccagggtcttgcacacccctccctgtaaccaaggaacactctgaaataaaggtgaatggcta

SEQ ID NO: 22417 - DNA, 2570 bp, Homo sapiens
tgacatgctcccagaatcctggatttggacttcattctggacagcatatgacaaggacgaggacccctattctagccagttaaagctggacagaatttttaaaagcaatgaagccagttccttggatatatccacgggctttgctttgagaaggaactgagtaggcagtgagaagagtcgagtgaagcctggcccgtgagtgcctcaacaactgagatgaacgtcgactcgcttgcaggcaagttgtcactcagcagcgatctgaactatatcctgggttccagaaaaggcagaggttcttaccgaaagcaggggaggaagccgcagcccaaggaggtcgtcacttgccgggaaggtggctcgggccaggctgcactcaaaacccgtgctctgtccacactgctacggggccagagccaaggaagcttccacttcttcccccagacagccccaacagcggctaccccaaggagccagcagccttgtgtcctgggatccccagcccctgcagaatgacccaccaggatctgagcatcacagccaaactcatcaatggaggtgtagcagggctcgtgggggtgacctgcgtgttccccatcgacttggccaagactcgcctgcagaaccagcatgggaaagccatgtacaaaggaatgatcgactgcctgatgaagacggctcgggcggagggcttcttcggcatgtaccgaggggctgcagtgaacctcactctggtcactccagagaaggccatcaagctggcggccaacgactttttccggcggctgctcatggaagatgggatgcagcggaacctgaagatggagatgcttgccgggtgtggggctgggatgtgccaggtcgtggtgacctgtcccatggaaatgctcaagattcagctgcaggatgctggacgcctggccgtccatcatcagggctcggcctcagcaccctccacctccaggtcctacacaactggttcggcttccacccacaggcgcccctctgccaccctcattgcctgggagctgctccgcactcagggcctggctgggctctacaggggcctgggtgccactctcctcagagacattcctttctccatcatctacttcccactgtttgccaaccttaacaacctggggttcaacgagctcgccggtaaggcgtcctttgcacattccttcgtgtcaggctgtgtggcaggttccatagctgcggtcgcagtgacgcctctagatgttctgaaaactcgaatccaaaccctcaagaaaggcctgggcgaggacatgtacagtgggatcaccgactgtgccaggaaactctggattcaggagggaccatctgccttcatgaaaggcgctggctgccgggcactggtcatagcacctctctttgggattgctcaaggggtctattttattgggattggagagcgcatcttaaagtgttttgactagacagagctggaggtcaagtccctgcgcttgccgccctctctctagctgtttcacttagcctagagggggcaagggcaggtggggccactctggcctgcctggtcctctgcgttgtagtgctacctcaatctcgggagaaacagccctatattctaacaagttgagcacagccttcttccccttcgtgtctacactcgttttcctttgtgggcacagctaccaggggcttttggaagcccctaaccacctacttttcaacaaaaatggtactttcgttgtattaattgcaggaccttaacaggtagtcacaatagaagggttgtttctgtattttaacatttctatttcacagtcaaactcggcattcttcagtcagcttgaggatttagcattgttaatcttggactccataacttatgagtcctagcactgattttgaggaaaaggaggatcagaagttcaagggaccgtgaaagccctcagagtcagcacctagtttgagaccaagcaccctttcgaatccctggatggctgagggggctgaggccggctctgactgggcagctcagcccctcccccagagcccagggtcttgcacacccctccctgtaaccaaggaacactctgaaataaaggtgaatggctaaaatctcatctgttcatcagtgggtacagcagataggctgcagtgaatgctatcaccatctacttttctacgtccatttcaaaaccaaacattaaaaagggcatagaagcagacccccgtcactcttcaaactgttacttgtgggggtggaggaacacagccatagggaaatatctgcttgttagtgacactgggttttaagccttgattctatcccttcataagtgaatcgtcttgaggagctgagtttgctgtgagagccctcctcacgcacctcgattcctcccccaaaggctgctacaggagagataatgtcacagcagcagggccaagtcctaagaactgggctaacaaggaagaggatggtgctaacatggtcagccctgggggcctcactctctgttatgagaactgcatttgagtatgggccctggagacagacctcagttcaagtcccagctcca

SEQ ID NO: 22418 - DNA, 2644 bp, Homo sapiens
tgacatgctcccagaatcctggatttggacttcattctggacagcatatgacaaggacgaggacccctattctagccagttaaagctggacagaatttttaaaagcaatgaagccagttccttggatatatccacgggctttgctttgagaaggaactgagtaggcagtgagaagagtcgagtgaagcctggcccgtgagtgcctcaacaactgagatgaacgtcgactcgcttgcaggcaagttgtcactcagcagcgatctgaactatatcctgggttccagaaaaggcagaggttcttaccgaaagcagatggaggctcgctgtgtcacccaggctggagtgcagtggtgcgatctcggctccctgcaagttctgcctcccaggggaggaagccgcagcccaaggaggtcgtcacttgccgggaaggtggctcgggccaggctgcactcaaaacccgtgctctgtccacactgctacggggccagagccaaggaagcttccacttcttcccccagacagccccaacagcggctaccccaaggagccagcagccttgtgtcctgggatccccagcccctgcagaatgacccaccaggatctgagcatcacagccaaactcatcaatggaggtgtagcagggctcgtgggggtgacctgcgtgttccccatcgacttggccaagactcgcctgcagaaccagcatgggaaagccatgtacaaaggaatgatcgactgcctgatgaagacggctcgggcggagggcttcttcggcatgtaccgaggggctgcagtgaacctcactctggtcactccagagaaggccatcaagctggcggccaacgactttttccggcggctgctcatggaagatgggatgcagcggaacctgaagatggagatgcttgccgggtgtggggctgggatgtgccaggtcgtggtgacctgtcccatggaaatgctcaagattcagctgcaggatgctggacgcctggccgtccatcatcagggctcggcctcagcaccctccacctccaggtcctacacaactggttcggcttccacccacaggcgcccctctgccaccctcattgcctgggagctgctccgcactcagggcctggctgggctctacaggggcctgggtgccactctcctcagagacattcctttctccatcatctacttcccactgtttgccaaccttaacaacctggggttcaacgagctcgccggtaaggcgtcctttgcacattccttcgtgtcaggctgtgtggcaggttccatagctgcggtcgcagtgacgcctctagatgttctgaaaactcgaatccaaaccctcaagaaaggcctgggcgaggacatgtacagtgggatcaccgactgtgccaggaaactctggattcaggagggaccatctgccttcatgaaaggcgctggctgccgggcactggtcatagcacctctctttgggattgctcaaggggtctattttattgggattggagagcgcatcttaaagtgttttgactagacagagctggaggtcaagtccctgcgcttgccgccctctctctagctgtttcacttagcctagagggggcaagggcaggtggggccactctggcctgcctggtcctctgcgttgtagtgctacctcaatctcgggagaaacagccctatattctaacaagttgagcacagccttcttccccttcgtgtctacactcgttttcctttgtgggcacagctaccaggggcttttggaagcccctaaccacctacttttcaacaaaaatggtactttcgttgtattaattgcaggaccttaacaggtagtcacaatagaagggttgtttctgtattttaacatttctatttcacagtcaaactcggcattcttcagtcagcttgaggatttagcattgttaatcttggactccataacttatgagtcctagcactgattttgaggaaaaggaggatcagaagttcaagggaccgtgaaagccctcagagtcagcacctagtttgagaccaagcaccctttcgaatccctggatggctgagggggctgaggccggctctgactgggcagctcagcccctcccccagagcccagggtcttgcacacccctccctgtaaccaaggaacactctgaaataaaggtgaatggctaaaatctcatctgttcatcagtgggtacagcagataggctgcagtgaatgctatcaccatctacttttctacgtccatttcaaaaccaaacattaaaaagggcatagaagcagacccccgtcactcttcaaactgttacttgtgggggtggaggaacacagccatagggaaatatctgcttgttagtgacactgggttttaagccttgattctatcccttcataagtgaatcgtcttgaggagctgagtttgctgtgagagccctcctcacgcacctcgattcctcccccaaaggctgctacaggagagataatgtcacagcagcagggccaagtcctaagaactgggctaacaaggaagaggatggtgctaacatggtcagccctgggggcctcactctctgttatgagaactgcatttgagtatgggccctggagacagacctcagttcaagtcccagctcca

SEQ ID NO: 22419 - DNA, 1508 bp, Homo sapiens
gatctgcccacctcagcctcccaaggtgctgggattacaggcgtgagccactgcgcccggcctatgagtcagttttatatgtggtggctctacaggagggcccagccccttagtgttgaggggaggacaccgaaagtaagctgttcactacttactttaacttttacttgatttagttctttctgaaaactcgaatccaaaccctcaagaaaggcctgggcgaggacatgtacagtgggatcaccgactgtgccaggaaactctggattcaggagggaccatctgccttcatgaaaggcgctggctgccgggcactggtcatagcacctctctttgggattgctcaaggggtctattttattgggattggagagcgcatcttaaagtgttttgactagacagagctggaggtcaagtccctgcgcttgccgccctctctctagctgtttcacttagcctagagggggcaagggcaggtggggccactctggcctgcctggtcctctgcgttgtagtgctacctcaatctcgggagaaacagccctatattctaacaagttgagcacagccttcttccccttcgtgtctacactcgttttcctttgtgggcacagctaccaggggcttttggaagcccctaaccacctacttttcaacaaaaatggtactttcgttgtattaattgcaggaccttaacaggtagtcacaatagaagggttgtttctgtattttaacatttctatttcacagtcaaactcggcattcttcagtcagcttgaggatttagcattgttaatcttggactccataacttatgagtcctagcactgattttgaggaaaaggaggatcagaagttcaagggaccgtgaaagccctcagagtcagcacctagtttgagaccaagcaccctttcgaatccctggatggctgagggggctgaggccggctctgactgggcagctcagcccctcccccagagcccagggtcttgcacacccctccctgtaaccaaggaacactctgaaataaaggtgaatggctaaaatctcatctgttcatcagtgggtacagcagataggctgcagtgaatgctatcaccatctacttttctacgtccatttcaaaaccaaacattaaaaagggcatagaagcagacccccgtcactcttcaaactgttacttgtgggggtggaggaacacagccatagggaaatatctgcttgttagtgacactgggttttaagccttgattctatcccttcataagtgaatcgtcttgaggagctgagtttgctgtgagagccctcctcacgcacctcgattcctcccccaaaggctgctacaggagagataatgtcacagcagcagggccaagtcctaagaactgggctaacaaggaagaggatggtgctaacatggtcagccctgggggcctcactctctgttatgagaactgcatttgagtatgggccctggagacagacctcagttcaagtcccagctcca

SEQ ID NO: 22420 - DNA, 1432 bp, Homo sapiens
gatctgcccacctcagcctcccaaggtgctgggattacaggcgtgagccactgcgcccggcctatgagtcagttttatatgtggtggctctacaggagggcccagccccttagtgttgaggggaggacaccgaaagtaagctgttcactacttactttaacttttacttgatttagttctgaaactctggattcaggagggaccatctgccttcatgaaaggcgctggctgccgggcactggtcatagcacctctctttgggattgctcaaggggtctattttattgggattggagagcgcatcttaaagtgttttgactagacagagctggaggtcaagtccctgcgcttgccgccctctctctagctgtttcacttagcctagagggggcaagggcaggtggggccactctggcctgcctggtcctctgcgttgtagtgctacctcaatctcgggagaaacagccctatattctaacaagttgagcacagccttcttccccttcgtgtctacactcgttttcctttgtgggcacagctaccaggggcttttggaagcccctaaccacctacttttcaacaaaaatggtactttcgttgtattaattgcaggaccttaacaggtagtcacaatagaagggttgtttctgtattttaacatttctatttcacagtcaaactcggcattcttcagtcagcttgaggatttagcattgttaatcttggactccataacttatgagtcctagcactgattttgaggaaaaggaggatcagaagttcaagggaccgtgaaagccctcagagtcagcacctagtttgagaccaagcaccctttcgaatccctggatggctgagggggctgaggccggctctgactgggcagctcagcccctcccccagagcccagggtcttgcacacccctccctgtaaccaaggaacactctgaaataaaggtgaatggctaaaatctcatctgttcatcagtgggtacagcagataggctgcagtgaatgctatcaccatctacttttctacgtccatttcaaaaccaaacattaaaaagggcatagaagcagacccccgtcactcttcaaactgttacttgtgggggtggaggaacacagccatagggaaatatctgcttgttagtgacactgggttttaagccttgattctatcccttcataagtgaatcgtcttgaggagctgagtttgctgtgagagccctcctcacgcacctcgattcctcccccaaaggctgctacaggagagataatgtcacagcagcagggccaagtcctaagaactgggctaacaaggaagaggatggtgctaacatggtcagccctgggggcctcactctctgttatgagaactgcatttgagtatgggccctggagacagacctcagttcaagtcccagctcca

SEQ ID NO: 22421 - DNA, 261 bp, Homo sapiens
tgttgaggggaggacaccgaaagtaagctgttcactacttactttaacttttacttgatttagttctttctgaaaactcgaatccaaaccctcaagaaaggcctgggcgaggacatgtacagtgggatcaccgactgtgccaggtgagagccagtgtcccctcaaatggtggctgggacaggttcctctgcgtgggtgtctgcctagaccagatttagagaccaacttgaattgctgggctctgggtttctttgaagtctg

SEQ ID NO: 22422 - DNA, 756 bp, Homo sapiens
ctcccccagagcccagggtcttgcacacccctccctgtaaccaaggaacactctgaaataaaggtgaatggctaaaatctcatctgttcatcagtgggtacagcagataggctgcagtgaatgctatcaccatctacttttctacgtccatttcaaaaccaaacattaaaaagggcatagaagcagacccccgtcactcttcaaactgttacttgtgggggtggaggaacacagccatagggaaatatctgcttgttagtgacactgggttttaagccttgattctatcccttcataagtgaatcgtcttgaggagctgagtttgctgtgagagccctcctcacgcacctcgattcctcccccaaaggctgctacaggagagataatgtcacagcagcagggccaagtcctaagaaaatcagcacctgctgcaggagctggtgtttacaatagtcccatctactgtgaaacctgggctaacaaggaagaggatggtgctaacatggtcagccctgggggcctcactctctgttatgagaactgcatttgagtatgggccctggagacagacctcagttcaagtcccagctccaccatgtactagctgcaaggccctgggcagctcttagtcgtcacctacggaaaaataaaacatgggacagggaaggaagaacagggcctctgtgaaaggatctggttccagcacacagtgacctgctccaaaataactcggttttttgggtctggcgccgtggc

SEQ ID NO: 22423 - DNA, 2507 bp, Homo sapiens
tgacatgctcccagaatcctggatttggacttcattctggacagcatatgacaaggacgaggacccctattctagccagttaaagctggacagaatttttaaaagcaatgaagccagttccttggatatatccacgggctttgctttgagaaggaactgagtaggcagtgagaagagtcgagtgaagcctggcccgtgagtgcctcaacaactgagatgaacgtcgactcgcttgcaggcaagttgtcagggaggaagccgcagcccaaggaggtcgtcacttgccgggaaggtggctcgggccaggctgcactcaaaacccgtgctctgtccacactgctacggggccagagccaaggaagcttccacttcttcccccagacagccccaacagcggctaccccaaggagccagcagccttgtgtcctgggatccccagcccctgcagaatgacccaccaggatctgagcatcacagccaaactcatcaatggaggtgtagcagggctcgtgggggtgacctgcgtgttccccatcgacttggccaagactcgcctgcagaaccagcatgggaaagccatgtacaaaggaatgatcgactgcctgatgaagacggctcgggcggagggcttcttcggcatgtaccgaggggctgcagtgaacctcactctggtcactccagagaaggccatcaagctggcggccaacgactttttccggcggctgctcatggaagatgggatgcagcggaacctgaagatggagatgcttgccgggtgtggggctgggatgtgccaggtcgtggtgacctgtcccatggaaatgctcaagattcagctgcaggatgctggacgcctggccgtccatcatcagggctcggcctcagcaccctccacctccaggtcctacacaactggttcggcttccacccacaggcgcccctctgccaccctcattgcctgggagctgctccgcactcagggcctggctgggctctacaggggcctgggtgccactctcctcagagacattcctttctccatcatctacttcccactgtttgccaaccttaacaacctggggttcaacgagctcgccggtaaggcgtcctttgcacattccttcgtgtcaggctgtgtggcaggttccatagctgcggtcgcagtgacgcctctagatgttctgaaaactcgaatccaaaccctcaagaaaggcctgggcgaggacatgtacagtgggatcaccgactgtgccaggaaactctggattcaggagggaccatctgccttcatgaaaggcgctggctgccgggcactggtcatagcacctctctttgggattgctcaaggggtctattttattgggattggagagcgcatcttaaagtgttttgactagacagagctggaggtcaagtccctgcgcttgccgccctctctctagctgtttcacttagcctagagggggcaagggcaggtggggccactctggcctgcctggtcctctgcgttgtagtgctacctcaatctcgggagaaacagccctatattctaacaagttgagcacagccttcttccccttcgtgtctacactcgttttcctttgtgggcacagctaccaggggcttttggaagcccctaaccacctacttttcaacaaaaatggtactttcgttgtattaattgcaggaccttaacaggtagtcacaatagaagggttgtttctgtattttaacatttctatttcacagtcaaactcggcattcttcagtcagcttgaggatttagcattgttaatcttggactccataacttatgagtcctagcactgattttgaggaaaaggaggatcagaagttcaagggaccgtgaaagccctcagagtcagcacctagtttgagaccaagcaccctttcgaatccctggatggctgagggggctgaggccggctctgactgggcagctcagcccctcccccagagcccagggtcttgcacacccctccctgtaaccaaggaacactctgaaataaaggtgaatggctaaaatctcatctgttcatcagtgggtacagcagataggctgcagtgaatgctatcaccatctacttttctacgtccatttcaaaaccaaacattaaaaagggcatagaagcagacccccgtcactcttcaaactgttacttgtgggggtggaggaacacagccatagggaaatatctgcttgttagtgacactgggttttaagccttgattctatcccttcataagtgaatcgtcttgaggagctgagtttgctgtgagagccctcctcacgcacctcgattcctcccccaaaggctgctacaggagagataatgtcacagcagcagggccaagtcctaagaactgggctaacaaggaagaggatggtgctaacatggtcagccctgggggcctcactctctgttatgagaactgcatttgagtatgggccctggagacagacctcagttcaagtcccagctcca

SEQ ID NO: 22424 - DNA, 724 bp, Homo sapiens
ttgaactaataattaaagtttctttacattagctatcttaggagatttctcctcttctccctcccccctggtttttttcagaaacattgttctgggagaaaaatcccagttatctgaattcatcaagtcaaaaccataagtcattgaagaaagcattaggtgataatttttatccttatgaaaaagcattttatttaatgaatttcagatatagtgtagtgctaaataagtttttttctctccttttaatgagatatgtgttttatgttcttcattttcagatgaagaaattgaagcccagaaaaattaagtaacttgtccaaatccaaacagatgagttcaaatcatgatgactttttagtggcttgaagacattttgtgtaacatttcagcttcaataagaagacgggagccttggtgcaaggatgttttactgggagcctacagtggagctcagaaagtcatgttccggctggacgcagtggcttatgcctacaatcccagcactttgggaggccaaggcaggtggattgcttgagctcaggagttcaagaccagcctgggcgacatggtgaaactccatctctgcaaaaagtacaaaaaattagccaggtgtcatgaggtgcaactgtggtcccagctacttgatgggctgaggcaggagaatcccttgagcccaggaggttgaggctgcagtgagccgtgttggagtgagaccctgtct

SEQ ID NO: 22425 - DNA, 318 bp, Homo sapiens
atatgaatggaaatatggatttttgttagagaattatacatgaatagttcaataggtgttttcgtaaacctcttcactagttcttagaaagaagactcaataatttgagtttttaaaacttgagggacatactaaccagggagttcctgcatgcagactatttttaatacaagctgtcatattcttgggtggtgagaactacagaaataatttcaaattcctaaaatattgttcggtgaaaggtttggagcttgtaaaacgttctgcgaataaaataactaatatgcttctaagatactacaataacctgaagctctg

SEQ ID NO: 22426 - DNA, 405 bp, Homo sapiens
agcagcgtgatctcagctcactgcaacctctgcctaccaggctcaagagatcctcccatctcagcctcccatgtagctgggactagaggcatgtaccagcacaccaagctaatttttgtatttcttgagatggtgttttgccatgttgcccaggctggtctcaaactcctggattcaagccatccgcctgcctcagcctcccaaagtgttggcattacaggcatgagccactgcaccttgcttaacccagagatgttaagtgacttacttcttttttttttttttttttttttgtgactgagtcttgctctgttgcccgggctggagtgcagtggcacaatctcagctcactgcaacctccagctcccaggttcaagcaattctcctgcctcagcctcccggata

SEQ ID NO: 22427 - DNA, 439 bp, Homo sapiens
acataacgaacttctctctcagcctggacctgtgctggaaaagagtttgacgcccactaaaacaggcatttcactgtgaattagaaagcctctggagaagagactttatgtaaatgtgtgttctcagtgtggaattgttcttccatgtttacaattgtttgtgtgtctttttctctgtgccaaatttcaggtgactggagactgattagctggtctgtgctatccttactccactttagccaacacattgcacattcttacctccaaagtggcaaaaaatgcaaatgtgtatcattatgctttattagctttagtaaaaagtttgccatattaaaggttaaaatttttggcaattttttgtactcctcgaatatctaattatttagattaaaataattatataattattctagttacctttcttgaatttaagtcttaa

SEQ ID NO: 22428 - DNA, 381 bp, Homo sapiens
tgattaaatttttcttttggtctttcagattgagaaagtaaggagaataggcatacatggtgggaaatttctatcaacttggaaaaaacaatagaatacataattcttagccactgagatgagagcccaggaagtcacaaggtcaaaggatcctgtcccattgtctgtggtgacagcctgtcctcccactataaggaatgccttacccttaaacaatggaagtgtccctgagaagttgaagaaatgcatgctgatggaattttaaaaatcatatcattgtagaagtactccagtgattatacttttctgtattttccattttttttttttttagtgagagtgtattctgtttataataaaaacagaaatcagaaaaatatt

SEQ ID NO: 22429 - DNA, 682 bp, Homo sapiens
gtcacgagatgctaaaacttcacttgcattgcctgttaaattgtctaagcctagctaaacttactttgaaaatatttttaaaaatgagaactcaaatattaaaccagtttttatttcttcatgctaaaagagtttagtgtgacattcctgcaactcaactttcttataaagtcagtggtgctttttgtgtagttatctgaaaataaaaggagagtgctgaagttgaatatagaaatataagtacgcacaggatgccttctggcattgctttaagaaatctgttttcttggtattgagcagtaaaatcaacttttttatggtttatttagaatttaaaataccagtaaactagatctgatatagaagatgtcagtggaaaaaaatgaaaacaaaatcataataaaagtaagaaaaatttaattgatgatggattattaatgctcaaagaaaaataattaaaggaaagatttctacaagaccatctttaagttagttactttctagttagtgtcaggtgagacaaactccacgttttattttgtttcgtttacagttagattaacttttgtttggttaactttttattttaagttgacagataaaaattttacataattagagtgtacagtatgatgtgttcatgggtaatgagttttaatgacatgatcatgaaaagattgct

SEQ ID NO: 22430 - DNA, 319 bp, Homo sapiens
gaaccattttctgcatggcagattcttgccaaacacccagtgtcgtacaattgctggacagaggccagtcttagagcaattgctggtagtcactgtaacaaaagttgttttataatttttctaagatgttaagactatttgaaaatagtgaagaacaccattcatcttttcattacttggctgaacaaaaaaagagaaggtcattctacgtgatgaaagtcattgtcgtttgatattcaagcctcaaaaagaagaaacttgggggaaaggaaataaaatgtctgtgtttttaggggactattcagtggtgacgtcttat

SEQ ID NO: 22431 - DNA, 175 bp, Homo sapiens
agatgagttgcctttctcttgcagctttcaaaattctgtctcttgagttttgacaatttaattataataagtcttgatgtagacttctttaactgttgtggggttctatgagcttgagtctggatatctgttttgttctccatatttaggaagttttgggttatttctttaaaaa

SEQ ID NO: 22432 - DNA, 334 bp, Homo sapiens
ttgatattcttgatttgaagaatttgattttagacaacagtgtatttgaggcaatggatgggatattcatgcaggcacccagtttcaatttgtccctagagcctgaaaaacagatcaaggtcagagcctaaaaagtgtagagttcttccatattgttgaagccatgaaaatggctaagcttcaataaggtgaacttatagtggtaaaaacagaaggctatgaactcaacatttattttattttattttattttgaattatttaaaagtagtataattaaggtaagaaattaaaacagttcaaaagtatataaaggagaggcaactactatcttc

SEQ ID NO: 22433 - DNA, 451 bp, Homo sapiens
taacttgtccctactgctaggcctgaataactggcccaaggaagagctcatatcagtctgtattgtaaaagaatcgtagacagtaattgcttacacagctcagggaaatgtaataaccagatgtttcagataatgagactattcccacagaattccagaaaatgaaaatgtcaagtaggaaggcagatgaccttcctcaatttcttgaataaaggtgctatataaacagttgaagtcttcgcccactcaactcaagaaaactgattttacatataagcaacttggtcatctcaactttgctatgcaatcaagtaaagagtaaatatataacaaaacagataaatgaatggaccagtagagataaatatataaatggacagttacaaatgattataagaacaccatctatgcaccaagagtctagctgtgagtgaggatgaagcaagacaca

SEQ ID NO: 22434 - DNA, 335 bp, Homo sapiens
tttgagtcttctctcttttttttcttagtctaagtaaaggcttttaaattctatattgtcaaaacaccacgatttgttttgttgatcttttgtattacttttctagtctctatttctgctcaggttttttcttttttcttcttcagagatgggggtctcactctgttacccaggcgggagtgtagcagtgcaatcatagctcactgtagattttaactcctggactcaagggttttctccacctcagcttcccaagtagctagaatctcaggtgcacagaaccatgccttgctaaattctttatttttgtagagactgggtcttattgtgttgcc

SEQ ID NO: 22435 - DNA, 409 bp, Homo sapiens
tgagtactatttacatatcacaactatttggatgattaagctctactactgtccccattttacagatgagaagacaacatgggaaggacaagtaggtcatacagagatacctctttagtaggtgatagagcaaaattctaaccctggtttgtgtaacccacagcatctgcttttaactagttggttatactgtctccagccagaaccttgttaacttgggaagagggtgcagagagacacatttattacaaactcacatgattgggtttgatgtgttagtgtgatgcattaaaaaagaataaggcctcagtcagacctgaaattgaaaccaagatcttctgtcttctagctgtatgcctcagggtagtttcaattttctcatgtgtaaatagaggtaatactaccagtc

SEQ ID NO: 22436 - DNA, 514 bp, Homo sapiens
atttgcttaataccctgtacatatctttgatttcaacccttagtacatgtggcttggtcactttgtggctaagataagaaagtgcttgtggaagacaagtctgtggcttggtgagtctgcgtggccagcagtctctgatctgtgcagggtattaatacgtcagggctgcgtgttctgggatttctctggaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaaccaaaaaaaaaa

SEQ ID NO: 22437 - DNA, 687 bp, Homo sapiens
gagtttttgaattttctcaggtgtgttttttttatagctgggtgatttcaaacagaatttcaaggcttagcttttagagtgctgccaagaaaaaggagagaaaaaatctccatttcatttttgctgtagaaaatgaatacatttccatgagaaaatgcggtaggtaattggtgagttacgtagattcataaaaacgtaagttcctttttttgcaaggtaaatttttgacagtgaatatctctgttcaaatcctgttatcttgatttgtgagtttcatgctaaatattatgagatgaaacttgatactgcctggaagtgttttcatatgactcattgttaactgcatgatttttagtggaattaatagaataagacatttattttctaaaagaaatagatacttttgcttttcttattaaggtatacaatataagcaacttggccgggcgcggtggctcatgcctgtaatcccagcactttgggagtctgaggcgagtagatcacaaggtcaagagatcaagaccatcctgaccaacatggtgaaaccctgcctctactaaaaatagaaaaattagctgggcatggtggcacgcacctgtagtcccagctacttgggaggctgaggcaggagaatggcttaaacctaagaggttgaggttgtagtgagccaagattgtaccactgtac

SEQ ID NO: 22438 - DNA, 705 bp, Homo sapiens
tagtaagagaggttgttaaatgccccagaggtcttctgaacatccataggaaataaagttaagtttaattctcatattctatgtaagaatagagttccaatgtcaaatgggatattagaaatgtaagtgcctcagtgtttactgttcataaatttgagaacagggtttgataagggataagtggaattctggcagatttacttgtaggttattgtgagtttatcataattttgacaacaaaaaaaaactccacagtatgttgaaatgcatttcttcattttattcaataatttttcaagatttttagaaatatttttaaaaatctaaattaagaagtttatttttggcatatatatatactagttttcaaaacttgtactccttttctgtaatcccagctatttgggaggctaaggcgggaggattggttgagcccgggagttcgaggctatagtgagccatgagagctatgatcactcaactgcattccattgtgggcaacagaatgagaccctatctctacaaaaaaccttcaactccaaagtagattaaatatgacaaatttatgttgcaaattaaccagtaaatctaaaggaactccacaaaggaaatttcaccattgatttatttaggccagattgggttgattgatatccttgtttctggtgattggtaaatgaaaaaaaaaaaaaaaaaaaaaaagca

SEQ ID NO: 22439 - DNA, 356 bp, Homo sapiens
acaaataattttttaaaaattatccaggcatgatggtgcatatctgtagtcctagctactcaggtggctgaggcagaaagattccttaagcacaggaattaaaaattactgtgagctatgtttatgccattgcactttagcctgagtgacagagaccctgtctcagaaatttcaaaatatcatttaactttgtttttgcttgttaattaggtacaataacaatacattcaaaataagaatatatttccatgatatttggcgaggaaatatatttggttagatgtacaaaaaactattgaagaataaaatcgatgaattcaataatattaaaacttaaaactcatataccaaaaaaa

SEQ ID NO: 22440 - DNA, 437 bp, Homo sapiens
taaatgtccatatcccctactagcctataagctccatgacttctaggtaccctgtctgactacgtgtatcactgtttctaccgcctaacattgcctagcacattcattgcttcacaggcatctgaatatggttttataaaatacattgctctagtgcacaggattttaagctaaggatttcatgaatgggatttggggtaggggcatctatgaaattcctgaaattgtgtagaattttgagaatatgtgttttcctggggatagagtatgtagtttctcagcaactcattacagtctgtcacatcatgccctaattctacttgcctgtagctaaacacctaataacattagaactgaaatgatagtgatatgcaagatagcacgtgtggtttccacatattctaagaggcatcttcaattagattccaaaaattttt

SEQ ID NO: 22441 - DNA, 737 bp, Homo sapiens
taaatgtccatatcccctactagcctataagctccatgacttctaggtaccctgtctgactacgtgtatcactgtttctaccgcctaacattgcctagcacattcattgcttcacaggcatctgaatatggttttataaaatacattgctctagtgcacaggattttaagctaaggatttcatgaatgggatttggggtaggggcatctatgaaattcctgaaattgtgtagaattttgagaatatgtgttttcctggggatagagtatgtagtttctcagcaactcattacagtctgtcacatcatgccctaattctacttgcctgtagctaaacacctaataacattagaactgaaatgatagtgatacacgtagtcagacaggtggcatcgataaacaccggtgtttatcgatgccactgcacctggccactaatattttttaaatcacactcattaatttattaccatttataagaaaacagcacctttcctctaaaagtggcttaccaatcttcccaagatccatgtaaagggaggtaagcaaggctactgacttcgagacgtacagtgacactacccaccataacttaactggttccattctaggttgtttttttctttcttgtctccaaagtttaaactttattttaggcaatctggtgcttaaaattcccaagcttaagttctctggctttggaataaatatcctgggagggtatttaacccttatttt

SEQ ID NO: 22442 - DNA, 324 bp, Homo sapiens
gattgctaaaaattgggaccaattgtttttaattaaaatgagatatcatggtatttgtagaactatctgaatatttccttaaattgaattacttaataaacattatgcatcttttaatatcttttcctattgtggacacagttcagtgttgtactgaagcttcaaaaatggtaaattattaactctaagaataatttatttgattttaaataatattcaactgttttcctttaaagaaaatgatgctattttttgcttattatgaatactgacctcttttctgcccctaaatgctgacacaaggctgcgttacaggtaaaaaaa

SEQ ID NO: 22443 - DNA, 407 bp, Homo sapiens
acagtagagagctcactactaggaaaggagaggcattcccaacacagagaagtaggggcggacaggtcccgaggctggagggcgtgtgcagatgggtcgggggagcaaggggctgtcagcttcattaaggctgagagcaggcaggagcgaaacagctggctttgctagccagttacacactcaccgctgtccacggatccctgacactggacgactgttgtgccggtggcccccccaggctgctgcagtctgaggagaaaagccagatggtgacactgcgtctctcctgccccttacctccaggcacagtgaggggcccacctgggatataggcatctccccggagctggtcaggcagatggccccagttggggggctgtggacgccgactcctgaccaggaaggcg

SEQ ID NO: 22444 - DNA, 152 bp, Homo sapiens
tgcttctgatgccttggacaagattcgctatgagagcctgacagacccttcaaagttggacagtggtaaagagctgaaaattgacattatcccatcaccctttatttggagaaggaacaagacaaggaaattagtgatgatgaggcagaaga

SEQ ID NO: 22445 - DNA, 1559 bp, Homo sapiens
cagtttcgctttctctctgtctctcagggcatgagaccagccaggcactgggaaacaaggtttggtgccagagattttggtggcttccaagactgctttttcagagacaggctcatggacacagcacggattgcagttgtcggggcaggtgtggtggggctctccacggctgtgtgcatctccaaactggtgccccgatgctccgttaccatcatttcagacaagtttactccagataccaccagtgatgtggcagccggaatgcttattcctcacacttatccagatacacccattcacacgcagaagcagtggttcagagaaacctttaatcacctctttgcaattgccaattctgcagaagctggagatgctggtgttcatttggtatcagggataaagggaagtggaggctggacactcactcggcgaatagaagacctgtgggaacttcatccgtcctttgacatcgtggtcaactgttcaggccttggaagcagacagcttgcaggagactcaaagattttccctgtaaggggccaagtcctccaagttcaggctccctgggtggagcattttatccgagatggcagtgggctgacatatatttatcctggtacatcccatgtaaccctaggtggaactaggcaaaaaggggactggaatctgtccccggatgcagaaaatagcagagagattctttcccgatgctgtgctctggagccctccctccacggagcctgcaacatcagggagaaggtgggcttgaggccctacaggccaggcgtgcgactgcagacagagctccttgcgcgagatggacagaggctgcctgtagtccaccactatggccatgggagtgggggcatctcagtgcactggggcactgctctggaggccgccaggctggtgagcgagtgtgtccatgccctcaggacccccattcccaagtcaaacctgtagatgacataaaatgacagcaaagagactgagagactgttgatcaaagcacagaacaggttcaaataacttttccactgcatgaaagtttaattagacatttctttgttttcaacattagaagtggtgtaacatgtaagctgagcacggtagcatgcctatagtcccagctacttgagaggctgaggcaggaggattgttgagcccaggagtttgagtgcaatctgggtaacattttttagaggtgccagttcccacctctaaaaaaaacaccaacaacaaaagaaatgatgcaacatgtaggcttacttaggaagtccagcattaatggcatagggcataaagctctattttttgttaaaaatacttcttatagagtaaaatttatttagaactgatgtccaaggacctatgcagatttatatgaatgttggaagctatagagattttgatatcatttggcttataaatccacaggaggagataatgtatggaaaacatttaaatcactgtcaattgcagagctgcctgtgatcttcttaggttatagccaagtcagcaacataattcctctaaataaaattacattgtgctcacac

SEQ ID NO: 22446 - DNA, 2135 bp, Homo sapiens
cagtttcgctttctctctgtctctcagggcatgagaccagccaggcactgggaaacaaggtttggtgccagagattttggtggcttccaagactgctttttcagagacaggctcatggacacagcacggattgcagttgtcggggcaggtgtggtggggctctccacggctgtgtgcatctccaaactggtgccccgatgctccgttaccatcatttcagacaagtttactccagataccaccagtgatgtggcagccggaatgcttattcctcacacttatccagatacacccattcacacgcagaagcagtggttcagagaaacctttaatcacctctttgcaattgccaattctgcagaagctggagatgctggtgttcatttggtatcaggttggcagatatttcagagcactccgactgaagaagtgccattctgggctgacgtggttctgggatttcgaaagatgactgaggctgagctgaagaaattcccccagtatgtgtttggtcaggcttttacaaccctgaaatgtgaatgccctgcctacctcccgtggttggagaaaaggataaagggaagtggaggctggacactcactcggcgaatagaagacctgtgggaacttcatccgtcctttgacatcgtggtcaactgttcaggccttggaagcagacagcttgcaggagactcaaagattttccctgtaaggggccaagtcctccaagttcaggctccctgggtggagcattttatccgagatggcagtgggctgacatatatttatcctggtacatcccatgtaaccctaggtggaactaggcaaaaaggggactggaatctgtccccggatgcagaaaatagcagagagattctttcccgatgctgtgctctggagccctccctccacggagcctgcaacatcagggagaaggtgggcttgaggccctacaggccaggcgtgcgactgcagacagagctccttgcgcgagatggacagaggctgcctgtagtccaccactatggccatgggagtgggggcatctcagtgcactggggcactgctctggaggccgccaggctggtgagcgagtgtgtccatgccctcaggacccccattcccaagtcaaacctgtagatgacataaaatgacagcaaagagactgagagactgttgatcaaagcacagaacaggttcaaataacttttccactgcatgaaagtttaattagacatttctttgttttcaacattagaagtggtgtaacatgtaagctgagcacggtagcatgcctatagtcccagctacttgagaggctgaggcaggaggattgttgagcccaggagtttgagtgcaatctgggtaacattttttagaggtgccagttcccacctctaaaaaaaacaccaacaacaaaagaaatgatgcaacatgtaggcttacttaggaagtccagcattaatggcatagggcataaagctctattttttgttaaaaatacttcttatagagtaaaatttatttagaactgatgtccaaggacctatgcagatttatatgaatgttggaagctatagagattttgatatcatttggcttataaatccacaggaggagataatgtatggaaaacatttaaatcactgtcaattgcagagctgcctgtgatcttcttaggttatagccaagtcagcaacataattcctctaaataaaattacattgtgctcacacagtgctggattattacatttaattgaagacaaagcatgcttgctcctagtactagcagcaagcttttcctcccctcagctggtaatgatggtaggagacagagatgaagttgcctatgtatgtcatatcaattcaatagctgcctggggtcaaacacctaggggttgtacattccattactgtaaatgattgagagctggtttgtggtatggttggctttgcctaagcatttttgaagatgaacagcatgtgcagccaaagaactaatttgctaattaaggtggaacaatcattctgaatgaaatataatcagagtactccgcagtttgttaagaagtattggggaggaggggaatgtgtctcacaataaaatgagttggaattgttgagttaaatgaa

SEQ ID NO: 22447 - DNA, 1736 bp, Homo sapiens
cagtttcgctttctctctgtctctcagggcatgagaccagccaggcactgggaaacaaggtttggtgccagagattttggtggcttccaagactgctttttcagagacaggctcatggacacagcacggattgcagttgtcggggcaggtgtggtggggctctccacggctgtgtgcatctccaaactggtgccccgatgctccgttaccatcatttcagacaagtttactccagataccaccagtgatgtggcagccggaatgcttattcctcacacttatccagatacacccattcacacgcagaagcagtggttcagagaaacctttaatcacctctttgcaattgccaattctgcagaagctggagatgctggtgttcatttggtatcaggttggcagatatttcagagcactccgactgaagaagtgccattctgggctgacgtggttctgggatttcgaaagatgactgaggctgagctgaagaaattcccccagtatgtgtttggtcaggcttttacaaccctgaaatgtgaatgccctgcctacctcccgtggttggagaaaaggataaagggaagtggaggctggacactcactcggcgaatagaagacctgtgggaacttcatccgtcctttgacatcgtggtcaactgttcaggccttggaagcagacagcttgcaggagactcaaagattttccctgtaaggggccaagtcctccaagttcaggctccctgggtggagcattttatccgagatggcagtgggctgacatatatttatcctggtacatcccatgtaaccctaggtggaactaggcaaaaaggggactggaatctgtccccggatgcagaaaatagcagagagattctttcccgatgctgtgctctggagccctccctccacggagcctgcaacatcagggagaaggtgggcttgaggccctacaggccaggcgtgcgactgcagacagagctccttgcgcgagatggacagaggctgcctgtagtccaccactatggccatgggagtgggggcatctcagtgcactggggcactgctctggaggccgccaggctggtgagcgagtgtgtccatgccctcaggacccccattcccaagtcaaacctgtagatgacataaaatgacagcaaagagactgagagactgttgatcaaagcacagaacaggttcaaataacttttccactgcatgaaagtttaattagacatttctttgttttcaacattagaagtggtgtaacatgtaagctgagcacggtagcatgcctatagtcccagctacttgagaggctgaggcaggaggattgttgagcccaggagtttgagtgcaatctgggtaacattttttagaggtgccagttcccacctctaaaaaaaacaccaacaacaaaagaaatgatgcaacatgtaggcttacttaggaagtccagcattaatggcatagggcataaagctctattttttgttaaaaatacttcttatagagtaaaatttatttagaactgatgtccaaggacctatgcagatttatatgaatgttggaagctatagagattttgatatcatttggcttataaatccacaggaggagataatgtatggaaaacatttaaatcactgtcaattgcagagctgcctgtgatcttcttaggttatagccaagtcagcaacataattcctctaaataaaattacattgtgctcacac

SEQ ID NO: 22448 - DNA, 1958 bp, Homo sapiens
cagtttcgctttctctctgtctctcagggcatgagaccagccaggcactgggaaacaaggtttggtgccagagattttggtggcttccaagactgctttttcagagacaggctcatggacacagcacggattgcagttgtcggggcaggtgtggtggggctctccacggctgtgtgcatctccaaactggtgccccgatgctccgttaccatcatttcagacaagtttactccagataccaccagtgatgtggcagccggaatgcttattcctcacacttatccagatacacccattcacacgcagaagcagtggttcagagaaacctttaatcacctctttgcaattgccaattctgcagaagctggagatgctggtgttcatttggtatcagggataaagggaagtggaggctggacactcactcggcgaatagaagacctgtgggaacttcatccgtcctttgacatcgtggtcaactgttcaggccttggaagcagacagcttgcaggagactcaaagattttccctgtaaggggccaagtcctccaagttcaggctccctgggtggagcattttatccgagatggcagtgggctgacatatatttatcctggtacatcccatgtaaccctaggtggaactaggcaaaaaggggactggaatctgtccccggatgcagaaaatagcagagagattctttcccgatgctgtgctctggagccctccctccacggagcctgcaacatcagggagaaggtgggcttgaggccctacaggccaggcgtgcgactgcagacagagctccttgcgcgagatggacagaggctgcctgtagtccaccactatggccatgggagtgggggcatctcagtgcactggggcactgctctggaggccgccaggctggtgagcgagtgtgtccatgccctcaggacccccattcccaagtcaaacctgtagatgacataaaatgacagcaaagagactgagagactgttgatcaaagcacagaacaggttcaaataacttttccactgcatgaaagtttaattagacatttctttgttttcaacattagaagtggtgtaacatgtaagctgagcacggtagcatgcctatagtcccagctacttgagaggctgaggcaggaggattgttgagcccaggagtttgagtgcaatctgggtaacattttttagaggtgccagttcccacctctaaaaaaaacaccaacaacaaaagaaatgatgcaacatgtaggcttacttaggaagtccagcattaatggcatagggcataaagctctattttttgttaaaaatacttcttatagagtaaaatttatttagaactgatgtccaaggacctatgcagatttatatgaatgttggaagctatagagattttgatatcatttggcttataaatccacaggaggagataatgtatggaaaacatttaaatcactgtcaattgcagagctgcctgtgatcttcttaggttatagccaagtcagcaacataattcctctaaataaaattacattgtgctcacacagtgctggattattacatttaattgaagacaaagcatgcttgctcctagtactagcagcaagcttttcctcccctcagctggtaatgatggtaggagacagagatgaagttgcctatgtatgtcatatcaattcaatagctgcctggggtcaaacacctaggggttgtacattccattactgtaaatgattgagagctggtttgtggtatggttggctttgcctaagcatttttgaagatgaacagcatgtgcagccaaagaactaatttgctaattaaggtggaacaatcattctgaatgaaatataatcagagtactccgcagtttgttaagaagtattggggaggaggggaatgtgtctcacaataaaatgagttggaattgttgagttaaatgaa

SEQ ID NO: 22449 - DNA, 355 bp, Homo sapiens
caagacacatcatagagaattgcctctcaaggtggagttcttgttggtccttcttaattgcaaatgtgcaaggacagccaaacactaatcccagcctgccctcaaatgaccctaaatattcaggatagtcctgaaataaaagtagtttccaaaagaaaagactgaaaccaggaaagagggaacatggatatttgaaagacatgactctatcttgccagtctgcatttagccctaaacattttcatccacatttgtttgagagtctacagtcctgcccatgagtgccatcagttatctcatgatttgatagacgttccttaccacccccacctgaaattattcttagcactagcct

SEQ ID NO: 22450 - DNA, 530 bp, Homo sapiens
gtcaaatatcacactggaaaccctagcaatttgtgtaggaccctttccagaaggaaggggacttcattggcgtggccttgtgcagggggagtttctcggagtttcagcctgggagtgggccgggcctccctgttctgggctcaccccaccttctccagccactctcgcgtgcacctggcctcaccatgaaaggcgactttctagacggactccccagccaggagacgtctgcgcttctcaggctctttggttttcccttcacatttttgggagttacatgacacccagcagccagcaatcctggcgggctaagaaatacaaagttcagggcctgaggccgctgtggcctccactgtggtttttctggagctctgtttcatttgggctagagtgaacgcttccctccggagaccccagcaggcaggggctgaagaaagttgaaggaacagtcatttccactgtggctgggtgttggtcgtctggcacggaggtagcctgacagcatgcggacagggggccagcgcggccgc

SEQ ID NO: 22451 - DNA, 1874 bp, Homo sapiens
actttaaatcaggcgtgatggctcattcctgtaatctcaagcactttgggaggctaaggtgggtggatctcttgaggtcaggagttcgagaccaacctggccaacgtggtgaaaccccgtctctactaaaaatacaaaattagccgggcatggtggcagctgcctgtaatcccagctactcgggaagctgaggcaggagaattgcttgaacctgggaggtggggattgcagtcagccaagattgttctgcagcatgggtgacaaagtgagacttcgtctcaagtaaataaaactaaaatttttaaatcaaacatgacaaaaatgttaatataattcagaagtaccttgaaattgaaacatatttgtgcaatgatcattaggctttttgtccttgttgttttaaaatgaggcttatacagagtgagttgagagtcaagtagccttcgctgtgagacggtaatgcagttatataatagatacccttgactttgccagattcatcacaatactgcttatacaggaaagttttctcagaaaggaaaatccattagtatcagtcccatcaagccaaacagaatgaagacctttgatagtaatagcaagaggttacaaatagcagggaggaggcgagtagtgaatgtcactgtgattgcaaacccttacctgtattatcacacgtagtcctcacaacaaccttgtgagacaagtgttgtgttcctcattttttcagaggggaacacagacccagagaggttaagaaatttgcccaagataacaagtaaaaggcaaagttggttgcaaaagaggtgtttctgaattcaagggccatactctctctctgacaacatgctctaagtccatagagtaagcactctagtatgaaaaaaagtttcaaggaacgaggccatgaaaatgagactatttgacatctcagatctgtctgggatgttatggaggtttttaaaaataaagttgaaaaaagaaaatgaatcatgtttatacataaaaaaaatcacatgtaacacatttcaagtgtttgaaaataaaaccaaaatctaaactttagtcttcaagcagacattcagtgttactttagaaaactcactgaattaggtggaaatgatggaataatactattcatggccagctattaacacagaagaacatggcagtgtgtgtctggaacggcatgcacaatttgtaaacctttttcaaatatcatttaatcaactcagaataaagtgccctgtagccaacagtgcctctttacttgcttctctgggaaatacatggtactaaattagtagcacaaagtttgggaatatgcaaaataatggataaccatttttcaaaatgtacattctctgaagaggaagcagctggttggacaggatttcttgaagagccaggtgctaagggcatcaggtcgacatccatagtaaccatgtgccataacatctacacatttccacttgttttacagacaaggtaacaggcagaaggaaaatccagagtcttgcagtaagcagatgacaaaacttcaatatgcttgggcaccacttaggtgaccccagggagatttagtgtggccttaggaaagcaaaagagcactttttattggaaatatgagcttgtcactgggaaagatttgtaaaattgatcaagaacttgatttataattatgcctcaaaaaaaaaagttctcatttagtagtggagcaatctagaaaacataccttttttgtttgtttggaagatcctctttccctggctgtattgtagtgtttgctatttgatgtggaaataactaataacttaagattttggaacagaacaccctttagatttccaaaacacaattcttatttcagggaa

SEQ ID NO: 22452 - DNA, 390 bp, Homo sapiens
atgctatgagatctcaaagagctaagtctgtttctcaaaaaatcagaaatagaattaccatatgatccggcagttccacttctgggtgtatacccaaaagacaggaaagcagggacacaaagggatatgtgcacacccataatccttcccatcagcgttactgacgaccactaaaagccagaagcagcccaagtgctcaacaacagatgaacagataaacaaaatgtggtctatccctgtgatgggggttctccagccttggaaggaaattctgacccgtgccacaacatgcatgaacctcaaggacattctgctcagtgaaatgagccagtgacaaaaagatagatgtttcccgattctactcatatgaagtacccagagtagtcaacc

SEQ ID NO: 22453 - DNA, 571 bp, Homo sapiens
atcctactctcatagtgcatggacacgtagacccagtattggaataatgtaggcaccctgtagctaagaatgctctccttgtcttttctgttgccctgaatagttgtaatagagaaaggagtcaacaccaggtattgagtcttcagagagaaaagtacccagtccctatcgtaaacaatccagtggaggatgcaaaaggcttagaaacaatgaccaagccagtagaaaaagcatgtctaatatccagattgtggttttgacatattccattaaagaatacagaacaggctggatgcggtggctcacgcctgtaatcccagcactttgggaggacaagacggacagatcacctgatgtcaggagttcaaaaccagcctggccaacatggtgaaacccccatatctactaaaaatacaaaaattagccgggcgtggcggcacacacctgtaatcccagctacttgggaggctgaggtaggagaatggcttgaactcaggaggcagaagttgcagtgagccgagattgtgccactgcactccagactgggcaaaagagagagactctgtctcaa

SEQ ID NO: 22454 - DNA, 655 bp, Homo sapiens
gtaatgtagcaatttctagctgatgttcacaagcagagagagcccaatcctgccaatcaaatcaagagtgttctctgtttcattgggaattgatgtctttagttaatatactcataagcgttaaaaaaatagcctgtgttctgaattaagtatggaaaatacgtttctgtccaggaaattagttgagatgaaattattttatctgaggaaacagtacagtaaaatttctttccttttggtgtaattttaaagtgttctttctattttaaactcaggcaaaaaatgcactttacaaattgggtgatggaactactttagtagagttaataaatattaaattagtctaggacagtatttatagaaagtaaaaaaaaaaaatcctggtgtgtttgcttagaatttctgatctgtctcttcataattatacttcttagctttcttatttttatctacagttaacatccttccaccattccctctggtagcctgactttgattaaacaatattttaggccaggcgtgttagaaaaaataggccaggtgtggtggcatgcgtctgtagtcccagctactcaggagtctgaagtgggaggatgttttgagcctgggagatcagggccactgtgtgctatgatcacaccactgtactgtagcc

SEQ ID NO: 22455 - DNA, 495 bp, Homo sapiens
gactgccactcgtggtataaggtctgatttggggcatgggctgtggaatcagatctggacccaatgtccgatctatcacttccccgcgcttttttttttagagacggggtctcgctacgttgcccaggctggcctcgaactcctggcttcaagcgacttcccgcctcccgagtagctgggattacaggcgcgccccaccactccctgtggatcggttgcttctcagctcggtgatgtggggtaacttatttcctggcccgcgacccttgtctgcatgaaagagtcaggggtgaataccatcagggggtgcctggagcattacacggggcaatgccgatagataagtcgcgaggatcagccaggcacggagctaagcgattttatgcgcacggcctccacgagatggctcgttttacggatgaggaaactgaggctcggagggtgaggaatctcgtcctagaccccattccggcagaggtcgaggacgcgagcacc

SEQ ID NO: 22456 - DNA, 531 bp, Homo sapiens
gctttgtggtgtcttaatagctgaaacacagcattttgttaataaacaagttgttctcaaactgtagcagtcatcagaatcccctgaggggctaattaaaacgggctgggtgtggtggagtgtgcctgtaggcccagtcactttggaggctgaggtgaaggattgcttgagcctgggagttagagtacagcctgagcaacacagcgataccttgtctcctaaaaaataaaattaaggccgggcacggtggctcaagcctgtaatcccagcactttgggaggccgaggtgggcggatcacctgaggtcaggagttcaagaccagtctgaccaacgtggagaaaccccatctctacaaaaaatacaaaattagccaggtgtggtggcgcatgcctgtaatcccagctactcgggaggctgaggcaggagaatcgcttaaacccaggaggcggaggttgcagtgagctgagatcgcgccattgcactccagcctgggcaagaagagtgaaactccatctcaaaaaataaataaa

SEQ ID NO: 22457 - DNA, 579 bp, Homo sapiens
atggatgtcacccgcttactcctggccaccctgctggtcttcctctgcttcttcactgccaacagccacctgccacctgaggagaagctccgagatgacaggagcctgagaagcaactcctctgtgaacctactggatgtcccttctgtctctattgtggcgctgaacaagaaatccaaacagatcggcagaaaagcagcagaaaagaaaagatcttctaagaaggaggcttcgatgaagaaagtggtgcggccccggacccccctatctgcgccctgcgtggccacccgcaacagctgcaagccgccggcacccgcctgctgcgacccgtgcgcctcctgccagtgccgcttcttccgcagcgcctgctcctgccgcgtgctcagcctcaactgctgagcgcccccactcccggccgcgagcaggcagggcttcggggacgcggggcgcttctcgggcgggtgatccctaacagggcggcttcccagggctgcaggcgggcggaggttccaggagatgggacttcagggagacctggcttgggctaaaatcgaaatacaatatatataggctgctcga

SEQ ID NO: 22458 - DNA, 321 bp, Homo sapiens
ctctgcccaaataaatgaattaatttcattattggaagaaatagttttgttataaaaatgaatttggcttattttgcacatgtgcatgtgttctcctacccttccaacatgagatgacacagcaagaaggccctcaccagatgtgagcgccttgactttgtactttccagtcttcaggactgtaagaaataaaattgacatacttattttaatttataattacatttttataaagttattcatttttggtaataaataatttgttataaataaaatttataaatatataaaatacataaataaatatatataaattgttat

SEQ ID NO: 22459 - DNA, 394 bp, Homo sapiens
ctaattgaattactgccaccttactcaatatcagaatatttagagagtttaactacctctggtgcttttctcttccattgatgaagtaatctcagacctgaatttaactgacattcctgggcaaagaatgtttgataaggccgggtgtggtggctcacgcctgtaatcccagcactttggatggccaagccgggtggatcacctgaggtcaggaattcaagaccagcctgaccaatatggtgaaaccccatctctactaaaaatacaaaaattagccaggtgtggtggcgtgcacctgtagttccagctactcgggaggctgagacaggagaattgcttgaacccgggaggtggagattgcagtgagctgagatcgtgccactgccctccagcc

SEQ ID NO: 22460 - DNA, 153 bp, Homo sapiens
tctgcctcatctccaccatgaccttcccggggacactctcctgtcttggcttctgggaaggagggcaagtctggcttccctcctatctcagtgcccacaactttatccctgcctgcgtctgctcttcctctccagtcctggaatgatgtgtac

SEQ ID NO: 22461 - DNA, 279 bp, Homo sapiens
tcaaagcctattgggtcatttatttcacctagttgatttgcatagtgaaatatttgtgttaaaaaattgtcatctttgggccaggcaagatggctcaaggctaatgaatgaatgatatccgtgatgaaaagcaaagacactacaacatgagcactgtttcaggttcctgcaggagtgtgtgtgtgtgtgtgtgtgtgtgtattactgtgttagtgtgagtatatagaattgtgtttcattatactctaagtatgaatagttgcctttacagtagaattg

SEQ ID NO: 22462 - DNA, 336 bp, Homo sapiens
tttcttttttcaaaaaaaaaagccttcatattaaaaactaaatgggatttgaggggttttgttgcagtaatgtctctttctgagttatatgcgaactctttctgagttatatgcctaaacgcacgctggtcagaacccatcactgtgtatcagctgacatcatttgggtactcctttaattctgtcaaaagtgaaaaaaaaaaaaagagccacgtaagttgcaataaaaagtcttgttgtccacctacttgattcattcccttttccagctttatgagagccagtattttgcatctggcatgccagaggtcttcaaccacagggcagagtacaacg

SEQ ID NO: 22463 - DNA, 181 bp, Homo sapiens
gggaggtggaggttgcagtgagcagagattgcgcctgggtgacacagcaagaccctgtctggaaaaaaaaaaaaaaggaaaagagggaagagagtcttgattgatgatttttatcaatttccttccacatgcattgggagctggtctcacatgatctgaatggtgccagggaaattttttt

SEQ ID NO: 22464 - DNA, 5769 bp, Homo sapiens
agcggaaaaggagcagcggccggggcggcagcggtccccaggccgggacacccggggtggtgcgcccgggttcgcgggggctgcgccggcgccggggaggcggggggagcgggagcgggcgacgcggggaaggggggagccagggggagggcgccggccggaggaggggcggacccgcccgccctagccgagcagagcacagccgagccgagcggcccgggcgggggccgaccccggccagcgtcggcgcagagagcgggcggaggcgcaggccatgctgcggctggtgcccaccggggcccgggccatcgtggacatgtcgtacgcccgccacttcctggacttccagggctccgccattccccaagccatgcagaagctggtggtgacccggctgagccccaacttccgcgaggccgtcaccctgagccgggactgcccggtgccgctccccggggacggagacctcctcgtccggaaccgatttgttggtgttaatgcatctgacatcaactattcagcaggccgctatgacccctcagttaagcctccctttgacataggtttcgaaggcattggggaggtggtggccctaggcctctctgctagtgccagatacacagttggccaagctgtggcttacatggcacctggttcttttgctgagtacacagttgtgcctgccagcattgcaactccagtgccctcagtgaaacccgagtatcttaccctgctggtaagtggcaccaccgcatacatcagcctgaaagagctcggaggactgtcggaagggaaaaaagttttggtgacagcagcagctgggggaacgggccagtttgccatgcagctttcaaagaaggcaaagtgccatgtaattggaacctgctcttctgatgaaaagtctgcttttctgaaatctcttggctgtgatcgtcctatcaactataaaactgaacccgtaggtaccgtccttaagcaggagtaccctgaaggtgtcgatgtggtctatgaatctgttgggggagccatgtttgacttggctgtagacgccctggctacgaaagggcgcttgatagtaatagggtttatctctggctaccaaactcctactggcctttcgcctgtgaaagcaggaacattgccagccaaactgctcaagaaatctgccagcgtacagggcttcttcctgaaccattacctttctaagtatcaagcagccatgagccacttgctcgagatgtgtgtgagcggagacctggtttgtgaggtggaccttggagatctgtctccagagggcaggtttactggcctggagtccatattccgtgctgtcaattatatgtacatgggaaaaaacactggaaaaattgtagttgaattacctcactctgtcaacagtaagctgtaaaaacagaacaatgacataaatcaagggagaaagaaaatgggcactttatgtctcagaattactcaaatcaatttatttttagttggtaatggatataatatttcttaaaacaaaagtaaggtgttaatgaataggtctctccttctcctcctcctcctcctcttcccttgggggaaaaaaaaaaatgtgctaataaaacttccctccatggctaagagggaaaacgcttacattcaattctttagtcatggatggtctcgttccagatgttattgttccagggaactaaattcattcctgatgccagatctgatcgagtcagtatgtcttcagcttgatcagattttaaaatcagttttgaaagtggttcccgacttctttgctttgggagaatttggtcttatgctcataagcagttcatgagtgacaagtgtagcaaaagccagccatatattttcagaatctatatcctcaggaaatggtcctttttttttctataaatcaccaaccaactatctaaatggacatttgggggaattccctcccaaatttgattttgttattagaaaaatgattccgtgaacacagatgtgttttgaagaagtagcacgtaatggcttttatctaccatcaacctgataaggcacatgtgaaatggaaatgttctctttcctctgaagcagcaaattaatgttgaaaacttacatagacagaaagtaggttttggaaagggaaaccacagagattagggggacttaaaattaatataggcacaggaaagagaaaagtgtgcgctccattctcagtgggggttcaccacaaaacacgggccccaggagggaagcgctgtctaggcacacggcaaggccttagtaacagcatgctacactgctcgaggtacggtatgtcccatcgccctgtgcaccgtagagacctcagtcatctcaaggaagaatacatttgcttctccttagaggcgttcgaactagaagctatgcgttacctctgattctggaaacagaatagcagccactcattctgcattcccatttttctctccacgtgttctggtggaatgagatgctccttggcactatagcctgatgtcccacattgacccactgaccacacaggaaaagcagcgaaacctgcaccctctcttctgagtcacgcctgtggctcatcggcttccctcttaacctttagtgccctgaagactgctgccgctgtcaccgttgcgctgaaaccccatgggcccgttctgattgaaggtgaagcccaccagattatttttcaaagtcttaggtttcggtgtatctaacctgctcagtaaatatggacgcaattaaagatgctctaggaaatttggggactgtatttaatttttctttccttccatctgaggagcaaggaaatcctactgctgaatagctgttagtatctattttacaagatttactcattttcaggtacctaatgtagctgctagcatgcatgcacaacaatacaatttatatggtaaatggaaccaaataatggcttcactgaatgttatggctgcactgaagggaaatgtcacggtaaatagctgccaaattatggatcatgccgaagtgtcacaactgcactaaagacaaatagcactagaggctattgccactgtgacgcttttgagttatgaagaagggtagcggcctgatgcgaggctctttgtgtcctcattatagcaaagggttactggtgcaggggactaggaaaaacccgtccagtgtggtgcttagttattcatccatccctttcagacctaacagccacagccacacggaaagagactttgcctcacttttacattcacaaacaaacaaaggaggggggagcaggttttatgaatgtaactgtgcacaggaaatgactggtaatggaaaaaatgttgtaataaaataatctaatcaaagaatattattaaatttaacatagtctatgtccaaaaggcttagttgcttcttatgcagatagatgtgtgaaatctaagcagtaatgtactttctccctttgtaaagacttggggagtaaggacattaccaactaaattgcttcttcgaaactgaagtgagtcccggtttgtttcattttaatgggagggtaataaagatgaaagaccaacattttaactgatggatcccttaagctacagaatagaaatttattgtgttttgagggaatatactaaatgcagctatgtaaaaataaaattcaaacgcccaggattaaaataaaatataatctgaaaacctcatgttctctctttccccaaactaagaaagtgcactgcatgctgttttcacttattcttagaaaacaagcatgaaagattccgcccattcagataatgccaaaaatatgtttaaacttttttttattcttttgaaaaatgatttgtaaattgagggtcatagttcagcatcagtttcatcttctgggattattgttcaagaccagcctctaatgggaggtgaaacggtacgatggtctcaacacctttcttctgaactgtaatacatatcacaaaaagtacatccataattcagggcaattgtcagtctttttagagaaggggccagggtggaacaatcccagtgagtaaattatttctcagcgtggacttctctgcatgtcgggcttaaggtcaccagccgggcagggtggaaggagcttgcctctttgagaaaccaaggagtcccagtgatctgttaccatttggttatgacttctaaagagccaaatgctattccttcaagcctgttttgcaggcagaaaataccagcagtgtcatttaggggttcctttgatgatgactactgctgttaactgacctcagcattaaaaaaaaaaaaattcagggaatagtttgcaaagaaatgaaggaagttttgcatgatatattctataacttgtcattatatgatttcatctggatgaagttcctcaggagtaggatagagcctctgtaaatggtcattagtattacattctgtgtttatctaatgaaagtgcagtgacaagtagctgcttcttattaaaatgaaaatcctgcattatgtacttgaggaacattccagctaatgaggatgtaatgtcctcagtacaacgcagaccttctttttgtgttcaccaccacaagatgctggaagcttgacaaatgatatcatttaagacacatgcctgccttagggacctggtttttggcttcctgtttctggcttttatttgggtaacgtttataatggccacccgacttgtacctgggtaatgttttaaccccttccccagagttctcaattagcatgaatttactacagtcagagtttcctttaaattggggtgggggtgctaagcactgaaaatatctttcttgattactttaccatgtggacatatgggataaatactgtatttcagatttacataaaagtagattagtaatgcacagctttcagaataaaaacaatgataaaaaagaccaagcactatcaactttggacagtaatttcctaggtgttaaacaagttttctgaatgcaatctggatgcaaaacggcctgatttgatgaattcataattttcttctgtatactttcattttattaaatattttattacttggttaaacacaagaattatctatgtaaacttcatgggcttttttgttgaaagttagatgttcagtaactaatttcccagttatggcccagaattaaacatttatgatcatatttcagaagtcaaaatacaaaactggattatcaaaacggttggtgtggtcactttaaactggactatcagtatggttgccgtggtcactttaagcgggattatcagtacggttggtgtggtcactttggtttatcatcaatacagttggtgtggtcactttaaactggattaccaatatggttggtgtggtcgctttaaagtttgttttcattttttttctatttttaattcttacgggtatatagaaggtgtatatatttatggggtacatgagatgtcttgaaacaggcatgcaatgtgaaataaataagcacatcatggagaatggggtgtctacctcctcaagcatttatccattgagttgcaaacaatccagctacactcagttatttaaaaatgtacagttattattgcttatagtcaccctgtttgctatcaaatagtaggtcttactctatttttttcattttaaactttgaattttatttttcctaggcttatagcatcatgctatcccccttgtaaaaggaggaatgcttggcatgagaaccttactgctgttaccatgaacaaactatggaatgttgg

SEQ ID NO: 22465 - DNA, 5199 bp, Homo sapiens
tatcagctcggaccttacttcccacgatctctctgctagtgccagatacacagttggccaagctgtggcttacatggcacctggttcttttgctgagtacacagttgtgcctgccagcattgcaactccagtgccctcagtgaaacccgagtatcttaccctgctggtaagtggcaccaccgcatacatcagcctgaaagagctcggaggactgtcggaagggaaaaaagttttggtgacagcagcagctgggggaacgggccagtttgccatgcagctttcaaagaaggcaaagtgccatgtaattggaacctgctcttctgatgaaaagtctgcttttctgaaatctcttggctgtgatcgtcctatcaactataaaactgaacccgtaggtaccgtccttaagcaggagtaccctgaaggtgtcgatgtggtctatgaatctgttgggggagccatgtttgacttggctgtagacgccctggctacgaaagggcgcttgatagtaatagggtttatctctggctaccaaactcctactggcctttcgcctgtgaaagcaggaacattgccagccaaactgctcaagaaatctgccagcgtacagggcttcttcctgaaccattacctttctaagtatcaagcagccatgagccacttgctcgagatgtgtgtgagcggagacctggtttgtgaggtggaccttggagatctgtctccagagggcaggtttactggcctggagtccatattccgtgctgtcaattatatgtacatgggaaaaaacactggaaaaattgtagttgaattacctcactctgtcaacagtaagctgtaaaaacagaacaatgacataaatcaagggagaaagaaaatgggcactttatgtctcagaattactcaaatcaatttatttttagttggtaatggatataatatttcttaaaacaaaagtaaggtgttaatgaataggtctctccttctcctcctcctcctcctcttcccttgggggaaaaaaaaaaatgtgctaataaaacttccctccatggctaagagggaaaacgcttacattcaattctttagtcatggatggtctcgttccagatgttattgttccagggaactaaattcattcctgatgccagatctgatcgagtcagtatgtcttcagcttgatcagattttaaaatcagttttgaaagtggttcccgacttctttgctttgggagaatttggtcttatgctcataagcagttcatgagtgacaagtgtagcaaaagccagccatatattttcagaatctatatcctcaggaaatggtcctttttttttctataaatcaccaaccaactatctaaatggacatttgggggaattccctcccaaatttgattttgttattagaaaaatgattccgtgaacacagatgtgttttgaagaagtagcacgtaatggcttttatctaccatcaacctgataaggcacatgtgaaatggaaatgttctctttcctctgaagcagcaaattaatgttgaaaacttacatagacagaaagtaggttttggaaagggaaaccacagagattagggggacttaaaattaatataggcacaggaaagagaaaagtgtgcgctccattctcagtgggggttcaccacaaaacacgggccccaggagggaagcgctgtctaggcacacggcaaggccttagtaacagcatgctacactgctcgaggtacggtatgtcccatcgccctgtgcaccgtagagacctcagtcatctcaaggaagaatacatttgcttctccttagaggcgttcgaactagaagctatgcgttacctctgattctggaaacagaatagcagccactcattctgcattcccatttttctctccacgtgttctggtggaatgagatgctccttggcactatagcctgatgtcccacattgacccactgaccacacaggaaaagcagcgaaacctgcaccctctcttctgagtcacgcctgtggctcatcggcttccctcttaacctttagtgccctgaagactgctgccgctgtcaccgttgcgctgaaaccccatgggcccgttctgattgaaggtgaagcccaccagattatttttcaaagtcttaggtttcggtgtatctaacctgctcagtaaatatggacgcaattaaagatgctctaggaaatttggggactgtatttaatttttctttccttccatctgaggagcaaggaaatcctactgctgaatagctgttagtatctattttacaagatttactcattttcaggtacctaatgtagctgctagcatgcatgcacaacaatacaatttatatggtaaatggaaccaaataatggcttcactgaatgttatggctgcactgaagggaaatgtcacggtaaatagctgccaaattatggatcatgccgaagtgtcacaactgcactaaagacaaatagcactagaggctattgccactgtgacgcttttgagttatgaagaagggtagcggcctgatgcgaggctctttgtgtcctcattatagcaaagggttactggtgcaggggactaggaaaaacccgtccagtgtggtgcttagttattcatccatccctttcagacctaacagccacagccacacggaaagagactttgcctcacttttacattcacaaacaaacaaaggaggggggagcaggttttatgaatgtaactgtgcacaggaaatgactggtaatggaaaaaatgttgtaataaaataatctaatcaaagaatattattaaatttaacatagtctatgtccaaaaggcttagttgcttcttatgcagatagatgtgtgaaatctaagcagtaatgtactttctccctttgtaaagacttggggagtaaggacattaccaactaaattgcttcttcgaaactgaagtgagtcccggtttgtttcattttaatgggagggtaataaagatgaaagaccaacattttaactgatggatcccttaagctacagaatagaaatttattgtgttttgagggaatatactaaatgcagctatgtaaaaataaaattcaaacgcccaggattaaaataaaatataatctgaaaacctcatgttctctctttccccaaactaagaaagtgcactgcatgctgttttcacttattcttagaaaacaagcatgaaagattccgcccattcagataatgccaaaaatatgtttaaacttttttttattcttttgaaaaatgatttgtaaattgagggtcatagttcagcatcagtttcatcttctgggattattgttcaagaccagcctctaatgggaggtgaaacggtacgatggtctcaacacctttcttctgaactgtaatacatatcacaaaaagtacatccataattcagggcaattgtcagtctttttagagaaggggccagggtggaacaatcccagtgagtaaattatttctcagcgtggacttctctgcatgtcgggcttaaggtcaccagccgggcagggtggaaggagcttgcctctttgagaaaccaaggagtcccagtgatctgttaccatttggttatgacttctaaagagccaaatgctattccttcaagcctgttttgcaggcagaaaataccagcagtgtcatttaggggttcctttgatgatgactactgctgttaactgacctcagcattaaaaaaaaaaaaattcagggaatagtttgcaaagaaatgaaggaagttttgcatgatatattctataacttgtcattatatgatttcatctggatgaagttcctcaggagtaggatagagcctctgtaaatggtcattagtattacattctgtgtttatctaatgaaagtgcagtgacaagtagctgcttcttattaaaatgaaaatcctgcattatgtacttgaggaacattccagctaatgaggatgtaatgtcctcagtacaacgcagaccttctttttgtgttcaccaccacaagatgctggaagcttgacaaatgatatcatttaagacacatgcctgccttagggacctggtttttggcttcctgtttctggcttttatttgggtaacgtttataatggccacccgacttgtacctgggtaatgttttaaccccttccccagagttctcaattagcatgaatttactacagtcagagtttcctttaaattggggtgggggtgctaagcactgaaaatatctttcttgattactttaccatgtggacatatgggataaatactgtatttcagatttacataaaagtagattagtaatgcacagctttcagaataaaaacaatgataaaaaagaccaagcactatcaactttggacagtaatttcctaggtgttaaacaagttttctgaatgcaatctggatgcaaaacggcctgatttgatgaattcataattttcttctgtatactttcattttattaaatattttattacttggttaaacacaagaattatctatgtaaacttcatgggcttttttgttgaaagttagatgttcagtaactaatttcccagttatggcccagaattaaacatttatgatcatatttcagaagtcaaaatacaaaactggattatcaaaacggttggtgtggtcactttaaactggactatcagtatggttgccgtggtcactttaagcgggattatcagtacggttggtgtggtcactttggtttatcatcaatacagttggtgtggtcactttaaactggattaccaatatggttggtgtggtcgctttaaagtttgttttcattttttttctatttttaattcttacgggtatatagaaggtgtatatatttatggggtacatgagatgtcttgaaacaggcatgcaatgtgaaataaataagcacatcatggagaatggggtgtctacctcctcaagcatttatccattgagttgcaaacaatccagctacactcagttatttaaaaatgtacagttattattgcttatagtcaccctgtttgctatcaaatagtaggtcttactctatttttttcattttaaactttgaattttatttttcctaggcttatagcatcatgctatcccccttgtaaaaggaggaatgcttggcatgagaaccttactgctgttaccatgaacaaactatggaatgttgg

SEQ ID NO: 22466 - DNA, 5716 bp, Homo sapiens
agcggaaaaggagcagcggccggggcggcagcggtccccaggccgggacacccggggtggtgcgcccgggttcgcgggggctgcgccggcgccggggaggcggggggagcgggagcgggcgacgcggggaaggggggagccagggggagggcgccggccggaggaggggcggacccgcccgccctagccgagcagagcacagccgagccgagcggcccgggcgggggccgaccccggccagcgtcggcgcagagagcgggcggaggcgcaggccatgctgcggctggtgcccaccggggcccgggccatcgtggacatgtcgtacgcccgccacttcctggacttccagggctccgccattccccaagccatgcagaagctggtggtgacccggctgagccccaacttccgcgaggccgtcaccctgagccgggactgcccggtgccgctccccggggacggagacctcctcgtccggaaccgatttgttggtgttaatgcatctgacatcaactattcagcaggccgctatgacccctcagttaagcctccctttgacataggtttcgaaggcattggggaggtggtggccctaggcctctctgctagtgccagatacacagttggccaagctgtggcttacatggcacctggttcttttgctgagtacacagttgtgcctgccagcattgcaactccagtgccctcagtgaaacccgagtatcttaccctgctggtaagtggcaccaccgcatacatcagcctgaaagagctcggaggactgtcggaagggaaaaaagttttggtgacagcagcagctgggggaacgggccagtttgccatgcagctttcaaagaaggcaaagtgccatgtaattggaacctgctcttctgatgaaaagtctgcttttctgaaatctcttggctgtgatcgtcctatcaactataaaactgaacccgtaggtaccgtccttaagcaggagtaccctgaaggtgtcgatgtggtctatgaatctgttgggggagccatgtttgacttggctgtagacgccctggctacgaaagggcgcttgatagtaatagggtttatctctggctaccaaactcctactggcctttcgcctgtgaaagcaggaacattgccagccaaactgctcaagaaatctgccagcgtacagggcttcttcctgaaccattacctttctaagtatcaagcagccatgagccacttgctcgagatgtgtgtgagcggagacctggtttgtgaggtggaccttggagatctgtctccagagggcaggtttactggcctggagtccatattccgtgctgtcaattatatgtacatgggaaaaaacactggaaaaattgtagttgaattacctcactctgtcaacagtaagctgtaaaaacagaacaatgacataaatcaagggagaaagaaaatgggcactttatgtctcagaattactcaaatcaatttatttttagttggtaatggatataatatttcttaaaacaaaagtaaggtgttaatgaataggtctctccttctcctcctcctcctcctcttcccttgggggaaaaaaaaaaatgtgctaataaaacttccctccatggctaagagggaaaacgcttacattcaattctttagtcatggatggtctcgttccagatgttattgttccagggaactaaattcattcctgatgccagatctgatcgagtcagtatgtcttcagcttgatcagattttaaaatcagttttgaaagtggttcccgacttctttgctttgggagaatttggtcttatgctcataagcagttcatgagtgacaagtgtagcaaaagccagccatatattttcagaatctatatcctcaggaaatggtcctttttttttctataaatcaccaaccaactatctaaatggacatttgggggaattccctcccaaatttgattttgttattagaaaaatgattccgtgaacacagatgtgttttgaagaagtagcacgtaatggcttttatctaccatcaacctgataaggcacatgtgaaatggaaatgttctctttcctctgaagcagcaaattaatgttgaaaacttacatagacagaaagtaggttttggaaagggaaaccacagagattagggggacttaaaattaatataggcacaggaaagagaaaagtgtgcgctccattctcagtgggggttcaccacaaaacacgggccccaggagggaagcgctgtctaggcacacggcaaggccttagtaacagcatgctacactgctcgaggtacggtatgtcccatcgccctgtgcaccgtagagacctcagtcatctcaaggaagaatacatttgcttctccttagaggcgttcgaactagaagctatgcgttacctctgattctggaaacagaatagcagccactcattctgcattcccatttttctctccacgtgttctggtggaatgagatgctccttggcactatagcctgatgtcccacattgacccactgaccacacaggaaaagcagcgaaacctgcaccctctcttctgagtcacgcctgtggctcatcggcttccctcttaacctttagtgccctgaagactgctgccgctgtcaccgttgcgctgaaaccccatgggcccgttctgattgaaggtgaagcccaccagattatttttcaaagtcttaggtttcggtgtatctaacctgctcagtaaatatggacgcaattaaagatgctctaggaaatttggggactgtatttaatttttctttccttccatctgaggagcaaggaaatcctactgctgaatagctgttagtatctattttacaagatttactcattttcaggtacctaatgtagctgctagcatgcatgcacaacaatacaatttatatggtaaatggaaccaaataatggcttcactgaatgttatggctgcactgaagggaaatgtcacggtaaatagctgccaaattatggatcatgccgaagtgtcacaactgcactaaagacaaatagcactagaggctattgccactgtgacgcttttgagttatgaagaagggtagcggcctgatgcgaggctctttgtgtcctcattatagcaaagggttactggtgcaggggactaggaaaaacccgtccagtgtggtgcttagttattcatccatccctttcagacctaacagccacagccacacggaaagagactttgcctcacttttacattcacaaacaaacaaaggaggggggagcaggttttatgaatgtaactgtgcacaggaaatgactggtaatggaaaaaatgttgtaataaaataatctaatcaaagaatattattaaatttaacatagtctatgtccaaaaggcttagttgcttcttatgcagatagatgtgtgaaatctaagcagtaatgtactttctccctttgtaaagacttggggagtaaggacattaccaactaaattgcttcttcgaaactgaagtgagtcccggtttgtttcattttaatgggagggtaataaagatgaaagaccaacattttaactgatggatcccttaagctacagaatagaaatttattgtgttttgagggaatatactaaatgcagctatgtaaaaataaaattcaaacgcccaggattaaaataaaatataatctgaaaacctcatgttctctctttccccaaactaagaaagtgcactgcatgctgttttcacttattcttagaaaacaagcatgaaagattccgcccattcagataatgccaaaaatatgtttaaacttttttttattcttttgaaaaatgatttgtaaattgagggtcatagttcagcatcagtttcatcttctgggattattgttcaagaccagcctctaatgggaggtgaaacggtacgatggtctcaacacctttcttctgaactgtaatacatatcacaaaaagtacatccataattcagggcaattgtcagtctttttagagaaggggccagggtggaacaatcccagtgagtaaattatttctcagcgtggacttctctgcatgtcgggcttaaggtcaccagccgggcagggtggaaggagcttgcctctttgagaaaccaaggagtcccagtgatctgttaccatttggttatgacttctaaagagccaaatgctattccttcaagcctgttttgcaggcagaaaataccagcagtgtcatttaggggttcctttgatgatgactactgctgttaactgacctcagcattaaaaaaaaaaaaattcagggaatagtttgcaaagaaatgaaggaagttttgcatgatatattctataacttgtcattatatgatttcatctggatgaagttcctcaggagtaggatagagcctctgtaaatggtcattagtattacattctgtgtttatctaatgaaagtgcagtgacaagtagctgcttcttattaaaatgaaaatcctgcattatgtacttgaggaacattccagctaatgaggatgtaatgtcctcagtacaacgcagaccttctttttgtgttcaccaccacaagatgctggaagcttgacaaatgatatcatttaagacacatgcctgccttagggacctggtttttggcttcctgtttctggcttttatttgggtaacgtttataatggccacccgacttgtacctgggtaatgttttaaccccttccccagagttctcaattagcatgaatttactacagtcagagtttcctttaaattgggatatgggataaatactgtatttcagatttacataaaagtagattagtaatgcacagctttcagaataaaaacaatgataaaaaagaccaagcactatcaactttggacagtaatttcctaggtgttaaacaagttttctgaatgcaatctggatgcaaaacggcctgatttgatgaattcataattttcttctgtatactttcattttattaaatattttattacttggttaaacacaagaattatctatgtaaacttcatgggcttttttgttgaaagttagatgttcagtaactaatttcccagttatggcccagaattaaacatttatgatcatatttcagaagtcaaaatacaaaactggattatcaaaacggttggtgtggtcactttaaactggactatcagtatggttgccgtggtcactttaagcgggattatcagtacggttggtgtggtcactttggtttatcatcaatacagttggtgtggtcactttaaactggattaccaatatggttggtgtggtcgctttaaagtttgttttcattttttttctatttttaattcttacgggtatatagaaggtgtatatatttatggggtacatgagatgtcttgaaacaggcatgcaatgtgaaataaataagcacatcatggagaatggggtgtctacctcctcaagcatttatccattgagttgcaaacaatccagctacactcagttatttaaaaatgtacagttattattgcttatagtcaccctgtttgctatcaaatagtaggtcttactctatttttttcattttaaactttgaattttatttttcctaggcttatagcatcatgctatcccccttgtaaaaggaggaatgcttggcatgagaaccttactgctgttaccatgaacaaactatggaatgttgg

SEQ ID NO: 22467 - DNA, 3395 bp, Homo sapiens
agcggaaaaggagcagcggccggggcggcagcggtccccaggccgggacacccggggtggtgcgcccgggttcgcgggggctgcgccggcgccggggaggcggggggagcgggagcgggcgacgcggggaaggggggagccagggggagggcgccggccggaggaggggcggacccgcccgccctagccgagcagagcacagccgagccgagcggcccgggcgggggccgaccccggccagcgtcggcgcagagagcgggcggaggcgcaggccatgctgcggctggtgcccaccggggcccgggccatcgtggacatgtcgtacgcccgccacttcctggacttccagggctccgccattccccaagccatgcagaagctggtggtgacccggctgagccccaacttccgcgaggccgtcaccctgagccgggactgcccggtgccgctccccggggacggagacctcctcgtccggaaccgatttgttggtgttaatgcatctgacatcaactattcagcaggccgctatgacccctcagttaagcctccctttgacataggtttcgaaggcattggggaggtggtggccctaggcctctctgctagtgccagatacacagttggccaagctgtggcttacatggcacctggttcttttgctgagtacacagttgtgcctgccagcattgcaactccagtgccctcagtgaaacccgagtatcttaccctgctggtaagtggcaccaccgcatacatcagcctgaaagagctcggaggactgtcggaagggaaaaaagttttggtgacagcagcagctgggggaacgggccagtttgccatgcagctttcaaagaaggcaaagtgccatgtaattggaacctgctcttctgatgaaaagtctgcttttctgaaatctcttggctgtgatcgtcctatcaactataaaactgaacccgtaggtaccgtccttaagcaggagtaccctgaaggtgtcgatgtggtctatgaatctgttgggggagccatgtttgacttggctgtagacgccctggctacgaaagggcgcttgatagtaatagggtttatctctggctaccaaactcctactggcctttcgcctgtgaaagcaggaacattgccagccaaactgctcaagaaatctgccagcgtacagggcttcttcctgaaccattacctttctaagtatcaagcagccatgagccacttgctcgagatgtgtgtgagcggagacctggtttgtgaggtggaccttggagatctgtctccagagggcaggtttactggcctggagtccatattccgtgctgtcaattatatgtacatgggaaaaaacactggaaaaattgtagttgaattacctcactctgtcaacagtaagctgtaaaaacagaacaatgacataaatcaagggagaaagaaaatgggcactttatgtctcagaattactcaaatcaatttatttttagttggtaatggatataatatttcttaaaacaaaagtaaggtgttaatgaataggtctctccttctcctcctcctcctcctcttcccttgggggaaaaaaaaaaatgtgctaataaaacttccctccatggctaagagggaaaacgcttacattcaattctttagtcatggatggtctcgttccagatgttattgttccagggaactaaattcattcctgatgccagatctgatcgagtcagtatgtcttcagcttgatcagattttaaaatcagttttgaaagtggttcccgacttctttgctttgggagaatttggtcttatgctcataagcagttcatgagtgacaagtgtagcaaaagccagccatatattttcagaatctatatcctcaggaaatggtcctttttttttctataaatcaccaaccaactatctaaatggacatttgggggaattccctcccaaatttgattttgttattagaaaaatgattccgtgaacacagatgtgttttgaagaagtagcacgtaatggcttttatctaccatcaacctgataaggcacatgtgaaatggaaatgttctctttcctctgaagcagcaaattaatgttgaaaacttacatagacagaaagtaggttttggaaagggaaaccacagagattagggggacttaaaattaatataggcacaggaaagagaaaagtgtgcgctccattctcagtgggggttcaccacaaaacacgggccccaggagggaagcgctgtctaggcacacggcaaggccttagtaacagcatgctacactgctcgaggtacggtatgtcccatcgccctgtgcaccgtagagacctcagtcatctcaaggaagaatacatttgcttctccttagaggcgttcgaactagaagctatgcgttacctctgattctggaaacagaatagcagccactcattctgcattcccatttttctctccacgtgttctggtggaatgagatgctccttggcactatagcctgatgtcccacattgacccactgaccacacaggaaaagcagcgaaacctgcaccctctcttctgagtcacgcctgtggctcatcggcttccctcttaacctttagtgccctgaagactgctgccgctgtcaccgttgcgctgaaaccccatgggcccgttctgattgaaggtgaagcccaccagattatttttcaaagtcttaggtttcggtgtatctaacctgctcagtaaatatggacgcaattaaagatgctctaggaaatttggggactgtatttaatttttctttccttccatctgaggagcaaggaaatcctactgctgaatagctgttagtatctattttacaagatttactcattttcaggtacctaatgtagctgctagcatgcatgcacaacaatacaatttatatggtaaatggaaccaaataatggcttcactgaatgttatggctgcactgaagggaaatgtcacggtaaatagctgccaaattatggatcatgccgaagtgtcacaactgcactaaagacaaatagcactagaggctattgccactgtgacgcttttgagttatgaagaagggtagcggcctgatgcgaggctctttgtgtcctcattatagcaaagggttactggtgcaggggactaggaaaaacccgtccagtgtggtgcttagttattcatccatccctttcagacctaacagccacagccacacggaaagagactttgcctcacttttacattcacaaacaaacaaaggaggggggagcaggttttatgaatgtaactgtgcacaggaaatgactggtaatggaaaaaatgttgtaataaaataatctaatcaaagaatattattaaatttaacatagtctatgtcca

SEQ ID NO: 22468 - DNA, 2769 bp, Homo sapiens
agcggaaaaggagcagcggccggggcggcagcggtccccaggccgggacacccggggtggtgcgcccgggttcgcgggggctgcgccggcgccggggaggcggggggagcgggagcgggcgacgcggggaaggggggagccagggggagggcgccggccggaggaggggcggacccgcccgccctagccgagcagagcacagccgagccgagcggcccgggcgggggccgaccccggccagcgtcggcgcagagagcgggcggaggcgcaggccatgctgcggctggtgcccaccggggcccgggccatcgtggacatgtcgtacgcccgccacttcctggacttccagggctccgccattccccaagccatgcagaagctggtggtgacccggctgagccccaacttccgcgaggccgtcaccctgagccgggactgcccggtgccgctccccggggacggagacctcctcgtccggaaccgatttgttggtgttaatgcatctgacatcaactattcagcaggccgctatgacccctcagttaagcctccctttgacataggtttcgaaggcattggggaggtggtggccctaggcctctctgctagtgccagatacacagttggccaagctgtggcttacatggcacctggttcttttgctgagtacacagttgtgcctgccagcattgcaactccagtgccctcagtgaaacccgagtatcttaccctgctggtaagtggcaccaccgcatacatcagcctgaaagagctcggaggactgtcggaagggaaaaaagttttggtgacagcagcagctgggggaacgggccagtttgccatgcagctttcaaagaaggcaaagtgccatgtaattggaacctgctcttctgatgaaaagtctgcttttctgaaatctcttggctgtgatcgtcctatcaactataaaactgaacccgtaggtaccgtccttaagcaggagtaccctgaaggtgtcgatgtggtctatgaatctgttgggggagccatgtttgacttggctgtagacgccctggctacgaaagggcgcttgatagtaatagggtttatctctggctaccaaactcctactggcctttcgcctgtgaaagcaggaacattgccagccaaactgctcaagaaatctgccagcgtacagggcttcttcctgaaccattacctttctaagtatcaagcagccatgagccacttgctcgagatgtgtgtgagcggagacctggtttgtgaggtggaccttggagatctgtctccagagggcaggtttactggcctggagtccatattccgtgctgtcaattatatgtacatgggaaaaaacactggaaaaattgtagttgaattacctcactctgtcaacagtaagctgtaaaaacagaacaatgacataaatcaagggagaaagaaaatgggcactttatgtctcagaattactcaaatcaatttatttttagttggtaatggatataatatttcttaaaacaaaagtaaggtgttaatgaataggtctctccttctcctcctcctcctcctcttcccttgggggaaaaaaaaaaatgtgctaataaaacttccctccatggctaagagggaaaacgcttacattcaattctttagtcatggatggtctcgttccagatgttattgttccagggaactaaattcattcctgatgccagatctgatcgagtcagtatgtcttcagcttgatcagattttaaaatcagttttgaaagtggttcccgacttctttgctttgggagaatttggtcttatgctcataagcagttcatgagtgacaagtgtagcaaaagccagccatatattttcagaatctatatcctcaggaaatggtcctttttttttctataaatcaccaaccaactatctaaatggacatttgggggaattccctcccaaatttgattttgttattagaaaaatgattccgtgaacacagatgtgttttgaagaagtagcacgtaatggcttttatctaccatcaacctgataaggcacatgtgaaatggaaatgttctctttcctctgaagcagcaaattaatgttgaaaacttacatagacagaaagtaggttttggaaagggaaaccacagagattagggggacttaaaattaatataggcacaggaaagagaaaagtgtgcgctccattctcagtgggggttcaccacaaaacacgggccccaggagggaagcgctgtctaggcacacggcaaggccttagtaacagcatgctacactgctcgaggtacggtatgtcccatcgccctgtgcaccgtagagacctcagtcatctcaaggaagaatacatttgcttctccttagaggcgttcgaactagaagctatgcgttacctctgattctggaaacagaatagcagccactcattctgcattcccatttttctctccacgtgttctggtggaatgagatgctccttggcactatagcctgatgtcccacattgacccactgaccacacaggaaaagcagcgaaacctgcaccctctcttctgagtcacgcctgtggctcatcggcttccctcttaacctttagtgccctgaagactgctgccgctgtcaccgttgcgctgaaaccccatgggcccgttctgattgaaggtgaagcccaccagattatttttcaaagtcttaggtttcggtgtatctaacctgctcagtaaatatggacgcaattaaagatgctctagg

SEQ ID NO: 22469 - DNA, 3128 bp, Homo sapiens
ctcagatttcagctgcattgtctaacctcctgtcaatctcaatccccaccagattatttttcaaagtcttaggtttcggtgtatctaacctgctcagtaaatatggacgcaattaaagatgctctaggaaatttggggactgtatttaatttttctttccttccatctgaggagcaaggaaatcctactgctgaatagctgttagtatctattttacaagatttactcattttcaggtacctaatgtagctgctagcatgcatgcacaacaatacaatttatatggtaaatggaaccaaataatggcttcactgaatgttatggctgcactgaagggaaatgtcacggtaaatagctgccaaattatggatcatgccgaagtgtcacaactgcactaaagacaaatagcactagaggctattgccactgtgacgcttttgagttatgaagaagggtagcggcctgatgcgaggctctttgtgtcctcattatagcaaagggttactggtgcaggggactaggaaaaacccgtccagtgtggtgcttagttattcatccatccctttcagacctaacagccacagccacacggaaagagactttgcctcacttttacattcacaaacaaacaaaggaggggggagcaggttttatgaatgtaactgtgcacaggaaatgactggtaatggaaaaaatgttgtaataaaataatctaatcaaagaatattattaaatttaacatagtctatgtccaaaaggcttagttgcttcttatgcagatagatgtgtgaaatctaagcagtaatgtactttctccctttgtaaagacttggggagtaaggacattaccaactaaattgcttcttcgaaactgaagtgagtcccggtttgtttcattttaatgggagggtaataaagatgaaagaccaacattttaactgatggatcccttaagctacagaatagaaatttattgtgttttgagggaatatactaaatgcagctatgtaaaaataaaattcaaacgcccaggattaaaataaaatataatctgaaaacctcatgttctctctttccccaaactaagaaagtgcactgcatgctgttttcacttattcttagaaaacaagcatgaaagattccgcccattcagataatgccaaaaatatgtttaaacttttttttattcttttgaaaaatgatttgtaaattgagggtcatagttcagcatcagtttcatcttctgggattattgttcaagaccagcctctaatgggaggtgaaacggtacgatggtctcaacacctttcttctgaactgtaatacatatcacaaaaagtacatccataattcagggcaattgtcagtctttttagagaaggggccagggtggaacaatcccagtgagtaaattatttctcagcgtggacttctctgcatgtcgggcttaaggtcaccagccgggcagggtggaaggagcttgcctctttgagaaaccaaggagtcccagtgatctgttaccatttggttatgacttctaaagagccaaatgctattccttcaagcctgttttgcaggcagaaaataccagcagtgtcatttaggggttcctttgatgatgactactgctgttaactgacctcagcattaaaaaaaaaaaaattcagggaatagtttgcaaagaaatgaaggaagttttgcatgatatattctataacttgtcattatatgatttcatctggatgaagttcctcaggagtaggatagagcctctgtaaatggtcattagtattacattctgtgtttatctaatgaaagtgcagtgacaagtagctgcttcttattaaaatgaaaatcctgcattatgtacttgaggaacattccagctaatgaggatgtaatgtcctcagtacaacgcagaccttctttttgtgttcaccaccacaagatgctggaagcttgacaaatgatatcatttaagacacatgcctgccttagggacctggtttttggcttcctgtttctggcttttatttgggtaacgtttataatggccacccgacttgtacctgggtaatgttttaaccccttccccagagttctcaattagcatgaatttactacagtcagagtttcctttaaattggggtgggggtgctaagcactgaaaatatctttcttgattactttaccatgtggacatatgggataaatactgtatttcagatttacataaaagtagattagtaatgcacagctttcagaataaaaacaatgataaaaaagaccaagcactatcaactttggacagtaatttcctaggtgttaaacaagttttctgaatgcaatctggatgcaaaacggcctgatttgatgaattcataattttcttctgtatactttcattttattaaatattttattacttggttaaacacaagaattatctatgtaaacttcatgggcttttttgttgaaagttagatgttcagtaactaatttcccagttatggcccagaattaaacatttatgatcatatttcagaagtcaaaatacaaaactggattatcaaaacggttggtgtggtcactttaaactggactatcagtatggttgccgtggtcactttaagcgggattatcagtacggttggtgtggtcactttggtttatcatcaatacagttggtgtggtcactttaaactggattaccaatatggttggtgtggtcgctttaaagtttgttttcattttttttctatttttaattcttacgggtatatagaaggtgtatatatttatggggtacatgagatgtcttgaaacaggcatgcaatgtgaaataaataagcacatcatggagaatggggtgtctacctcctcaagcatttatccattgagttgcaaacaatccagctacactcagttatttaaaaatgtacagttattattgcttatagtcaccctgtttgctatcaaatagtaggtcttactctatttttttcattttaaactttgaattttatttttcctaggcttatagcatcatgctatcccccttgtaaaaggaggaatgcttggcatgagaaccttactgctgttaccatgaacaaactatggaatgttgg

SEQ ID NO: 22470 - DNA, 1492 bp, Homo sapiens
agcggaaaaggagcagcggccggggcggcagcggtccccaggccgggacacccggggtggtgcgcccgggttcgcgggggctgcgccggcgccggggaggcggggggagcgggagcgggcgacgcggggaaggggggagccagggggagggcgccggccggaggaggggcggacccgcccgccctagccgagcagagcacagccgagccgagcggcccgggcgggggccgaccccggccagcgtcggcgcagagagcgggcggaggcgcaggccatgctgcggctggtgcccaccggggcccgggccatcgtggacatgtcgtacgcccgccacttcctggacttccagggctccgccattccccaagccatgcagaagctggtggtgacccggctgagccccaacttccgcgaggccgtcaccctgagccgggactgcccggtgccgctccccggggacggagacctcctcgtccggaaccgatttgttggtgttaatgcatctgacatcaactattcagcaggccgctatgacccctcagttaagcctccctttgacataggtttcgaaggcattggggaggtggtggccctaggcctctctgctagtgccagatacacagttggccaagctgtggcttacatggcacctggttcttttgctgagtacacagttgtgcctgccagcattgcaactccagtgccctcagtgaaacccgagtatcttaccctgctggtaagtggcaccaccgcatacatcagcctgaaagagctcggaggactgtcggaagggaaaaaagttttggtgacagcagcagctgggggaacgggccagtttgccatgcagctttcaaagaaggcaaagtgccatgtaattggaacctgctcttctgatgaaaagtctgcttttctgaaatctcttggctgtgatcgtcctatcaactataaaactgaacccgtaggtaccgtccttaagcaggagtaccctgaaggtgtcgatgtggtctatgaatctgttgggggagccatgtttgacttggctgtagacgccctggctacgaaagggcgcttgatagtaatagggtttatctctggctaccaaactcctactggcctttcgcctgtgaaagcaggaacattgccagccaaactgctcaagaaatctgccagcgtacagggcttcttcctgaaccattacctttctaagtatcaagcagccatgagccacttgctcgagatgtgtgtgagcggagacctggtttgtgaggtggaccttggagatctgtctccagagggcaggtttactggcctggagtccatattccgtgctgtcaattatatgtacatgggaaaaaacactggaaaaattgtagttgaattacctcactctgtcaacagtaagctgtaaaaacagaacaatgacataaatcaagggagatgcggccgaaaaacaaccacataacaactcatataaacataatgttctgaacct

SEQ ID NO: 22471 - DNA, 1796 bp, Homo sapiens
tgacctcgtgggctcaagcaatcctcccgcctcaacctctcaagtagctggcactacaggcacatgccaccatgcctggctaattttttccatttttgtagagacagggtccccctgtgttgcccaggctggtcttaaactcctggtctcaagcaatcttcctgcctcggcctccgaaagtactgggattacaggtatgagccactgtacccagcctttttcctcttcttaaagtctggtcctctctcccagttttcatgtctcacagccatccttttgtctctgataccgcttcttaattctaaacagctatattctataagctgctaccaaagagagaaacatcatcctctctagactgccgtggagtcagtgccacatataccaaactgtctgatctgtgactatgtcctcttttgactgggcccacattaaagcatgtcccaaacgctatcttgatatatgtcctcagtagcaatcttgttttttaagccttcctttacaggttgattcacagtgggagagagccatgttcagaatttttttctgatagcctgaattttcttcttgtctttcatgtctttgcttctatttatgttctttgtacctcttcttccttgaacttggatcttctgcatagttgactctattatatcatctttggggctgcagaataaaatgtggaagattttaaagttaaggttcccagaataatgttgtcgcccacattgcacatatgtcacattttgagtttactagttaagcctctaaatatgcactttatatacaatatgcgcagtgcgatgatttaggttgccatgagaacctaaaaattttaggcttaaatggttcggtaacagacactttaaaattatcttagatgaaggctaattttttcttttatatactctttacaaactgaggcataaggcaatagctgttctcatatagtacttctgctgacaggttgggtggcttctttgtttgcctacctgttatcagtccccttcattccagtctttcatactctggtgtcctgtcccctgcccaagtatttgtctctcttttttttttaagtcttaccctgttgctcaggctggagagcagtggcgtgatcttggatcactgcaacctccacctcccaggtttaagcagttctcctgcctcagcctccccagtagctgagattacaggtgcctgccaccacacccagctaattttttttttcccgagtcggagtctcgctgtgttgcctaggctggagtgcagtgacaggatctcggctcactacaacctccacttcctgggttcaaatgattctcctgcctcagcctcccaagtggctgggactatttttgtatttttagtagagacagggtttgccatgttggccaggctgctctcgaactcctggcctcatgtgatcttctcgcctcggcctcgcaacgtgctgggattacaggcgtgagccagcatgcctggccactaatttttatatttttagtagagattgggtttcgccacgttacccgggctggtctcgaacttctgacctccagtgatccacctgcctcagcctcccaaagtgctgggagccactgtccccggcctcgtctcctactttctttgctccaaggtaggattagaagtagaaactggagccaggagctatagtgccagctacccgggaggctgaggtgggataattacttgaacctgagaggcagaggttgcagtgagctgagattgcgccactgtgctccagcctgagctacagagcaagactctgtctcaaa

SEQ ID NO: 22472 - DNA, 588 bp, Homo sapiens
taggcttttagcagcccaaagccatagcttttagtttctctctctagtgataagtggaaaagagggatgaggaagaggctttgccggcccaaccagaaacaaactaagaacccatgactgcattctctccctttaacacccctgtttaggggaaactgaaactgggtaaggagaatatgggtcctctttgtactatctttgtaacttttctgtaaatctaaaaatatttcaaaatgaaagttcattttagaaaaagaagggagtattatgaataactttacaattttgacaaattaggtaaaatgaacaaattccttgaattacagaaagtgactcaagaagaaatagaaaaatggcactatttctattaaagaattttaaatctgtaaaactttcccacaaagaaaaccctaggcccagagagcctccctggtgaattctatcatatatttaagaagaactaacacaatcttatcaccaactttttcaaaaaacagaagtaaaaggaagatgtctcatcttattttatgaggtcagctttaccccaacttgaaaaccagataaataatttacaaacaaaaaaaaaaa

SEQ ID NO: 22473 - DNA, 1186 bp, Homo sapiens
aaatgagacgtccaaacacttgagtttcttaagattgggatctctttcaaatgaaaaaggacagagccaagtagagaaaagactttgtgctcccacccagccttaatgagtctcatggtctaaaagtataggaagaaatgaaatgcactttcagaagctaaaatgacagtgtctgctacaaaaggctgtagttgtaggcagtcggggatgccatgtccttggttccattcctgcgtgagtctgcagaaggcacacactttgtaagagtagagtggactagtgccagcctgaataggtttaaaactgcaaacagttggagaacatggaacaggttggtgcaggaagcctaagattttgcaatcatattataacattggcttttgacaacataaatgttgtatcttccctaaggtcaggtcggggaaagaaagacttccagcttcttacctctgcgtgcatgggcacgtgtgcattgctcagtccgcaggaggtctcactccgcaggaaacgctctcctcccgcataagtctgtacttccatcccctcatctgtggtagtagtgaaggctaggtgagtaagcgtgggctgttctacccaccagaagtccaggagctgttgtatacctcatttctaactcgtgaccgagtgacttgctttaactttctcgaaatcctacagagttgccaagtctgccctccctcctcagtcatgttaaactctggcctatagcatcatgggacctgtagcctagggtgggaccccctaaagcctctgaatgtcgctgcttaaaagctactgcaaactgagggcaaattgcaatcttctattcctttttgttgcaaggggtcttcacaggtctcttaacatctgctttccctgccaccctgcctttaggggctggccagctatccacacccctaacccaccctgtgtttctgacagctggccacacgtcaacttctgtacttgccttttccttggtggggtagaggccaaccccttctcctctgaggcctcagggttctgtttcttttcaggactttgggtagaagggaagacaccaaaggctcctttaagctgactgctgcatacacatttcactttttttcctttgacatgaccaaaaatatccattaaaggtattaataataataatattatttgcccctttttccgggccctctgc

SEQ ID NO: 22474 - DNA, 3441 bp, Homo sapiens
aaatgagacgtccaaacacttgagtttcttaagattgggatctctttcaaatgaaaaaggacagagccaagtagagaaaagactttgtgctcccacccagccttaatgagtctcatggtctaaaagtataggaagaaatgaaatgcactttcagaagctaaaatgacagtgtctgctacaaaaggctgtagttgtaggcagtcggggatgccatgtccttggttccattcctgcgtgagtctgcagaaggcacacactttgtaagagtagagtggactagtgccagcctgaataggtttaaaactgcaaacagttggagaacatggaacaggttggtgcaggaagcctaagattttgcaatcatattataacattggcttttgacaacataaatgttgtatcttccctaaggtcaggtcggggaaagaaagacttccagcttcttacctctgcgtgcatgggcacgtgtgcattgctcagtccgcaggaggtctcactccgcaggaaacgctctcctcccgcataagtctgtacttccatcccctcatctgtggtagtagtgaaggctaggtgagtaagcgtgggctgttctacccaccagaagtccaggagctgttgtatacctcatttctaactcgtgaccgagtgacttgctttaactttctcgaaatcctacagagttgccaagtctgccctccctcctcagtcatgttaaactctggcctatagcatcatgggacctgtagcctagggtgggaccccctaaagcctctgaatgtcgctgcttaaaagctactgcaaactgagggcaaattgcaatcttctattcctttttgttgcaaggggtcttcacaggtctcttaacatctgctttccctgccaccctgcctttaggggctggccagctatccacacccctaacccaccctgtgtttctgacagctggccacacgtcaacttctgtacttgccttttccttggtggggtagaggccaaccccttctcctctgaggcctcagggttctgtttcttttcaggactttgggtagaagggaagacaccaaaggctcctttaagctgactgctgcatacacatttcactttttttcctttgacatgaccaaaaatatccaaatatttaagtttattattattattattattatttgacaatcttatatccaatgggctctctagaagctgcatccccagccctttcaccttttctttgaatgtagttcccaaccttcaattcccacccctaatgctgacaaaaagcttagccaggtcatgatactgctgctataagccaggggagggtggtttctttgttttgttttgttttgttttgtttttcaaatttccagccaaaaccaaagatttcttaatgattgtataaactcaaaacaaacaaaagaaccaaagaaaagggaagtcttcagcatcagtccagtctgtggtgtcctggcacttagaagagtgaggccagggaaggtggggcggggggaccctctgactggatcagaaagggcaggcaagctgcttaccaccttccagggtccagcacaggtgcatgcccctagctttggccctcacaaacttgtgagcatgccctgaaacaaattggcatttcagattttccaaaacaaaagtcaaaaaaccccatcaccaccatcatccaccctacaccaaccagggtcactatggggacttagcacagggcctagggagggtgggagctgctgctggactggcccgaggactccacagagtgggggacgttgaagacactggcgcacgattggctgctctgctgggtgctttaacctctggggctgggcgaatgcacgccacggtgcccttctgagcctttttttcttttcctgtactggaactgcttggaagtggctgtcctgtttgtgagaaaacatgcagaaagattatcaagcttttcatttctctttattgtagttttctttcctttttgcagcaccactgtgcaactatgcattgtacttcacaaccttttgtgctaggtagatgcctgtgactttttaacttggggggtggggggattgcaaatgaaggaactttttacatggatctttttaatctcagttggttgggggaggggggtacttggttcttgggtcacacaagctctatcccaaagcaaaatccaaatgttaataatattagcctgatgcagataccaaagataatttctttcctgcagaaccttagactcgtgtattaagtacgattacccagcacttgcattagtctaacctcagtaattccaaagcttagatgtatattttggtatatttctgggatattaaaaaaaatgtcgtttaacttcttgtttgtttcagtgtaatgctcttaaagtcatagcatgaaaataattgaactgtcctattcttagtagtttgaaataatagtatttttgtatgttttgggtgtgtctatgtatgtattaacataacagttttcactgcctaggtgttcataataaaaaagaaaatgaaaaaagttctgagtgtacataatattcaataataatctcccaccaggtgtcaatttagattgcatattcctcattactgttcccaactgggattttgttttcttttaaagagacagtgatcgtgtttttctaaagatgttttctttctctctttcaatatcttaactcactttttttttcttccttttttgtcttaattattaattcaggggtgtttgtccactgttgtcaaaggaggggcacaaggggaattggcccccggcctcctagaactttttgttttatgtactttaaaatgtgagtttgagttcttctttgtggaaacttaagatgtggtgtaaatgattctttccaaaattgtccagcagcttgaatgaggcagtgacaattctgaggtggtttattgggagtccttctacatttctcttagataactctgcactctgggtggctattgtgtagccttactgccccagagtgcctgttagccaaatatttcccctctgataggaatattttctaagaatcagctgataacttgcgtgctggaccttgttatctgtgcccctgggagacacacgttttcttggttttgaaaacctgaaacacaggcaactttacattttggggaattagctgatgcctcctgaagcctgaggaggtggcggggaatatgagcggtgctgtctctctcaaaagtgccctttagatgattccccctcctagggctgcctgcaggggctgtaggcttgggaaagattgtgtaggtgacagtgaatcagaatgaagtggtagattttgtgtagatgcatttgtctgctgtaattttttatatatatattaaacttactgtaactgtacagttcatttctgttgtaaaacatcattaaaccatcttccaagtgttttca

SEQ ID NO: 22475 - DNA, 3209 bp, Homo sapiens
gaagattctttgcctggtgtaattgtgactcatgtgtcagttcatgatgtggatttgaattcagctttcatattcagttttgccaaagagagtaatcctggaaccaagtttgctattgatcagaacactggagtggtggtgttggtgaaaacattggattttgaagaaatgactgaatatgagctgctcatccaaatttctgattcagtgcactacacagagggagcacttgtagtccgtgtgctggatgtcaatgataatccaccagtgttttctcaagatttctatcaggtcacagttcctgaatcaatacctgtggggtattcagtgctgactctgtcagccacagacttagaaagcaatgagaacatttcttacagaattctatcctcttctaaggaattctccattgatcctaagaatggcacaatatttactatcagtcccgtattacttctggatacaatatcaacaactcaatttcttgtggaagccagtgatggtggaaatcctgacctgagagctcttactttagtggagataggaatagaagatatgaacaattatgcccctgaattcacagtcaaatcctataatcttagcctaagtgaggatgctctggttggaagcacgcttgttacattttcaaacatcgaccatgactggacccgtgaaaacacatatgttgaatattccatcatcagtggtaattcacagaacaattttcatgtggaaactaagttctttcattcagaatatccttataagcaagtcggttatcttgtgttgcttcacagtctggacagagaagcaagtgctagccatgagcttgtcattctggcatctgacagtggctgccctccattgagttccacagctgtcatatcaatacaagtacttgatgtcaatgacaatcccccaaacttcagcagcctgagctatcacacccatgtcaaggaaagcacccctctagggagtcacatcactgtggtctcagcaaatgaccgtgacacagggtcacatgcagaaatcatctacaacatcatctctggaaatgagaagggacatttttacttagaagaaaacactggagttctttatttgattaaacctctggattatgaaaaaatgacaaaattcaccttaactgtccaagcttcagatgcagaaaagaaacatttttcttttgcagttgtgtttgtcagtgtcctggatgataacgaccatgcacctcagtttatgttctcaagcttcagctgtattgttccagaaaatctgcctatttcctctaccatatgctctataaatgctctggattttgatgctggtccgtatggagaattgacctattctattgtatcaccctgttttctcactcatggaatgtcttatgatcatgatctcttcctcattgaccctttgacaggggatattcatgctaagcaaatccttgactatgaaaatggcaataaatactgcctcacagtccaagccaaagacaaaggtgatgcaactgcctccttagtggtctgggtggatattgaagggatagatgaatttgagcccattttcactcaagatcagtattttttcaccctcccagaaaagaataaagacagacagttgattggcagagtggaagcctcagatgcagatgctggtattgatggagtcattctttactcccttggaacctcatctcctttcttttcagtaaatagaaccaatggaaatatttatttgattagagcccttcccctaataaaaagtcaactcaacaaagaagacaccttggaaatgaaaataatcgctcatagtcccaaatcagattccaagtttgcatcttgcactgtttttgtgaatgtgtctttctcctctgaaggaacacccttggcagtgttcgccagcagcttttcaatcagcctggtggtctcctttttagtgtttctgatactcatctgcattctaattgtaatgattttaagacataaacaaaaagacacaataaacaattatgaggagaagaaaacctcatctttagatgcggacttgagagtgacccgggatgccagtgtgctcaaagccttccagaaaactgacgactgcagtaacgaggtggtccctgtggatgccactccggaatggttgagtttaataagtatcatggagaaggatattgtcaatctgtacagatactcaaactccagtggccactgttctgtggaaggagaaactgcagaagataaggaaatccagaggataaatgagcatccctacagaaagtgctcagactcagctctgagtgaccacgagtccagggtgccagactcgggtatcccgagggactcagaccagctctcctgcctatctggggaaactgatgtgatggtgactgccgaaacagcagaagccagccaaacatttggggaaggagatcaaggggaaggctgcagcaccacctgtgctcaaaataatgtgttaccccagacagttcagaagagagaggcaaaagagagcatcctggctgacgttagaaaagagtctgtctttatttcaggtgatcaggaagtaaggtgtgcagctctttcaactcagacgacctctgatcatgatggaaaagacaactatcactggaattatcttcttagttgggagcccaaattccaacctcttgcctcagtatttaatgatattgcaaaactaaaggatgaacatttgcatatgcctggcattccaaaagagaagaaatcttttgtttttccaccccctttgataacagcagtagcccagcctgggattaaagcagtcccaccaagaatgccggcagtaaacctggggcaggtgcctccgaaacacccacgctctcccatcccctaccatcttggttctctgccagaaggcatgactcccaatttttctccatctctttccctattgacgatgcagcctcctgccttgtctccactgttgagagaaggagaattattaggaacacacatcagtggtacatgccatgaacttaaagcagaagatgaagttcaaatatgaaaccactgggatgccaagtacctgctcaccattggtcatgaatgaatgaacaaaatgttttcaagccggcaactcgagattgggctcatttttatctaaaagcaagtgatgtaatttagttagagtttttaaaacttccccattaaagtttctccaatttc

SEQ ID NO: 22476 - DNA, 2532 bp, Homo sapiens
gctgggtgatctacggatccttgtaagtggtaattcacagaacaattttcatgtggaaactaagttctttcattcagaatatccttataagcaagtcggttatcttgtgttgcttcacagtctggacagagaagcaagtgctagccatgagcttgtcattctggcatctgacagtggctgccctccattgagttccacagctgtcatatcaatacaagtacttgatgtcaatgacaatcccccaaacttcagcagcctgagctatcacacccatgtcaaggaaagcacccctctagggagtcacatcactgtggtctcagcaaatgaccgtgacacagggtcacatgcagaaatcatctacaacatcatctctggaaatgagaagggacatttttacttagaagaaaacactggagttctttatttgattaaacctctggattatgaaaaaatgacaaaattcaccttaactgtccaagcttcagatgcagaaaagaaacatttttcttttgcagttgtgtttgtcagtgtcctggatgataacgaccatgcacctcagtttatgttctcaagcttcagctgtattgttccagaaaatctgcctatttcctctaccatatgctctataaatgctctggattttgatgctggtccgtatggagaattgacctattctattgtatcaccctgttttctcactcatggaatgtcttatgatcatgatctcttcctcattgaccctttgacaggggatattcatgctaagcaaatccttgactatgaaaatggcaataaatactgcctcacagtccaagccaaagacaaaggtgatgcaactgcctccttagtggtctgggtggatattgaagggatagatgaatttgagcccattttcactcaagatcagtattttttcaccctcccagaaaagaataaagacagacagttgattggcagagtggaagcctcagatgcagatgctggtattgatggagtcattctttactcccttggaacctcatctcctttcttttcagtaaatagaaccaatggaaatatttatttgattagagcccttcccctaataaaaagtcaactcaacaaagaagacaccttggaaatgaaaataatcgctcatagtcccaaatcagattccaagtttgcatcttgcactgtttttgtgaatgtgtctttctcctctgaaggaacacccttggcagtgttcgccagcagcttttcaatcagcctggtggtctcctttttagtgtttctgatactcatctgcattctaattgtaatgattttaagacataaacaaaaagacacaataaacaattatgaggagaagaaaacctcatctttagatgcggacttgagagtgacccgggatgccagtgtgctcaaagccttccagaaaactgacgactgcagtaacgaggtggtccctgtggatgccactccggaatggttgagtttaataagtatcatggagaaggatattgtcaatctgtacagatactcaaactccagtggccactgttctgtggaaggagaaactgcagaagataaggaaatccagaggataaatgagcatccctacagaaagtgctcagactcagctctgagtgaccacgagtccagggtgccagactcgggtatcccgagggactcagaccagctctcctgcctatctggggaaactgatgtgatggtgactgccgaaacagcagaagccagccaaacatttggggaaggagatcaaggggaaggctgcagcaccacctgtgctcaaaataatgtgttaccccagacagttcagaagagagaggcaaaagagagcatcctggctgacgttagaaaagagtctgtctttatttcaggtgatcaggaagtaaggtgtgcagctctttcaactcagacgacctctgatcatgatggaaaagacaactatcactggaattatcttcttagttgggagcccaaattccaacctcttgcctcagtatttaatgatattgcaaaactaaaggatgaacatttgcatatgcctggcattccaaaagagaagaaatcttttgtttttccaccccctttgataacagcagtagcccagcctgggattaaagcagtcccaccaagaatgccggcagtaaacctggggcaggtgcctccgaaacacccacgctctcccatcccctaccatcttggttctctgccagaaggcatgactcccaatttttctccatctctttccctattgacgatgcagcctcctgccttgtctccactgttgagagaaggagaattattaggaacacacatcagtggtacatgccatgaacttaaagcagaagatgaagttcaaatatgaaaccactgggatgccaagtacctgctcaccattggtcatgaatgaatgaacaaaatgttttcaagccggcaactcgagattgggctcatttttatctaaaagcaagtgatgtaatttagttagagtttttaaaacttccccattaaagtttctccaatttc

SEQ ID NO: 22477 - DNA, 3224 bp, Homo sapiens
tcatttttactgctttcatttggcttgaatatcaacaagtatttccagaataagtatctttatgccagaatatctttatacatgtgtttgtgggtagtagaatggggtataaattttacaaacaaaaatattttttaagaatagtggaacaacttactatacaaaaacaaaattcagaggaatttgtggcaacagcaacctcaagcagcacacatatttcacagagtgaatgtcatgaatattatttctgtatcttacatgttataaacatataaatacaataatttgtatttctatttggagtcattgttcattgtgacttaacagatctaacaaagaattaaacacatattagtagacattggatagtcaactgccgattaaatggatcatcaaaactgcacctcacagtgttgaaatactatgtcttatttttcaggcacaatatttactatcagtcccgtattacttctggatacaatatcaacaactcaatttcttgtggaagccagtgatggtggaaatcctgacctgagagctcttactttagtggagataggaatagaagatatgaacaattatgcccctgaattcacagtcaaatcctataatcttagcctaagtgaggatgctctggttggaagcacgcttgttacattttcaaacatcgaccatgactggacccgtgaaaacacatatgttgaatattccatcatcagtggtaattcacagaacaattttcatgtggaaactaagttctttcattcagaatatccttataagcaagtcggttatcttgtgttgcttcacagtctggacagagaagcaagtgctagccatgagcttgtcattctggcatctgacagtggctgccctccattgagttccacagctgtcatatcaatacaagtacttgatgtcaatgacaatcccccaaacttcagcagcctgagctatcacacccatgtcaaggaaagcacccctctagggagtcacatcactgtggtctcagcaaatgaccgtgacacagggtcacatgcagaaatcatctacaacatcatctctggaaatgagaagggacatttttacttagaagaaaacactggagttctttatttgattaaacctctggattatgaaaaaatgacaaaattcaccttaactgtccaagcttcagatgcagaaaagaaacatttttcttttgcagttgtgtttgtcagtgtcctggatgataacgaccatgcacctcagtttatgttctcaagcttcagctgtattgttccagaaaatctgcctatttcctctaccatatgctctataaatgctctggattttgatgctggtccgtatggagaattgacctattctattgtatcaccctgttttctcactcatggaatgtcttatgatcatgatctcttcctcattgaccctttgacaggggatattcatgctaagcaaatccttgactatgaaaatggcaataaatactgcctcacagtccaagccaaagacaaaggtgatgcaactgcctccttagtggtctgggtggatattgaagggatagatgaatttgagcccattttcactcaagatcagtattttttcaccctcccagaaaagaataaagacagacagttgattggcagagtggaagcctcagatgcagatgctggtattgatggagtcattctttactcccttggaacctcatctcctttcttttcagtaaatagaaccaatggaaatatttatttgattagagcccttcccctaataaaaagtcaactcaacaaagaagacaccttggaaatgaaaataatcgctcatagtcccaaatcagattccaagtttgcatcttgcactgtttttgtgaatgtgtctttctcctctgaaggaacacccttggcagtgttcgccagcagcttttcaatcagcctggtggtctcctttttagtgtttctgatactcatctgcattctaattgtaatgattttaagacataaacaaaaagacacaataaacaattatgaggagaagaaaacctcatctttagatgcggacttgagagtgacccgggatgccagtgtgctcaaagccttccagaaaactgacgactgcagtaacgaggtggtccctgtggatgccactccggaatggttgagtttaataagtatcatggagaaggatattgtcaatctgtacagatactcaaactccagtggccactgttctgtggaaggagaaactgcagaagataaggaaatccagaggataaatgagcatccctacagaaagtgctcagactcagctctgagtgaccacgagtccagggtgccagactcgggtatcccgagggactcagaccagctctcctgcctatctggggaaactgatgtgatggtgactgccgaaacagcagaagccagccaaacatttggggaaggagatcaaggggaaggctgcagcaccacctgtgctcaaaataatgtgttaccccagacagttcagaagagagaggcaaaagagagcatcctggctgacgttagaaaagagtctgtctttatttcaggtgatcaggaagtaaggtgtgcagctctttcaactcagacgacctctgatcatgatggaaaagacaactatcactggaattatcttcttagttgggagcccaaattccaacctcttgcctcagtatttaatgatattgcaaaactaaaggatgaacatttgcatatgcctggcattccaaaagagaagaaatcttttgtttttccaccccctttgataacagcagtagcccagcctgggattaaagcagtcccaccaagaatgccggcagtaaacctggggcaggtgcctccgaaacacccacgctctcccatcccctaccatcttggttctctgccagaaggcatgactcccaatttttctccatctctttccctattgacgatgcagcctcctgccttgtctccactgttgagagaaggagaattattaggaacacacatcagtggtacatgccatgaacttaaagcagaagatgaagttcaaatatgaaaccactgggatgccaagtacctgctcaccattggtcatgaatgaatgaacaaaatgttttcaagccggcaactcgagattgggctcatttttatctaaaagcaagtgatgtaatttagttagagtttttaaaacttccccattaaagtttctccaatttc

SEQ ID NO: 22478 - DNA, 382 bp, Homo sapiens
gagggaaatttatagttgtaaatctatacatgaaagaaaaatactgcaaacagtggattagtgtcccctacgattgcagacttgtattattacttcttcttctactaattttttttttttttttttgagatggagtctcactctgtcaccaggctggagtgcagtggcgtgatctcagctcactgcaacctctgcctcctgggttcaagccattctcctgtctcaacttcccgagtatctgggaccacagacacacatcaccacacccagctaatttttgtattttttagtagacacggggtttcaccatgttggccaggatggtcttgatctgttgacctcaggtgatccgcccgccttggcttcccaaagtgctgggatt

SEQ ID NO: 22479 - DNA, 378 bp, Homo sapiens
cagcaagactgaaactgttaaggagccatgaaggaagaagcagcagcaaaagaagagaaagaagaatcttatgatgaagctgcagtagaggaagaagaagaaaaacagaaaccaaagactaaaaaagttgaaaaaactgtctgtgaatgggaacttatgaatgatatcaaaccaatatggcagagaccatccaagaagtagaagatgaatacaaagctttctgcaaatcattttcaaaggaaagtgatgaccctgtggcttgtattcactttactgctgaaggagaagttaccttcaaatcaattttatttgtacccacatttgttccacgtggcctatttgatgaatatggatctaaaaagagcgattacattaagc

SEQ ID NO: 22480 - DNA, 441 bp, Homo sapiens
gttagcttcgatggcaaccatatgggaatctaaattgcgttttgaattacagggagatggtaggaagaaagctaaatatggttatgaaagtgtcatatgggaaaagtgtaagaaaggtataaagtggggaaagtaattgaatataggcttgcttagtgtggccactccctctgtggggcagtatgaaggcgcagaagcattctcacttgatatactccgcagattgaaatgaagccaagtggggagaagttggaaaaccaaatcatgtttcaaccaccataaacttgccaaaatgttgcactcatttagatgggtcactttgttttaatgtccacagtaataggtagtccctggcaaaaggtgaaagcaatctgcatttttaacagaacttttcactaatgatgtttttcttgtaagcaccccaaagagtcttccaagaat

SEQ ID NO: 22481 - DNA, 253 bp, Homo sapiens
gctatatatagatatagatactatatatatagtacctatatatagtgtgtgtatatatctacatataggatcatatattcatagatgtataggctatatatctatacactatatagtacatatgaatatatatcttatatatcatatatatccatatatatgatatatattcatatgtgctatatagtatatagacctatatatctcactatatatccataagtagtatatctatatctatggatatatatat

SEQ ID NO: 22482 - DNA, 811 bp, Homo sapiens
attttaaagctatatagcactttgacctactttttttttactttagaacgactaaactgattaatttatcaatgttaatccttcctctttgtgtaaatgtagttgacagccctttgggagaggtgttggagatgctaactgtctacaattcaatccacctattgatgtgttgatggaatgctaggcttaggaagggtactcataacccctgttatgatgtgtaaaaaaatccaggaaggtacagaagtacttttgaagtcttgatcaaatgaagtaaggggagctataacttcaaaacacattccatttaaatccaacaaggtctaggttaatatttttactaagaagtgttgtctacatactataaaattttggttgaccgttccctagtagatgacaacttcacatggctatttcctgaataaactcagagaaggtgattctagagaaagcttaccaggagaaatagatgtgttttagaagtggatactttctggaaatgtttatgtttaaaaatacttttccccaaattctctgtcttgtatgatctttgattttgctgactttggtcagtccattttcagggatgtaaactgtgcgattgatgaaggattattgtatggaacttacagacactatactttctttttcacagaagaagtacattgttttttctctaaactttaggggaaaatacctaaaggacctaaagactaaagaacaaaattaaaaaacacaagtagctattgccagttttgatctctatatttgacataaaaaaggaaataaattgatatattttaaaaatgca

SEQ ID NO: 22483 - DNA, 452 bp, Homo sapiens
ctaatttgtaagcaaactattggaacaaagtctatttgtaaattgactgccttttctaaaatgcaccaggtgttatttttttcatgtgttttccatgaatccttaaacgcatttcattattggatgttgataatattttaattaactggtgatcatttaggtcatttctacctctaaaatttctatgattcggttagagcagagatttttggcaaatgatttagttgaattaaggtttctaaagttttaatgttcaaagatatggcacttcaatcaatattttcttgtatagacaagttaggtttattttgggaggaaattttttaaaaaataatatcctgcttctttcttacagaatttagtacacatgggcttaaggaagaatttattgtaaaaataaaatttttcttttacaatgttattacttgttttttagctttcaagaccatagg

SEQ ID NO: 22484 - DNA, 5456 bp, Homo sapiens
ggggcggtgaaagaagtttgctgacgaagatggcgactgaggcacagagtgaaggggaggtgccagcccgcgaatccggccggagtgatgccatctgcagttttgtgatctgcaatgattcttcccttcgaggtcagcccattatctttaatcctgacttttttgtggagaaactccgacatgagaaacctgagattttcactgagttggtggtcagcaatatcacaaggctcatcgatttacctggaactgagttggctcagctgatgggggaagtggaccttaagttgcctggcggggctggcccagcatcaggattcttccggtctctcatgtctctcaagcgaaaggaaaaaggagtgatatttgggtccccactgacggaggaaggcattgcccagatataccaactgattgagtatctacacaaaaacttgcgagtagagggtttgtttagagtaccgggtaatagtgtccgacagcagattttaagggatgctctcaataatggaactgacattgacttggaatcaggggaatttcactcaaatgatgttgccactttgctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtttgcaccccacgtcctgtggccaaaaaatgtcactgcaaatgaccttcaggagaatatcacaaagttaaacagtgggatggcttttatgattaaacactcccagaaactttttaaggctcctgcttacattcgggagtgtgcgagattgcactatttgggatccagaactcaggcatcaaaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccagagtcagcaaagaagaaacaacttattagacagtttaataagcaatcattgacccagacaccagggcgagaaccttctacttcccaggtacaaaagagggctcgttcgcgctccttcagtgggcttattaagcggaaggtcctgggaaatcagatgatgtcagaaaagaaaaagaagaaccctactccagaatctgtggccattggtgaattgaagggaaccagcaaagaaaataggaacttattattttctggctctccagctgtcacgatgacaccaacaagattgaagtggtctgaagggaagaaagaggggaaaaaaggatttctctgaaggatccagagttgtctcctatggtccatgcagaattttctgtttagtgggcaggtgttattcctgcccacagcaaagcttggacttgcagcttgcttgctgcattttgaattgtcaaagccaactaataccgtgacccgactgatacctctaaccccactcactggatgatgtttgcaagctgtgccttctgagagagtgcttaggccctgtctctcttttttaatattatggggaaaccactaactatccaaccagcttatacagcacactaaggtgggcttcagtgctcactcaatgtgtttaggcagattccacttttgaaaaaaaatatgaaatgtgtgctcaactgccagtaattttttaaaaagcactgtcccagtggattgatgttgtttttaatggatattttgggtttttctctgttttgatagtattgggtatttggttgtttttgtttgtttatttctttgttttaaaagccatgtttttggttgggctctaagctagatatctttccctctttttcactttgagctttgggaaaactctttatcttatgaggctgtattcctcaatacctaatttgtgtccaaagaatttatagcttttctggacattttttattatttcttgggtgtgacatcagagtatttgacctgcagtattgaaaaaggagaattcagaatgatacagtattttaacaaatcttaattattaaactcttttccttccttccatttctccctcccttgtccatctctctctctctttccctttcctcagtgatgtgaaaataattgtgttttgctgaacttgttatcttcattcaatttcctcttgactaaaacatctctggtgccaacgtaatacttctgaaccaaatcactgtgactcaaggaaagtcactgacagcataagagaagtttgctaaaatatttgtatgtgggggaagctctggagtgtgcctaggagggggctggctgcctttatgtcccaggatgactctttatgggtgggattacattgcaccctctgagggtgcaggctagaccgtctcctgagaggaagttaggatcagaaagaagaagcaagcagcagcctctgcagggctgacaggatttaaaggagagaatgttcttatttggaagcagctgtggcttgtcaccaatgttcaaggagtgttactgttccgccctctctttgtcagaagggacacaggtggtaatttggagatggggccagagcttctggctttggatttggtgtgttcacttgtgttggatagagcagtggcatggctttgacctagtatgaactggtgtctgcccagagagcagcatgtagcaggggggaatgctcaggtttgtgcctggctctgtggagctgtacaacccttctcaccctgtgggttggagccgagtcaggccactatggggaagcagttgccccacaaaatgtggtttgctgacctatttctaaactgttgaatatgctgcaccattgctgaaatgaaagatgactctgggggagcagagcttggccttgtgcccagctggcagccccctctgccagcctttctgctgcttttgctgctgtaacagcaatagtggagaaaaatgtaaaatttggtcttccagcttaatgcagtgtgaacaatagatggttaggaaaacaaaactgcttagaagcccctttctctagagcagttttatgtcatttgtaaaaacacatattagcaaattcgtttgcgtaggtttctattaaatatttgactttttttttcttattaagaaaatgaaatcccttacaccagatatcagttaattcaaacagaaaaccctttgggtatcaccaaattgaaatggtattcttccttaactcttccttctttcctttatttgtttagacgtgcttcatcccgaagtggtgctatggtctgttaaacagggctggcatcaggtagagggagcagagtggtgacctgatagctcctgtcatcgtgttagtttttgattctatttaagggaagtagctgagatttagacggatgtagatgctctttgggtgaatggaatcataagcaaaggttgtgttctggggtgaggatcatgagagagatatttatcacatgcacatgcctttatatagctggtctccttgggtggtttatgtgtgttttgtttatttattgaatatgttttcccttgctttaggggttttataggtcatttttcttaatagaagctgtgatcgacttagaatccaaatttgaggagtaagcagcataaccttctaccttgtaatatgtaactattctaatccagtggaatcttacggaaaacacagagaaaaccccttttatcatttgccacagaaggctgctgtctcccttctgatttggtgggcaggtattgtttttgagccagtatttaacagagttttttaatctataagattttttttgaatctatttcattgtgtttgtttttcatgttggaacaatctctctggaagtgcctcttcttgtggcttttacaacttcatttctttctggggtcacctgtgatgggctttgatgtggtgtcaatttggggccttgtgtttgtgccagagggatacacatattaaactgcaggccaccttcctggtccagactgtactgtgtgaaccccactgactaaattagtgagaaccataggcgttggaatttctcaccttttacaatgatagacttttgcattgggaccaatgaatctggtgtgaaaaaccctgctgtagtagtgaaagagcatcaggagatactgactgtacctgagggccaaaacaggagcaggtaacgaaccgtaaaaaaaggagcaggtaatgaatcgtaaccaaaactacagttgatcctccgcaaaggaaagctctttacccagaatgtccttccagagtcattcaggaaggacaagggaacacccttgggaaatgggctagtggagggctgttgactgcagtgacacctgggtgctccggaggtatctgttctgttgacctgtaaggaagcagtcgatcctagagtgtcagaacagagccattctctcctcctgagtaggaacgtttctgttcagtttccctcacagcagcctgtgttagcatgcagttgaaaatactgccgtctaggagaacctgtggtcactgggaacgtgccccacagtgactggccatgcaaccaggtgatttttaggaatagatgtctctagactctgtctcctttcctacaaggcctcacacagatgcttgaggctaatggcccccattctgaggtcatttttgtgtagaactcctttccccaggagagagccttatctctgccctcctttaccctgaaggcttcaaacggaagacaggacctagatctaaacctagatactagcattttgtgggattgtctagaatttggggaagatttgggttcctaagatgcacaagcgttttacaccagtggtgattaactcaactaaaacccactgtaggaagttagcttccccagacagctaatgccgagatcttctaccagcgtagagttgacagaagcaggccagcgaggaggtgtgggacataatagcctgagtgcttgggttaccatggagactggagtgtgtgaggccacagcctgtgctaaagagccatggagccctcccctggccatgtctggggacagatagaacctgttgggggaaatattccctcaccccagggttctttctgcagagcaagggttgcctttgtcctatccctgagcttgctcaacaagagaaacaaggtttcttaagtgttttggttaaagttttcattcttatttgactatgtatatgtaattgtaaagaaacgatcctatgcattgtctttcttttatattcttgtaatattctgaaattaaaattgttttgtttcata

SEQ ID NO: 22485 - DNA, 5237 bp, Homo sapiens
ggggcggtgaaagaagtttgctgacgaagatggcgactgaggcacagagtgaaggggaggtgccagcccgcgaatccggccggagtgatgccatctgcagttttgtgatctgcaatgattcttcccttcgagaaaaaggagtgatatttgggtccccactgacggaggaaggcattgcccagatataccaactgattgagtatctacacaaaaacttgcgagtagagggtttgtttagagtaccgggtaatagtgtccgacagcagattttaagggatgctctcaataatggaactgacattgacttggaatcaggggaatttcactcaaatgatgttgccactttgctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtttgcaccccacgtcctgtggccaaaaaatgtcactgcaaatgaccttcaggagaatatcacaaagttaaacagtgggatggcttttatgattaaacactcccagaaactttttaaggctcctgcttacattcgggagtgtgcgagattgcactatttgggatccagaactcaggcatcaaaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccagagtcagcaaagaagaaacaacttattagacagtttaataagcaatcattgacccagacaccagggcgagaaccttctacttcccaggtacaaaagagggctcgttcgcgctccttcagtgggcttattaagcggaaggtcctgggaaatcagatgatgtcagaaaagaaaaagaagaaccctactccagaatctgtggccattggtgaattgaagggaaccagcaaagaaaataggaacttattattttctggctctccagctgtcacgatgacaccaacaagattgaagtggtctgaagggaagaaagaggggaaaaaaggatttctctgaaggatccagagttgtctcctatggtccatgcagaattttctgtttagtgggcaggtgttattcctgcccacagcaaagcttggacttgcagcttgcttgctgcattttgaattgtcaaagccaactaataccgtgacccgactgatacctctaaccccactcactggatgatgtttgcaagctgtgccttctgagagagtgcttaggccctgtctctcttttttaatattatggggaaaccactaactatccaaccagcttatacagcacactaaggtgggcttcagtgctcactcaatgtgtttaggcagattccacttttgaaaaaaaatatgaaatgtgtgctcaactgccagtaattttttaaaaagcactgtcccagtggattgatgttgtttttaatggatattttgggtttttctctgttttgatagtattgggtatttggttgtttttgtttgtttatttctttgttttaaaagccatgtttttggttgggctctaagctagatatctttccctctttttcactttgagctttgggaaaactctttatcttatgaggctgtattcctcaatacctaatttgtgtccaaagaatttatagcttttctggacattttttattatttcttgggtgtgacatcagagtatttgacctgcagtattgaaaaaggagaattcagaatgatacagtattttaacaaatcttaattattaaactcttttccttccttccatttctccctcccttgtccatctctctctctctttccctttcctcagtgatgtgaaaataattgtgttttgctgaacttgttatcttcattcaatttcctcttgactaaaacatctctggtgccaacgtaatacttctgaaccaaatcactgtgactcaaggaaagtcactgacagcataagagaagtttgctaaaatatttgtatgtgggggaagctctggagtgtgcctaggagggggctggctgcctttatgtcccaggatgactctttatgggtgggattacattgcaccctctgagggtgcaggctagaccgtctcctgagaggaagttaggatcagaaagaagaagcaagcagcagcctctgcagggctgacaggatttaaaggagagaatgttcttatttggaagcagctgtggcttgtcaccaatgttcaaggagtgttactgttccgccctctctttgtcagaagggacacaggtggtaatttggagatggggccagagcttctggctttggatttggtgtgttcacttgtgttggatagagcagtggcatggctttgacctagtatgaactggtgtctgcccagagagcagcatgtagcaggggggaatgctcaggtttgtgcctggctctgtggagctgtacaacccttctcaccctgtgggttggagccgagtcaggccactatggggaagcagttgccccacaaaatgtggtttgctgacctatttctaaactgttgaatatgctgcaccattgctgaaatgaaagatgactctgggggagcagagcttggccttgtgcccagctggcagccccctctgccagcctttctgctgcttttgctgctgtaacagcaatagtggagaaaaatgtaaaatttggtcttccagcttaatgcagtgtgaacaatagatggttaggaaaacaaaactgcttagaagcccctttctctagagcagttttatgtcatttgtaaaaacacatattagcaaattcgtttgcgtaggtttctattaaatatttgactttttttttcttattaagaaaatgaaatcccttacaccagatatcagttaattcaaacagaaaaccctttgggtatcaccaaattgaaatggtattcttccttaactcttccttctttcctttatttgtttagacgtgcttcatcccgaagtggtgctatggtctgttaaacagggctggcatcaggtagagggagcagagtggtgacctgatagctcctgtcatcgtgttagtttttgattctatttaagggaagtagctgagatttagacggatgtagatgctctttgggtgaatggaatcataagcaaaggttgtgttctggggtgaggatcatgagagagatatttatcacatgcacatgcctttatatagctggtctccttgggtggtttatgtgtgttttgtttatttattgaatatgttttcccttgctttaggggttttataggtcatttttcttaatagaagctgtgatcgacttagaatccaaatttgaggagtaagcagcataaccttctaccttgtaatatgtaactattctaatccagtggaatcttacggaaaacacagagaaaaccccttttatcatttgccacagaaggctgctgtctcccttctgatttggtgggcaggtattgtttttgagccagtatttaacagagttttttaatctataagattttttttgaatctatttcattgtgtttgtttttcatgttggaacaatctctctggaagtgcctcttcttgtggcttttacaacttcatttctttctggggtcacctgtgatgggctttgatgtggtgtcaatttggggccttgtgtttgtgccagagggatacacatattaaactgcaggccaccttcctggtccagactgtactgtgtgaaccccactgactaaattagtgagaaccataggcgttggaatttctcaccttttacaatgatagacttttgcattgggaccaatgaatctggtgtgaaaaaccctgctgtagtagtgaaagagcatcaggagatactgactgtacctgagggccaaaacaggagcaggtaacgaaccgtaaaaaaaggagcaggtaatgaatcgtaaccaaaactacagttgatcctccgcaaaggaaagctctttacccagaatgtccttccagagtcattcaggaaggacaagggaacacccttgggaaatgggctagtggagggctgttgactgcagtgacacctgggtgctccggaggtatctgttctgttgacctgtaaggaagcagtcgatcctagagtgtcagaacagagccattctctcctcctgagtaggaacgtttctgttcagtttccctcacagcagcctgtgttagcatgcagttgaaaatactgccgtctaggagaacctgtggtcactgggaacgtgccccacagtgactggccatgcaaccaggtgatttttaggaatagatgtctctagactctgtctcctttcctacaaggcctcacacagatgcttgaggctaatggcccccattctgaggtcatttttgtgtagaactcctttccccaggagagagccttatctctgccctcctttaccctgaaggcttcaaacggaagacaggacctagatctaaacctagatactagcattttgtgggattgtctagaatttggggaagatttgggttcctaagatgcacaagcgttttacaccagtggtgattaactcaactaaaacccactgtaggaagttagcttccccagacagctaatgccgagatcttctaccagcgtagagttgacagaagcaggccagcgaggaggtgtgggacataatagcctgagtgcttgggttaccatggagactggagtgtgtgaggccacagcctgtgctaaagagccatggagccctcccctggccatgtctggggacagatagaacctgttgggggaaatattccctcaccccagggttctttctgcagagcaagggttgcctttgtcctatccctgagcttgctcaacaagagaaacaaggtttcttaagtgttttggttaaagttttcattcttatttgactatgtatatgtaattgtaaagaaacgatcctatgcattgtctttcttttatattcttgtaatattctgaaattaaaattgttttgtttcata

SEQ ID NO: 22486 - DNA, 6671 bp, Homo sapiens
  misc_feature (5459)..(5459): n is a, c, g, or t
  misc_feature (5462)..(5462): n is a, c, g, or t
  misc_feature (5467)..(5467): n is a, c, g, or t
  misc_feature (5474)..(5474): n is a, c, g, or t
  misc_feature (5483)..(5483): n is a, c, g, or t
  misc_feature (5485)..(5485): n is a, c, g, or t
  misc_feature (5490)..(5490): n is a, c, g, or t
  misc_feature (5492)..(5492): n is a, c, g, or t
  misc_feature (5503)..(5503): n is a, c, g, or t
  misc_feature (5505)..(5505): n is a, c, g, or t
  misc_feature (5507)..(5507): n is a, c, g, or t
  misc_feature (5510)..(5510): n is a, c, g, or t
  misc_feature (5512)..(5512): n is a, c, g, or t
ggggcggtgaaagaagtttgctgacgaagatggcgactgaggcacagagtgaaggggaggtgccagcccgcgaatccggccggagtgatgccatctgcagttttgtgatctgcaatgattcttcccttcgaggtcagcccattatctttaatcctgacttttttgtggagaaactccgacatgagaaacctgagattttcactgagttggtggtcagcaatatcacaaggctcatcgatttacctggaactgagttggctcagctgatgggggaagtggaccttaagttgcctggcggggctggcccagcatcaggattcttccggtctctcatgtctctcaagcgaaaggaaaaaggagtgatatttgggtccccactgacggaggaaggcattgcccagatataccaactgattgagtatctacacaaaaacttgcgagtagagggtttgtttagagtaccgggtaatagtgtccgacagcagattttaagggatgctctcaataatggaactgacattgacttggaatcaggggaatttcactcaaatgatgttgccactttgctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtttgcaccccacgtcctgtggccaaaaaatgtcactgcaaatgaccttcaggagaatatcacaaagttaaacagtgggatggcttttatgattaaacactcccagaaactttttaaggctcctgcttacattcgggagtgtgcgagattgcactatttgggatccagaactcaggcatcaaaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccagagtcagcaaagaagaaacaacttattagacagtttaataagcaatcattgacccagacaccagggcgagaaccttctacttcccaggtacaaaagagggctcgttcgcgctccttcagtgggcttattaagcggaaggtcctgggaaatcagatgatgtcagaaaagaaaaagaagaaccctactccagaatctgtggccattggtgaattgaagggaaccagcaaagaaaataggaacttattattttctggctctccagctgtcacgatgacaccaacaagattgaagtggtctgaagggaagaaagaggggaaaaaaggatttctctgaaggatccagagttgtctcctatggtccatgcagaattttctgtttagtgggcaggtgttattcctgcccacagcaaagcttggacttgcagcttgcttgctgcattttgaattgtcaaagccaactaataccgtgacccgactgatacctctaaccccactcactggatgatgtttgcaagctgtgccttctgagagagtgcttaggccctgtctctcttttttaatattatggggaaaccactaactatccaaccagcttatacagcacactaaggtgggcttcagtgctcactcaatgtgtttaggcagattccacttttgaaaaaaaatatgaaatgtgtgctcaactgccagtaattttttaaaaagcactgtcccagtggattgatgttgtttttaatggatattttgggtttttctctgttttgatagtattgggtatttggttgtttttgtttgtttatttctttgttttaaaagccatgtttttggttgggctctaagctagatatctttccctctttttcactttgagctttgggaaaactctttatcttatgaggctgtattcctcaatacctaatttgtgtccaaagaatttatagcttttctggacattttttattatttcttgggtgtgacatcagagtatttgacctgcagtattgaaaaaggagaattcagaatgatacagtattttaacaaatcttaattattaaactcttttccttccttccatttctccctcccttgtccatctctctctctctttccctttcctcagtgatgtgaaaataattgtgttttgctgaacttgttatcttcattcaatttcctcttgactaaaacatctctggtgccaacgtaatacttctgaaccaaatcactgtgactcaaggaaagtcactgacagcataagagaagtttgctaaaatatttgtatgtgggggaagctctggagtgtgcctaggagggggctggctgcctttatgtcccaggatgactctttatgggtgggattacattgcaccctctgagggtgcaggctagaccgtctcctgagaggaagttaggatcagaaagaagaagcaagcagcagcctctgcagggctgacaggatttaaaggagagaatgttcttatttggaagcagctgtggcttgtcaccaatgttcaaggagtgttactgttccgccctctctttgtcagaagggacacaggtggtaatttggagatggggccagagcttctggctttggatttggtgtgttcacttgtgttggatagagcagtggcatggctttgacctagtatgaactggtgtctgcccagagagcagcatgtagcaggggggaatgctcaggtttgtgcctggctctgtggagctgtacaacccttctcaccctgtgggttggagccgagtcaggccactatggggaagcagttgccccacaaaatgtggtttgctgacctatttctaaactgttgaatatgctgcaccattgctgaaatgaaagatgactctgggggagcagagcttggccttgtgcccagctggcagccccctctgccagcctttctgctgcttttgctgctgtaacagcaatagtggagaaaaatgtaaaatttggtcttccagcttaatgcagtgtgaacaatagatggttaggaaaacaaaactgcttagaagcccctttctctagagcagttttatgtcatttgtaaaaacacatattagcaaattcgtttgcgtaggtttctattaaatatttgactttttttttcttattaagaaaatgaaatcccttacaccagatatcagttaattcaaacagaaaaccctttgggtatcaccaaattgaaatggtattcttccttaactcttccttctttcctttatttgtttagacgtgcttcatcccgaagtggtgctatggtctgttaaacagggctggcatcaggtagagggagcagagtggtgacctgatagctcctgtcatcgtgttagtttttgattctatttaagggaagtagctgagatttagacggatgtagatgctctttgggtgaatggaatcataagcaaaggttgtgttctggggtgaggatcatgagagagatatttatcacatgcacatgcctttatatagctggtctccttgggtggtttatgtgtgttttgtttatttattgaatatgttttcccttgctttaggggttttataggtcatttttcttaatagaagctgtgatcgacttagaatccaaatttgaggagtaagcagcataaccttctaccttgtaatatgtaactattctaatccagtggaatcttacggaaaacacagagaaaaccccttttatcatttgccacagaaggctgctgtctcccttctgatttggtgggcaggtattgtttttgagccagtatttaacagagttttttaatctataagattttttttgaatctatttcattgtgtttgtttttcatgttggaacaatctctctggaagtgcctcttcttgtggcttttacaacttcatttctttctggggtcacctgtgatgggctttgatgtggtgtcaatttggggccttgtgtttgtgccagagggatacacatattaaactgcaggccaccttcctggtccagactgtactgtgtgaaccccactgactaaattagtgagaaccataggcgttggaatttctcaccttttacaatgatagacttttgcattgggaccaatgaatctggtgtgaaaaaccctgctgtagtagtgaaagagcatcaggagatactgactgtacctgagggccaaaacaggagcaggtaacgaaccgtaaaaaaaggagcaggtaatgaatcgtaaccaaaactacagttgatcctccgcaaaggaaagctctttacccagaatgtccttccagagtcattcaggaaggacaagggaacacccttgggaaatgggctagtggagggctgttgactgcagtgacacctgggtgctccggaggtatctgttctgttgacctgtaaggaagcagtcgatcctagagtgtcagaacagagccattctctcctcctgagtaggaacgtttctgttcagtttccctcacagcagcctgtgttagcatgcagttgaaaatactgccgtctaggagaacctgtggtcactgggaacgtgccccacagtgactggccatgcaaccaggtgatttttaggaatagatgtctctagactctgtctcctttcctacaaggcctcacacagatgcttgaggctaatggcccccattctgaggtcatttttgtgtagaactcctttccccaggagagagccttatctctgccctcctttaccctgaaggcttcaaacggaagacaggacctagatctaaacctagatactagcattttgtgggattgtctagaatttggggaagatttgggttcctaagatgcacaagcgttttacaccagtggtgattaactcaactaaaacccactgtaggaagttagcttccccagacagctaatgccgagatcttctaccagcgtagagttgacagaagcaggccagcgaggaggtgtgggacataatagcctgagtgcttgggttaccatggagactggagtgtgtgaggccacagcctgtgctaaagagccatggagccctcccctggccatgtctggggacagatagaacctgttgggggaaatattccctcaccccagggttctttctgcagagcaagggttgcctttgtcctatccctgagcttgctcaacaagagaaacaaggtttcttaagtgttttggttaaagttttcattcttatttgactatgtatatgtaattgtaaagaaacgatcctatgcattgtctttcttttatattcttgtaatattctgaaattaaaattgttttgtttcataaanaanaaaanaaaaaanaaaaaaaananaaaananaaaaaaaaaanananaananaaaggggggggcgcgcgcaccaaaacagtactcccccccagaggggcgcccaccgactaagaccgagaacacacaagagttattatggcaacaaagagggaggccaccaaaagggaggagagagaatatatacaagacgcagaagagaggtgggagcgaaggaaaaaaaaagaacgaggaaagagagggaaaaaaaggcagacgacagggagagaaaacacaggcgagcaaacaaggacacaacagaaaacaagggcgggagaggagacaaacaaaaaacgatggagcaacaaaaaaccaccacccaagacgacaacaccaaacacaagcacacaagaggaaaaaaacataaacaaaacaaaggagagaccacaacacacgggtgtcacaaaaaacaacaacccacagggaaacaacacgagcagagggaggccagagaagaacgaaagaaggccaacacacaacgagcacactcagtaccccacccgctgcacaacaaacttaatataccaaccacgagggagcacacctacaccgtaaacaaccacaagaaaccaaccaagagagaaaacaaggagaaaagaaaaagaagagaagaaaaaaagaggaaaacagcagaaaagagggaaggagagagagaggagagagagagagagagagagagagacaagaagcgaaagagagagaggaaggcagggaaaagagagggacaagagaaagagtggagaagagaagaaggagagaaaggacagagaaaagaaagaaaggagcaaagcacgggaaaaagaggagaggaggagggggcgaggaaggagagggaagaggagcgcgggaagcagggagaaagggagggggagggagagggagcagggagagggagaaggcaggaaagagagaggaggagaaaggaggagagacaaagaagaagagagagaggaggaagagacaggagaaggagagagagagaaaggacgaaaaagaaaggggagagaggagagaaggaggatggaagcaagcgcaaaggaaaggagagagcagagaggcagccaagagacagcgcacgaggaaggagaaggacagaaaaaagcagcacaagaagaggaaggaaagacgagaaagaaagagagaaacgaagaaagaaggaggagccaaagaacag

SEQ ID NO: 22487 - DNA, 6268 bp, Homo sapiens
  misc_feature (5528)..(5528): n is a, c, g, or t
  misc_feature (5531)..(5531): n is a, c, g, or t
  misc_feature (5536)..(5536): n is a, c, g, or t
  misc_feature (5543)..(5543): n is a, c, g, or t
  misc_feature (5552)..(5552): n is a, c, g, or t
  misc_feature (5554)..(5554): n is a, c, g, or t
  misc_feature (5559)..(5559): n is a, c, g, or t
  misc_feature (5561)..(5561): n is a, c, g, or t
  misc_feature (5572)..(5572): n is a, c, g, or t
  misc_feature (5574)..(5574): n is a, c, g, or t
  misc_feature (5576)..(5576): n is a, c, g, or t
  misc_feature (5579)..(5579): n is a, c, g, or t
  misc_feature (5581)..(5581): n is a, c, g, or t
ggggcggtgaaagaagtttgctgacgaagatggcgactgaggcacagagtgaaggggaggtgccagcccgcgaatccggccggagtgatgccatctgcagttttgtgatctgcaatgattcttcccttcgaggtcagcccattatctttaatcctgacttttttgtggagaaactccgacatgagaaacctgagattttcactgagttggtggtcagcaatatcacaaggctcatcgatttacctggaactgagttggctcagctgatgggggaagtggaccttaagttgcctggcggggctggcccagcatcaggattcttccggtctctcatgtctctcaagcgaaaggaaaaaggagtgatatttgggtccccactgacggaggaaggcattgcccagatataccaactgattgagtatctacacaaaaacttgcgagtagagggtttgtttagagtaccgggtaatagtgtccgacagcagattttaagggatgctctcaataatggaactgacattgacttggaatcaggggaatttcactcaaatgatgttgccactttgctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtttgcaccccacgtcctgtggccaaaaaatgtcactgcaaatgaccttcaggagaatatcacaaagttaaacagtgggatggcttttatgattaaacactcccagaaactttttaaggctcctgcttacattcgggagtgtgcgagattgcactatttgggatccagaactcaggcatcaaaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccagagtcagcaaagaagaaacaacttattagacagtttaataagcaatcattgacccagacaccagggcgagaaccttctacttcccaggtacaaaagagggctcgttcgcgctccttcagtgggcttattaagcggaaggtcctgggaaatcagatgatgtcagaaaagaaaaagaagaaccctactccagaatctgtggccattggtgaattgaagggaaccagcaaagaaaataggaacttattattttctggctctccagctgtcacgatgacaccaacaagattgaagtggtctgaagggaagaaagaggggaaaaaaggatttctctgaaggatccagagttgtctcctatggtccatgcagaattttctgtttagtgggcaggtgttattcctgcccacagcaaagcttggacttgcagcttgcttgctgcattttgaattgtcaaagccaactaataccgtgacccgactgatacctctaaccccactcactggatgatgtttgcaagctgtgccttctgagagagtgcttaggccctgtctctcttttttaatattatggggaaaccactaactatccaaccagcttatacagcacactaaggtgggcttcagtgctcactcaatgtgtttaggcagattccacttttgaaaaaaaatatgaaatgtgtgctcaactgccagtaattttttaaaaagcactgtcccagtggattgatgttgtttttaatggatattttgggtttttctctgttttgatagtattgggtatttggttgtttttgtttgtttatttctttgttttaaaagccatgtttttggttgggctctaagctagatatctttccctctttttcactttgagctttgggaaaactctttatcttatgaggctgtattcctcaatacctaatttgtgtccaaagaatttatagcttttctggacattttttattatttcttgggtgtgacatcagagtatttgacctgcagtattgaaaaaggagaattcagaatgatacagtattttaacaaatcttaattattaaactcttttccttccttccatttctccctcccttgtccatctctctctctctttccctttcctcagtgatgtgaaaataattgtgttttgctgaacttgttatcttcattcaatttcctcttgactaaaacatctctggtgccaacgtaatacttctgaaccaaatcactgtgactcaaggaaagtcactgacagcataagagaagtttgctaaaatatttgtatgtgggggaagctctggagtgtgcctaggagggggctggctgcctttatgtcccaggatgactctttatgggtgggattacattgcaccctctgagggtgcaggctagaccgtctcctgagaggaagttaggatcagaaagaagaagcaagcagcagcctctgcagggctgacaggatttaaaggagagaatgttcttatttggaagcagctgtggcttgtcaccaatgttcaaggagtgttactgttccgccctctctttgtcagaagggacacaggtggtaatttggagatggggccagagcttctggctttggatttggtgtgttcacttgtgttggatagagcagtggcatggctttgacctagtatgaactggtgtctgcccagagagcagcatgtagcaggggggaatgctcaggtttgtgcctggctctgtggagctgtacaacccttctcaccctgtgggttggagccgagtcaggccactatggggaagcagttgccccacaaaatgtggtttgctgacctatttctaaactgttgaatatgctgcaccattgctgaaatgaaagatgactctgggggagcagagcttggccttgtgcccagctggcagccccctctgccagcctttctgctgcttttgctgctgtaacagcaatagtggagaaaaatgtaaaatttggtcttccagcttaatgcagtgtgaacaatagatggttaggaaaacaaaactgcttagaagcccctttctctagagcagttttatgtcatttgtaaaaacacatattagcaaattcgtttgcgtaggtttctattaaatatttgactttttttttcttattaagaaaatgaaatcccttacaccagatatcagttaattcaaacagaaaaccctttgggtatcaccaaattgaaatggtattcttccttaactcttccttctttcctttatttgtttagacgtgcttcatcccgaagtggtgctatggtctgttaaacagggctggcatcaggtagagggagcagagtggtgacctgatagctcctgtcatcgtgttagtttttgattctatttaagggaagtagctgagatttagacggatgtagatgctctttgggtgaatggaatcataagcaaaggttgtgttctggggtgaggatcatgagagagatatttatcacatgcacatgcctttatatagctggtctccttgggtggtttatgtgtgttttgtttatttattgaatatgttttcccttgctttaggggttttataggtcatttttcttaatagaagctgtgatcgacttagaatccaaatttgaggagtaagcagcataaccttctaccttgtaatatgtaactattctaatccagtggaatcttacggaaaacacagagaaaaccccttttatcatttgccacagaaggctgctgtctcccttctgatttggtgggcaggtattgtttttgagccagtatttaacagagttttttaatctataagattttttttgaatctatttcattgtgtttgtttttcatgttggaacaatctctctggaagtgcctcttcttgtggcttttacaacttcatttctttctggggtcacctgtgatgggctttgatgtggtgtcaatttggggccttgtgtttgtgccagagggatacacatattaaactgcaggccaccttcctggtccagactgtactgtgtgaaccccactgactaaattagtgagaaccataggcgttggaatttctcaccttttacaatgatagacttttgcattgggaccaatgaatctggtgtgaaaaaccctgctgtagtagtgaaagagcatcaggagatactgactgtacctgagggccaaaacaggagcaggtaacgaaccgtaaaaaaaggagcaggtaatgaatcgtaaccaaaactacagttgatcctccgcaaaggaaagctctttacccagaatgtccttccagagtcattcaggaaggacaagggaacacccttgggaaatgggctagtggagggctgttgactgcagtgacacctgggtgctccggaggtatctgttctgttgacctgtaaggaagcagtcgatcctagagtgtcagaacagagccattctctcctcctgagtaggaacgtttctgttcagtttccctcacagcagcctgtgttagcatgcagttgaaaatactgccgtctaggagaacctgtggtcactgggaacgtgccccacagtgactggccatgcaaccaggtgatttttaggaatagatgtctctagactctgtctcctttcctacaaggcctcacacagatgcttgaggctaatggcccccattctgaggtcatttttgtgtagaactcctttccccaggagagagccttatctctgccctcctttaccctgaaggcttcaaacggaagacaggacctagatctaaacctagatactagcattttgtgggattgtctagaatttggggaagatttgggttcctaagatgcacaagcgttttacaccagtggtgattaactcaactaaaacccactgtaggaagttagcttccccagacagctaatgccgagatcttctaccagcgtagagttgacagaagcaggccagcgaggaggtgtgggacataatagcctgagtgcttgggttaccatggagactggagtgtgtgaggccacagcctgtgctaaagagccatggagccctcccctggccatgtctggggacagatagaacctgttgggggaaatattccctcaccccagggttctttctgcagagcaagggttgcctttgtcctatccctgagcttgctcaacaagagaaacaaggtttcttaagtgttttggttaaagttttcattcttatttgactatgtatatgtaattgtaaagaaacgatcctatgcattgtctttcttttatattcttgtaatattctgaaattaaaattgttttgtttcataaaaaaaaaaaaaaaaaaaaagaggaaaaaagaaaaaaaaaaaaaaaaaaaaaggagaaaaaaaaaaaaaaanaanaaaanaaaaaanaaaaaaaananaaaananaaaaaaaaaanananaananaaagggggggggggggggaaaaactggcgagggggaaacaacaatcgcaagacctaagccaaactcctttagtagaaagcgaaagacgggaccacctagaggggggaggaccactaatataagagcacgacagagccccggagcagagataacaaacagccccatcagcgggagagaacgacaacaaaccaccacaacgatgagaccaactggagggaaaaaccccaccctcgcactcggagcaggcacagccattataagcaaaacaccaacacgaagagaagaatatcaccacgcagcatgttataccaacagacatatgaggaacgtaactagtggtgtcaaccaccaaccgcataggtatgggcggcgaaacaaaaacgtccagcaaacggacaaaatctagagataaaaaacatctcacgagccgggggggtggctgagaataaaacaaagggagcagaaaggaagagacaagaagaacgcggccgcagatggaaaggagagccgaagtaggaaccggcaagcagatgacgtagccgctaaccgagagagcaggacgaggcggacaagaacacaccgctagccaaaaacaacacatagtgagcaaagacacaaagcaacagcatccatacccctaccggcaaagacaacgaaacacacaaagcagtacgacaaagaagaagc

SEQ ID NO: 22488 - DNA, 1239 bp, Homo sapiens
  misc_feature (1234)..(1234): n is a, c, g, or t
ggggcggtgaaagaagtttgctgacgaagatggcgactgaggcacagagtgaaggggaggtgccagcccgcgaatccggccggagtgatgccatctgcagttttgtgatctgcaatgattcttcccttcgaggtcagcccattatctttaatcctgacttttttgtggagaaactccgacatgagaaacctgagattttcactgagttggtggtcagcaatatcacaaggctcatcgatttacctggaactgagttggctcagctgatgggggaagtggaccttaagttgcctggcggggctggcccagcatcaggattcttccggtctctcatgtctctcaagcgaaaggaaaaaggagtgatatttgggtccccactgacggaggaaggcattgcccagatataccaactgattgagtatctacacaaaaacttgcgagtagagggtttgtttagagtaccgggtaatagtgtccgacagcagattttaagggatgctctcaataatggaactgacattgacttggaatcaggggaatttcactcaaatgatgttgccactttgctgaagatgtttctaggagagttgccggagcctctgctgacacataaacacttcaatgcacacctcaaaatcgctgatttgatgcagtttgatgataaaggaaacaagaccaatataccagacaaggaccggcaaattgaggctctccagttgctcttcctcattctccctcctcctaatcgtaatttgctgaagttattgcttgatctcctataccagacagcaaagaaacaagacaagaacaagatgtcagcctataaccttgcccttatgtttgcaccccacgtcctgtggccaaaaaatgtcactgcaaatgaccttcaggagaatatcacaaagttaaacagtgggatggcttttatgattaaacactcccagaaactttttaaggctcctgcttacattcgggagtgtgcgagattgcactatttgggatccagaactcaggcatcaaaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccagaatttctaacccacaaagccccgagtcacaataaatgctatgggacaaaaanaaaaa

SEQ ID NO: 22489 - DNA, 199 bp, Homo sapiens
ggatatattaatttactcttcttttaaattttccttaggatgaccttgacctcatagcttcatgtcatactaagtcctttcagctggcaaagtctcagaaacggaaccgggtagattcctgccctcaccaggaggagacccagcaccatacggaagaggcactgagagagctgtttcaacacgttcatgatatgccaga

SEQ ID NO: 22490 - DNA, 1032 bp, Homo sapiens
ggtttctagtgacgcaagtacaatattttgtgccaaaatgttaactaatgattacttatgggccttatttctactttctattacatgaacatccattactaagaaagggttaagaacaaaactgaagtattcaaatagcaagtcatcttatattgaaattttaattcagcatcaaacttactaaggcatagtctctaggcttgaggatcctgaaggatgggggtggagggagaagaaacaggcacataagcgaagaagcataatgcaatataagttctatgcttagaagtatttgtaaaaatgccatgggaacacagaatagggagcaattgtgtcaggtacagatgatgggggaggaactttaggtgcaggtaacaacagtttgtgcagaggcatgaagataggcaacacaaacacatggtgcattatgggggaggcaaggaatgcttaaaaaaaaaaaaaagagttacgagcaatctgtctggaaacaaaccctaaccaaactgcaatcaaattgattttgaaggaaataaggagaaccactgaaatattttaagaatgagaatgacctgaacagatctaaaatgtattcaggaggacaattacagggctatttcaaatagtttaggtgcaggtgaaaaatgggtgcttcaactgagcacctagctacactgtgaaatcataaagctagggaaagacaagatttaagtaaaagctgtgatggggtggtgattaactcaggccagcaaaacaatgataccctcaacagattttccattaatcaggcaagcatcttcacagaaacaacttcaaactgtaaagactaagatttatataattttgttatgaaaaagttggccttttttttttttgagacggagtcttgctctggcaccaggctggagtgcagtggcgcgatctcggctcactgcaacccccacctcctgggttcaagcgattccccagcctcagcctcctgagttgggattacaggcatgtgccaccacacccagctaattttttgtattttta

SEQ ID NO: 22491 - DNA, 444 bp, Homo sapiens
atactggatggggcagtttacctgagaaaagatcttatttcattgtcatgacaaccacagaaagtacatactttgatcttcatcttataaacaatgaatccaagtcgctgagaagttaaaaacttgctcagggtaacacgagacagaatctgactctgtcgcccaggctggagtgcaacggcgcgatatcgactctgcaacctctgcctcccgggttcaagcggtccttgtgcctcacccccctgagtagctgggactacaggcatccgccacctcgccaggaagatgaccatcttttactgcccaacgacatctttctaccaatgtgaacagagactagcagcacagtgatcacctgcagatagacctggctttatctgtacataacaccaaaagaaaaaacctggattccagaaggaaataaagattttcagtccctgcaaa

SEQ ID NO: 22492 - DNA, 607 bp, Homo sapiens
acaattccattggcatggtccttcaccgaccctatgatttgcactttttatttctatgtgtgccacacacaatgcagtattaatggcaaccaggtaaatattgatttattttttaaagcttttcttcagtgttttgtcaaccatttcaaagtgtctcccaaaaaaggatgctgaagagcaattgctcccttaagcaacagattcatatttaccctgggttaatacaacaaaaggcctgtataattgtcttttcattgttaacacccaaaatagcatctatctagacagtatccccaaagaatttggaaaatctgatggtgtgagcagcagccgttagtatcagggtttcccattcttggacagtccgaggctgtgacctgttagataattagattatacttgaactggaccagagtttgttttttgaatttatgagaaaaaccaaaacactaagttaagtttgaacttgtaaagtattgaaatttgttgagtgtcctataaattgtcactacttttcctgatctgtataactgactgcaaagtgtttgtttttacaaaagagaaaagaaaagatttttaataaagagaatttgaaagctgtgagtga

SEQ ID NO: 22493 - DNA, 509 bp, Homo sapiens
gccactctcagcagcctctgcttttccccatgccatccacaggccaggcccagctaatgcagacatcccacacatgctgtcctatacatgaaagtgcccaagtcctccccttcaactatgctgtttgatatgatcccaagagtgtttcacagcatccttgatttcttaagtaagatgctccaggctctagccaggtacagtggtgcacaactgtattccccactactcaggaggctgaggtaggaggattgcttgagcctataaattcaaatcaagcctggggaacacagtaggaccttgtctctttaaaaaaaaaaaaaaaaaaaaaaaaaaaaaattccgggggtttgtgtttcccattttctttaagaacggaaaaaggccctttttttttttttccaaaaagccgggggttttaaaaaggtggcaagggaaaattcattgtgtatactctccttcgggggaacccttttacaaactataaaaggctttctggaagggaaagtggg

SEQ ID NO: 22494 - DNA, 1481 bp, Homo sapiens
ttactgcgctcctgcctctcctcagggcagctgggaactagctgcctgcccctttcagtccttgagggaactcgcccctttgccctggcctgtgtggtgttaaagctctgtttctcgggcacctcctcctccaaaccccggaccagccgcccagcgccgtcagagcagccccgactagcctcctctcctctcagccgtctgactcctctccccagtctgtagtcccctcaatttgcatcctttagccccgcttggaaagagaccggagagaaatttgcccactacccccgcgagaagacccacttgtcagccgtgtctcggggtggggggcactgcaaggcctggcgctgttttgtgcacgttaaatgcccagcagtatctcccagaccggcaacccccgaccctccagtctccatgtcttacagaagccaaattcgagagttatataatttctagtgctgctgttgctcctgcctgaggaaacacttcatcgcgtggagggtgcaggacatttcagtgctcttccctaaaagaacggggcttgggcaggggtggccagcggtggcaaagaaatgtcttgtcttttctgcaaaaggaaggtgggtagtttgaagagagattgagagaaaaggtggatgtgaaagccaagcagctgcactttctcatttaggaaatcgcggaccgtttacatagcttatgcttacatgtctaatactactacggcgtctctgaaaacacctttgggggaaggtttggcttctctcgaagtctcagtgtttttcctcgccggatagggagctgcttgaatgcgaagagatggcatgatgtgaatgactccagtgtgaagaaatctgcttcgccaactcatcctgcatcaagtgcccattgagtagcactgtcactttaatgtctccatgccaagggattgctttccttttttttcaatcctctcggttaatacatgggaggatcagaatcagaggggcattaaggatcaagcctgggggcttggagagcacagaagaaaaaaatgaaagggacagcaagctggattctgagttactgaggggaagactcagcctggatttcaaaactgaacactgaagtggtttgcaacagttacctggctcttggcctcaatccagctggatcaaactgagacctgaaaagagatattgactcctgtggcagtggaaagacccaagaatgccagtcaagaagacagagagtttcttttggattaccttattttgaactaataatggaattaaacacattacgtgtgtgtgtgagagagagagagacagagaggaaaagagtgaaaggaagagagaatgggaaggaggagagacagagaaagagataaaaagatactgaccgagctttatcattactggaagaatactgcaaaaaattaaggaaaccagaggagcagctgttgaaaaatgcggttaaaaaggtgatgggtatctttaagagca

SEQ ID NO: 22495 - DNA, 740 bp, Homo sapiens
tggggttacatttttctctacagatttgagtatctttatcatcatctttgaatttgaccatgtataaagtaatgagacctgtctaaatttggtttgtgccttaattgagttagtcattgaacttccaaaaatgttgctgcctgaagaggaatttcagtaacgttcttcatgtttacaataattttcccagtttgtaaaaacagtctaaatattttctgaaaattgaaaaacttgaaaaactaaaaaattacgttgctgtaaactctgtgggcggtgtaaaaagtttagttgtggaaaaaatacatcattattttctttgtctgacatagaagactcagcctggatttcaaaactgaacactgaagtggtttgcaacagttacctggctcttggcctcaatccagctggatcaaactgagacctgaaaagagatattgactcctgtggcagtggaaagacccaagaatgccagtcaagaagacagagagtttcttttggattaccttattttgaactaataatggaattaaacacattacgtgtgtgtgtgagagagagagagacagagaggaaaagagtgaaaggaagagagaatgggaaggaggagagacagagaaagagataaaaagatactgaccgagctttatcattactggaagaatactgcaaaaaattaaggaaaccagaggagcagctgttgaaaaatgcggttaaaaaggtgatgggtatctttaagagca

SEQ ID NO: 22496 - DNA, 1010 bp, Homo sapiens
ttactgcgctcctgcctctcctcagggcagctgggaactagctgcctgcccctttcagtccttgagggaactcgcccctttgccctggcctgtgtggtgttaaagctctgtttctcgggcacctcctcctccaaaccccggaccagccgcccagcgccgtcagagcagccccgactagcctcctctcctctcagccgtctgactcctctccccagtctgtagtcccctcaatttgcatcctttagccccgcttggaaagagaccggagagaaatttgcccactacccccgcgagaagacccacttgtcagccgtgtctcggggtggggggcactgcaaggcctggcgctgttttgtgcacgttaaatgcccagcagtatctcccagaccggcaacccccgaccctccagtctccatgtcttacagaagccaaattcgagagttatataatttctagtgctgctgttgctcctgcctgaggaaacacttcatcgcgtggagggtgcaggacatttcagtgctcttccctaaaagaacggggcttgggcaggggtggccagcggtggcaaagaaatgtcttgtcttttctgcaaaaggaagaagactcagcctggatttcaaaactgaacactgaagtggtttgcaacagttacctggctcttggcctcaatccagctggatcaaactgagacctgaaaagagatattgactcctgtggcagtggaaagacccaagaatgccagtcaagaagacagagagtttcttttggattaccttattttgaactaataatggaattaaacacattacgtgtgtgtgtgagagagagagagacagagaggaaaagagtgaaaggaagagagaatgggaaggaggagagacagagaaagagataaaaagatactgaccgagctttatcattactggaagaatactgcaaaaaattaaggaaaccagaggagcagctgttgaaaaatgcggttaaaaaggtgatgggtatctttaagagca

SEQ ID NO: 22497 - DNA, 1037 bp, Homo sapiens
gggtacatcattacataaatgcaagaacatcctgtttcaaatgatgacccagaaaaccacactgatggcagtgatggccagccctgaggtcttgtccccgccaccatgtcgagagttttagtggaatcactccgtgaaggtgctgttcagataaagccaaaaaccacgccaacaaacgtttcctgagtgctgctttgagcaaggtgcaagctaggttcagagaggggagggcacgagagccgtatttatctcaccctggagctgcttaaatctggcaaagcaaggacacaaggaaaatcatgacgttacatgtctatacaagatttagaaagctcccagacgagactagtagagctgtcactgtccttcggcaggtgtgtaagccctgtcctgtgccttcctttcccttatcagtaaaaacggggacaaaattgtactcacctcatgaactcttactgaggtctgatgagatagtgcatataaagtgctcatgccaacaccccaggacgttgtacgcactcaacacatattcacagccattactgttgtcatcattgtggccatgagtactgtgcccgttgccataggaagcgcattggttgaagttcctgtaggagtttagaagtgagcacttctggagttgggcgtggtggctcatgtctgtaatcccagcatattgggagactgaggtgggggatcacgtgaactcaggagtttgagaccagtctggcaagatggcgagactctgttgctaccaaaaaaaaaaaacaaaaaaaaaaaactttttcggggcggcctgggccctggaaaaatttttaaaacccattcggttggggccggggccccaatggttacgggacactgggcccaacacgggggccccaaaggagaaaccccggggccaagaaaagaggggcgtggggttctcccccgaataaaaaacacgccggggggaaaccgagggtttggacaaacccagaaggggcccagaaggccaaacgggcccaccaacgggggcccaggacccaaaataatag

SEQ ID NO: 22498 - DNA, 974 bp, Homo sapiens
  misc_feature (1)..(2): n is a, c, g, or t
  misc_feature (5)..(7): n is a, c, g, or t
  misc_feature (533)..(533): n is a, c, g, or t
nncannnggtgatgaggaccagcaagaatttgcaacaggaacgcagcttccatagcaaagtcaaggggaggggagctgccgccctgggcttgcctggcaggaattagcttatgtaccaaattgtttgtgacagtgctgagcaggagacgctggcttgtgaggaggaaggcttttttaaacaatttggttaaaatgttcaaattgccagctctgactcttgccctggagaggagggcagcggcctgctgttgactccctgatggctggagcagtggaagccactaagaatggctaaagatcacccaagctacgggcaagggcaatctcgtgggtccgcagcccaaggcagagagagacatggagtttaccacctccccggcagctcctgccactgcccagcgtcttgatgaaacagtatggaaacacggctgtcatttatccaggtgtctgcctagcaggtacaggaatgtgggcttggggactggagcccccaccttaaaaagaggtgaggcaatggaaaggaccagaggggncctgattcagcaatttacagtgccttggagctcgccagcagcacctcatttgcatctggattccagccctggcatctgcctcgccccgctctgctcacaaagtaaccccactgtctttccacaaagccaggcactccttagcctaacggcagatcctagccctgagtgcccagaaattctatgtaaagaatgagaaccaaaccaggctcccactaatttagaattcaaacaaccccaaagctaaaataaccccaatttttttctatattgcatagtcatcagtgagctttataattttgtcctagaaacccccccagagtccctaagtgcctttggcctatcaaagtaagactcatttatgttcagtctagtttgtgttaaatgtgttttgtgctatcctgattcctttaaaaatggtaattcattcatgagaaatacgat

SEQ ID NO: 22499 - DNA, 444 bp, Homo sapiens
gttggcaaagcataatagcttttgaaggtgcttactgtggttcaaatgtgtaccctccaaaattcagctgctgttaatgtgatagtatcaagaggtagggcctttaagtggtaattttcccatgagggcccctcccttgtgaatggggttaggtgctcttataaaaggtcttgacagagggagctcctctcttttggtcctttctccatgtgaggacacagtgttcaaggagccatcttggaagtagagaccgaaccttcaccagacagtgaacctgctggtgacttgatcttggacttcccagcctccagaactgtgatgagtacatttttgttctttatcaattaccaatctcagcagcactaaaacagtgctcatctgctgtttcaaccaacaaactataagaatttcagttccattggtaaggccatgaatatagcaagg

SEQ ID NO: 22500 - DNA, 508 bp, Homo sapiens
attacaggtgtgagcgaccacacccagccatgaacagcatgtttgaagagtctagtacacagtacttgactgacaaaagtgagtgtatgtcttaattcccttctagctctgagatcccatgcattgcctgctagttggggccttgaaggaagtggactcagcacagctggaccatgggatgatggatggagtgatgctgggacagccacaggggccatgaaaaggggacctcatttaatgaatattacataccagaggcagccaaaaaatctggaaagactattcagactgttggatagcatgagaaagaacccccaaagactgcttaatagatttaaatttacaagatcactgggaatgatttttcctccccctgggattaactcagttggcagggctctccttagttcagcaaataactcttctagaatatagaaaaaattggcttgtgacagctttttgattcacaagtatttactgcatttacgacgtggcaggaaccagacac

SEQ ID NO: 22501 - DNA, 458 bp, Homo sapiens
gaaatcctaaatgcattccatttttaactagcacaaaatggaaatgacttttcaggaatagattagaaagctatgaccttgaggactttccacctttaaagtaagattcttttgtgaagcaattcaggaagatggacggtgaacattcaattcattaacatctgagaaccatgaagagagtattttttgccacaagcaaaaatgaacctaaataaaagactggtgggggaggagaatcataacgaccattatggcccgcatcttatgggctgctgcgcagttagcatgaggggaggccttgcacaagctcttcccctcagcctcagcatcctgttctgcctcatttgtggcttgcgtcagactgagtcacccagcgcaatgtcactcttcctcaggggacttctctcaaccttccaccttctacagagagcttgatggatggtgaggttgttgcaacc

SEQ ID NO: 22502 - DNA, 429 bp, Homo sapiens
taacattattgccacaactaaatttctgtttaactgtgttgcagaatatgataatgtcatctaacatcactccctacttgcaacattcctctgtgaatattaatatagttaaccctcccttattatgtatcatatcaataagtttctcttcccttggattaatttttgcttctttgcattacattttatcttgtgctaagataacaaaaagcaagcaagaataaagatccagatattagccatatgtagaaagttcctggtgtgcatttctgtgtacttttccctcacatattagaattgtcaggaaagtttttttcttttggaactttctgtttacattttgcatgatcttataaattaacctgaagagtaattggataccttttatggttatttgaaaataaaatttgctacaaataagaaaaaaaa

SEQ ID NO: 22503 - DNA, 331 bp, Homo sapiens
ccgcggcgccgccctccacccaccgtgctgccaccttgcaccccccgtgccgccctccacccgccgtgccgccctccacgtggttctgagacacaggacggagctatcagggcacccgtcgaggtcaggaggcgtccggggcatcaggagaaactaccggcaaatacccaagaatccaggaagacccgggatgaggagaagcccccgagagtaaagcccgggacgagggccccccacggcacccactgagcccagacatccctgcccagagccacccaccacggcctccccatccaccgtgactcactcgagtgaagccaataccattgca

SEQ ID NO: 22504 - DNA, 412 bp, Homo sapiens
gcaatcacttcgtccattctgatttccaggagaggcactgggggctcggcgtctgcaacaacttcgtacctcaggggtttggtgtttcggcgtgtgcacacgccgagcgcccaaaccatgagaatttgcaacaggggaggaaaaaagaaccaaaacttcccaaggccctgctttttttcttaaaagtactttaaaaaggaaatttgtttgtattttttatttacattttatatttttggtacatattgttagggtgcaggtcagaatggacgaagttgttgcgcaacaacttcgtccactacgatctgcaacaacttcgtccatccagacttgtgtcacaagggtatgggttctcggcgtgtgcagcaacaacttcgtccattgggatctgtgtggaccttcggcgtgtgca

SEQ ID NO: 22505 - DNA, 645 bp, Homo sapiens
gcaatcacttcgtccattctgatttccaggagaggcactgggggctcggcgtctgcaacaacttcgtacctcaggggtttggtgtttcggcgtgtgcacacgccgagcgcccaaaccatgagaatttgcaacaggggaggaaaaaagaaccaaaacttcccaaggccctgctttttttcttaaaagtactttaaaaaggaaatttgtttgtattttttatttacattttatatttttggtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttcttttttttccttttttgtctatgaagttgctgtttattttttttggcctgtttgatgtatgtgtgaaacaatgttgtccaacaataaacaggaattttattttgctgagttgttctaacaaaaaaaaaaattc

SEQ ID NO: 22506 - DNA, 821 bp, Homo sapiens
gcaatcacttcgtccattctgatttccaggagaggcactgggggctcggcgtctgcaacaacttcgtacctcaggggtttggtgtttcggcgtgtgcacacgccgagcgcccaaaccatgagaatttgcaacaggggaggaaaaaagaaccaaaacttcccaaggccctgctttttttcttaaaagtactttaaaaaggaaatttgtttgtattttttatttacattttatatttttggtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttcttttttttccttttttgtctatgaagttgctgtttattttttttggcctgtttgatgtatgtgtgaaacaatgttgtccaacaataaacaggaattttattttgctgagttgttctaacaaaaaaaaaaattcacatgaaaccctctctctactaaaaatacaaaattagccgggtgtcatgggcgcctataattccagctaccaggagactgatgcacgagaattccttgaacctgggaggaggagtgttcagtaagccagatggcagcattgcacttcagcctgggcaacaagagcgaactcaaaaa

SEQ ID NO: 22507 - DNA, 388 bp, Homo sapiens
gtacagcacgagggcaaccagaatataaaaagcataagtttcaaaatttaaaatttaataacataatcatagtctgagaagtcctaaacattttaataacaaaagaaagtaaaaagtgggcaaaaaatttgtatagacacttcatcaaagaaatatggatggcatattatttaatttttctaatcttttttctttttttggctctgttacgttagtaacttacaacttttctaaccttatacaggtatgcatccattttttaaaaatcagtaaaggttatctggttgagaagtttatgatctacttttattttctttgttcctcactggatcttttaaagtgcaaatcctagcaaatgaaacctgaggaagaaagtctctaatcgggg

SEQ ID NO: 22508 - DNA, 264 bp, Homo sapiens
tggcttcccaaagtgctgggattacaggcatgaaccatcgcacccggcctccattgtttggttttataaagaatattatagtgaacatctcttgtatatagatttgtgtgaacaaccatgattatttccttagcatatattcttagaagtagaattattgggttcaaagggtatgaatagtttttaagttattaatatattactgtccggaaaggttgtactaatctcattgtttttacttttaaaactgattggtagagggat

SEQ ID NO: 22509 - DNA, 475 bp, Homo sapiens
aattttgcagtaataatattaagtaatcttgatattcacctggatagcatgtctcttgattgcctccaaagtaaaatccccattctggttggcttctttgaatgcagtgctgctcctaacacccctcctcacatgtgccctttaaggactccacctttctcgcacatgtggtttcatccttgagcttgagcctcactggtcagaaccacaggatcgaccaagggctctgatacagactctcattatcccatttatctgagctagcaacagttagttctttttaaagattcaacaatgcttttattacttttttaaggtcttttttcctccttccaaagttgtgtatttgggggaagggcagggaaagggatgtaaatgcttaagtgtttctatgaaccagaagtgactagggtagggttacaggcaggtcaaatgacatttgtttggatgcattacatttaagcaaccttctgtt

SEQ ID NO: 22510 - DNA, 314 bp, Homo sapiens
acaaccacccaggaaaacattgctatgtccctaccagaggcatacttcctttataaaggaggtttggggtcttcttaaagtcccacagggactccatccccctcagctgtccatcagtgtgccttctactgtccctgcagaatggtacttacttccctctactgcctttcttctctccaaaacctcccttctcatttgccttcctcttccatagtgggcaggtatcactaaggctgcccagtctctccccgcaagaccgccttctgacaattctccacttcccctccttgcgcattcccctgcctcctttgccc

SEQ ID NO: 22511 - DNA, 454 bp, Homo sapiens
tactgtcttcccatctgagcactaaattcttattaatgatgccaaaagttgtattggcaggcaaaacaaaaattgctcttttttattttttgcatgaacttccattatgccagtctttttcctcacatgtatgtacaactaaatttttaagcccaaagacaactgatgttcaattttggtgtttatggacttattttcccttccttctgttttgccatttctcttgtaattttctagtgtttagttctataaaactattataatgcaacctcaaaagattggactctattaaagttgatgataatgagactttgactttaataaattcacctttgccttaattataaagaaaaactttacaaaattcagctaccttcagaaaacgaattctttaaaagaccatagtgcaaaatgatgctgtcatgaatctcattggttcattcagccaaaaaaa

SEQ ID NO: 22512 - DNA, 452 bp, Homo sapiens
tagaggcaacacaagcttttggaagtaattggcatgtgtctgtctaatccagtaaagccttgcagacctacctgatatccacactgatcttggccttggccttccctctctcaacatgcaaagccattcctctcccaggcccaccatgtggcccctaagttaaaaccaagctaaaatggaaatatatttagttgttataaaaaaataaaatgtgggcagtctcccaacagaaataatcagcctgcttgcccagagggcaagtgctaatgtatcagagcagaggaatgaagtggggaggaaacagaaggctgtctcccaagcctggtccctaacaccctgtgcactcaataaacaaacagccatttgaatcactttggttctccttttttattattctgcagaatgataaagacctaaagcctgtttatatagtgttttcatggctagagttg

SEQ ID NO: 22513 - DNA, 243 bp, Homo sapiens
tttccaagtgaaaggtgatggaatattttgacagcatgctgctaacttaaacatttttgtttaatgtaatttttgtgtctaagtgctcccaaccaccatttccaagacaagaagactcatgagcattcagaaaacatttggcactgtttcattttaattttttacttctccttgactctttgagcctagaaagaattttctctgtagttgctcacccaggtacaagtgtccttgagttaatct

SEQ ID NO: 22514 - DNA, 215 bp, Homo sapiens
ctgtcatctgtggcctagaacatggaacactgaccaactagagaattcccatttttacccccacttgagacctttatctgtactgtactgtcgttttttttccccttccctttgcccctcccccaagcttgcaaattccccatcttatcatttttcaactccagtaatctctactggactcttaagactagatttcatcattcacccacctaccc

SEQ ID NO: 22515 - DNA, 232 bp, Homo sapiens
gagaaaaattcttaaagcaaattatatgctactacaccaaaatattttgaacaatgttacacaaaaacattaacaaaaaatatcttcccatttaaaaaaaaaaaggaatacaaaagggaaattggttaatgcagggaaaataatcataacaacatcaatttaccaaatgaataacaacacaaagtggatgagccagggctgagattctcaaaataaagcagacggggcgtcc

SEQ ID NO: 22516 - DNA, 312 bp, Homo sapiens
taaaagataactaacattaaaaaatatgaatgctatatgtgtactttatttatagaagaactgagcctggagtagaggaggcagctggatataaaaaagtgcatagactggcatcaaagagagctcactttgaatctgggttttgccaagtgtgttatcttagaaaagtcatttaactccctgaccttcaattttttcacccactaagttaatagtacctagtacaacatgaaattaggaggatgggaaatgatctacataccaccataccattgctatgcaatcgtaagaactctaaatataacttctctc

SEQ ID NO: 22517 - DNA, 503 bp, Homo sapiens
aatggaatgatttaaaatgtctctgggcacaatgaagtgctcctagagcttaaagtgccagaaaagtgtacagggtttccctccatgtcctgcctctctcctttactgtctctagcccagcatacaccgcctgagtttctagggccatgttcctgcacctggtactgtctccttcaagctgtgtgttcctccttgtgccttaatttcccttagttgtcaatagtatcgttgtcaattgattatgttatctacctcataaggtcagtatgaagattcagtgttctaatgcaggttcagagacctgagcaggttcctgcaatagaaccagtgtaaaaaatgaaaagggctatgtgttggtaaagatcaatggttttcagaacacagagaagtgtctcaaagccagtgaagaatatttggcctaaagtaaatttctgtattgtgatttgaatagcaagcaaaatccatttaaaccctagcaagaatactatctcctcaaaaaaaaa

SEQ ID NO: 22518 - DNA, 1052 bp, Homo sapiens
gccaggcttagacgctttatctttattttgaaggcaatctgtgggtaaagaacaaaataaaagccttgtccctttgttcccttagccatctttcttatgctttctttgttaccagatagggcctttctcatactaccctggaatactgaaatttcagactaaatcagtcaggtggctgggagtgcaagaaatccttggcaagacccttctccccggaaagcctcctgacagcagagtacacagtgtcacaccttagaatgtccaccatgaaatgtaatggtgctcagtgtagcagatgattgcaaggccagtgtgaaggcaatctacccacaacatttataactctgcgggttgtcagcttcatgagctatgcagctgagtaggaaggcatctcctgactttcactcctcaagatccattctctatgatgcccttcccacttgaaagagctttctttagccaaggtctttctttgatactctgtccccctaaaaatcagtgcttttgaaagtcatggccagaatagtataaacaacagaagggttttataaatgttaatactttgatttcgcaaattttctgtcacttggaatgattcttaatacaaaacaatgtacattataaaaataaattcatagctcagtatagaactacattatctgcaaactctacttacacacatcaaatcataaagggtagcaggaagttgttatgaaattttgaatcacaagtacaaggatcaaataaagtatacaacactcaaacgtccagtttcatgaacaaaccatcacttccatgtaaccacaacccagatcatgcgatacgacgtgaaatcatacagcatgcactctttcgtatctggcttcctaaactcaaccctgagtttagatgaatttgaaaaacaagttagataacttataccaagaaatatcaagacttataacattattaattaaaatcatgtaattggcacacaaatggaaaacagcaataaaacagatcatatgtatgtgtacaatcacctgatttatgacaatctatattgactatat

SEQ ID NO: 22519 - DNA, 353 bp, Homo sapiens
tcttgctctctgtcatccaggctggagtgcagtggcatgatcttggttcactacaatctcctcctcccagattaaagcagttctcatgcttcagcctcatgcttcagcctccaagtagctagaactacaggcatgtaccactacgcccaattaatttttgtatttttagtagagatggggtttcaccatattggccaggctggtcttgaactcttgacctcaagtgatcctcccacctcagccttctaaagtgctgggattacaagtgtgagccactgcaactggcctaatttccttctttaaaaaacaagaaagatctcaaatcaatagcgtaacatacaacttaatgaact

SEQ ID NO: 22520 - DNA, 466 bp, Homo sapiens
caggagtaactgaggttaatcaatggaaaatgcttagaatagtgcctggcacatactaaacgctcaacaaatgttagctgctgctatcatcatcatcgtcatcattatcattaagtttattgtgataataggataaatttctaggatgatacaattcaagcctttagagcattgagagcgtaaacgtgtcatcagtactccacatttctgtgtagaaagaatgacaaaaggtattcctgttttggggaagataactttgaaacaagtatttaaaacatttctctgagaaaaaaaatagggaatcacagttaggtgctatacaagtcagctttttttaggtagggaaggttgcatattcagtccttaaactctgcaagaattgcactgcttccctgtgtgactcttgaccctgtggaagacaagtggggtgtgaaatctgcccaaatcatctcccttactggatgaa

SEQ ID NO: 22521 - DNA, 449 bp, Homo sapiens
tttaaaacatagaaccatgtttcctgccattgggaaactttgagaaggtctcaaatgattacaatataatagctaagcactacagtatgggaaagtggcaaggactgcagagaggaaggctttgattactctggggcagttttggaagactccctagagggtgaaacatttcatcagagaagatgaaatatgacaatgcagggagtgtaacatatgccatggttccaaagtgtggaaaagccttaaataacaggcagtttgattagtgattgccaatctggcttttaattagaatcatctggcaaactaaaaaatgtactgattctgaagtctaatctccagagattcttatttaactacttttaaattgggaccagacatttctttttcagcaccatttaaaggaatacaaagcatatgcaaggtatcctacatatgctatttaaatt

SEQ ID NO: 22522 - DNA, 413 bp, Homo sapiens
ccttccctgctgcatccttcctcatccctcaccctcctcccagaagtctctagatttaacccccaggggttgtcccaaggggctattaagaaccttcaaggagcttgtgaaattggggctcaacactgaagtaacaaatagcagctgctatttactgaacacctactatgtgttaggcaccgagctctttacatgtgttttcttcttaagagccaattatagtcctaaaaggaaagtattattgccagcatttcacagaaaaggaaacccagcttcaaaaagctggagtcagttgctcaagtacacatggctgacgggcaaaggcaggatttgagctcagatccagagcagcactgtccagtagatatataatgccagccatgtgtggaatgtaagattttctagtcatcaca

SEQ ID NO: 22523 - DNA, 183 bp, Homo sapiens
ttgtgccattgcattccagcctgggcaggcgacaaagcaagaaaaaaaacagataccttgaatgataacattaatgataaaaattgcatagcataacagctattcacatggatgtcagattagtcactgttcagctttctctttaatactacccaagtatttcatagtgtttaggatttactt

SEQ ID NO: 22524 - DNA, 463 bp, Homo sapiens
agccaccaacaaattataaacttagatagtacataataaaccagggtatgcttaacaagaagcagccacattggcagtcactgtggatgactgatgatgtgacaaagcccttgaagctttttgcaggctgagaacataaaactacaaagtagcacaagcggaaaccaaaatagctgaagcaaaacacagcaagaaaagagaaaatgttaggaagagaatagtgaaatacctggaagaaaataatggaagagtagaacatgagatgaagaacagagttcataatacaatacatgcatttcagatataaaaattgaaatacatttattcaacaaatatgcattaagatctgattgtgtcccagacactactgtacacacttgggatacatctgtgaatgaaagaagacagtaagcccagccatcaggtagcttatatggggaagtaggccagagaggcaaacaat

SEQ ID NO: 22525 - DNA, 355 bp, Homo sapiens
aggacatgaaccagtgactttgaatgtgatgctgagcccagcagggagccagtatgactctccccaaatcacaagtgagactcagaggccccactgggctcccacatggactcaggccaccgtctttgcttagaggacgcagcagaaagacttggctcattttccaggggcagacttggagagttctggcaggtccatacatttcaactccctcctcccaccacagcaggcctgctcttttatgtatccaatgggaatatttttcattatcttccctctcaatttaattaatccacattccgtaatgaaccttgaaatttcattaaacacatcattactaatcagcacagagctg

SEQ ID NO: 22526 - DNA, 698 bp, Homo sapiens
ctttttgcaagggctttgaatagatatgcttttgcaagggctgaatgggaaaaggtaaagatgaagctatgcaaatgagccggggaactttttatatatattctttaaacacacacacacacactgcggggggaagagtgctgcctcgggatgtttatagaagcaataattgccattattagcattgtctgcggcagatagaaattgaacaggttgggataatatagggtagcagtaattattcttctaattaatggtcctttgctacttgaaaaaagaaaaaaggaaagaagtagtaaaagttatgcagaagttatgtttccttgtgtccatttgcccagcgctggaatctgtggagcaggaagcctggcaattccaagatacgcgatgatcttcaaacattcccgggagccagtcctgaggctctggcttcagggcctagtttccatttatgccgcgtttttgagagtctaatactgtgtctggcacatggtaggtgctcactgaatagtcgtggtatgaatgaatgaacgaatgaatgaatgaatgaatgaatgaatataagtttaatgggggaaacccgggcctcctaataaaggtaggggctgggggatacctaggggcttccccaggaggatttcttttttcatcatcccacccctgggagaaaggtccacgcaggatggtcgcttccccct

SEQ ID NO: 22527 - DNA, 544 bp, Homo sapiens
ctgagggtctttaaagaatggatttagtaatttctacattgtactactttctgaaatattactgattttcaatgaagtaactaagccctagccaaatgttttagtttatttctttctctctctctctttttgtcaatctgtaaatgcgtcagaaaaacgtttactgtaatgttagactgtgcatgtgttggcattaaaagtgtggttttgtccttacagggaatcaaatagaagcaaaattatagttaattcttggtttctgtggtaatggggaacagactgagtttgtaccaataacacttgaaaaatttattttagaaattaggttgaactttgtccttcactaaacttttgccagaaaatccacatgcagtcaagttgttcttctttctcttcttcctggctctgccccaagctggggtaggagaaatggccagcagggaaagaagggtggaatcaaaagacctatgcccaaatgtcgtggtcctgaggtggttctcagcatgttgactagagttatttgtgggaaaaggaaactactctg

SEQ ID NO: 22528 - DNA, 482 bp, Homo sapiens
acaaatgtgctcctgaaatgtgactgtgccaggtggaaactgcattcagctgcttgcagcaaagacatgaaacaacagggtttaaacaaggggcaagcttattttttactcattacaatgattggaagtcctggtggctccacattgtcatcaacactccaggcctcttttatctttgtcataccactcttaacatattctcaaagtcatacaggattacagaactgtcacttagggatcacaatgaatggagaaaagagaaatattgctgtgtagctgtgtaagtgttttcctaaaaccctcaccaagtgactctctgacacatctcacaacctacctcctcccatctgcaatgaggactgagaaatgtcaattggcagttgggcatattgataccccacagagcaggggctttttccagggtaaaagaccaccctcctctactacaacttaagggattggaacacacccaaatctacttt

SEQ ID NO: 22529 - DNA, 1795 bp, Homo sapiens
ccgacctggattgtagactccaggcacagtcaactgcaggcacagtcagcaccagcgcagcagggacggggcggtcctcactgacgtcctcctactgcagatgcacactgaggctcttggccgcagagcgtggcgtctgcagttcatgccaacggtgtgtgcacgtccccggagagtgacagaggagagtggctaaatgtcagtcatggggaatctagagcacaggtgggcacgcttctccgatgaagggtcaggcaggaaatattcttggcactgcagccatacagcctgtgcctcagcacccacgggggaccacagaaggttggggaccactgctttaaacaactagctctcccgtgaagagcaggtccccaccctgctgtgtagggcaacagcagatgtcaatggcatatgaatgaacgagcgtggctgtgccaataaaactttatttacaaacgtaaaaaaaaaaaaaaaaaaaaaaaaaaaaaaaaaaaaaaaaaaaaaaaaaaaaaaaggggggggggcccaaaatatattcccctcgggggggcaccagtatacagcgtcacgcccccgctttgttttttatacaaggggtggcccccatataggagacatcattatttaatacacgagcaggcaacagggcgccgcgcggttaataaaacacctctatgatcagagaacaacaacgctcgatcacagcgggagtaatctgtggaagaaaaaccccctaatatacgctggggggggaggggagaacaatagtggtggggaaacacactcaccacttaaggacattattttaaacaggtcctagaagaggatagaagaatatataacaaatctcttagagggtgttataatcatgtgtggtgtgtaaaacaataagaagggcgaactatattttatgatggagagtgattcgacaaaaaagatttttgcagtgacctataacgaaggagtatatatgtgaatcttttggtacagaccaattttttttatctaccacgcgggaggcgcactctttgttgttaataaaatagactaaaagcgataagtgatagatagagactgcactcagaactgaccaaacatactagtggaacaaccatgacacagaaattgaccgacgcaaagatagaacagtaagatagaacagtcaaagtcaaaagaatagatcaatcaacaataggaaccgataggcatagtagatgacaaaggcaaagaagaagaagaaggaagaaggaagacggacagaaggaagaaaagaaacaaaagaaagaaagaaagaagaaagacaaacaagaaaaaagcaacgaagaagaaatagaagagaaaaaagagaaaacagaacacagcaaagagacgagcagaacgaaagaaaagaagacaacagagaaacgcaagagacgatacacgacaaacagaaagagacaaagaacagagacgagagagaagaaacgaagaaacgaaaaaaagaacaaaaaacaaagaaacgaaacagaaagcaagaacaacaggagaacacaagaacaaaaaaaaagaaagagaaaagaaaaaaagaaaaaaaagaacaacaaagatgaaaaaaaagaaaaaaccagagagcaacgaaagaagacgaaaaacggaaagaagggcaaagaagaggaccacgaaaagaaaacaaacagagaaacagagagacacgaacacagaaaagaacgaaagaaagaaaaaaggacaaagaacagagaagaagaaaacaagagcaaaaagaaaaagaacaacacaaaagagaagagagaggacg

SEQ ID NO: 22530 - DNA, 292 bp, Homo sapiens
gccttctcctgccaaccctctctctcctgtctcccgcgctgtccctcacagctcctactctaggcctgtgacccacatctgtccctctcctgtctcccacgcagctcctgctcctgcctctgacctgcatctgtccctctcctgtctcccccgctgccccttgcagctcctgctccaggcctctgacctgcatcgtatcatctgtctacacatttccctcgtccttcatagcaccacagggttccccggggtcttccgaagccttttctgggctctgtctcttgcacatgcc

SEQ ID NO: 22531 - DNA, 436 bp, Homo sapiens
ggaaatttgtaaaaaataagttttgaagattacttaggtaaataagaggcagctgggctaaaagaagttaaatttaaaggataatttaaaaacaaaaacaaaaactattctttattccacccagtaggaagcatttaattttcctcaactctgtgtcttagaaaagtttgcttagaagtgtttttggccaggcatggtagctgacacctctaatctcagcactttggcaggctgaggcgggaggatcgcttgaacccaggagttcaagaccagcctgggcaatatagcaagatgttgtctctacaaaaaatttaaaaattagctgagtgtgctggctggggcatgcctgtagccccagctactcaggagactgaggtgggagaatcacttggacctgggaggtggagtctgcagtgagccaagatcgtgccaactg

SEQ ID NO: 22532 - DNA, 537 bp, Homo sapiens
cactaaaatcttggtgtcccctagggtctttccttgaatttcatgccctcctggggtgacctcattcacttccaaccactacttgaaattgacacctctagagtccttgtctctgactcagctctcttcaatcagtgggcattttaatctccatgtgaacggccaggccagcctgtctccagatgctcttccctcctctgagtccagtctatgtaccactgagctctggactgtgcaccgcttagctccagatggccaggacggcctgtctgcagatgcttttcccctcctccttccctccatgagtccccatcagcttcccagctccctgctccatcgcctgctctcctgtgaagtctttcctgctacggccaaacagaattcatcactgttcctggtgtgacccagtgtccttgccagagtgtgagctcccgggcgggggtggcaagttcccatcacctgtctgggctcccattcctaggactcagcattggcatatggctggcgctcaatagaataaattagaaccaacacaat

SEQ ID NO: 22533 - DNA, 412 bp, Homo sapiens
gagaatgagagaatatctgtaatcatgttcccatgaactgactaaaatgatggatgacagagtctcattctaccaaataagttagtgtcaaaatgtgccccccaaattacaaatatgaattaatttgccatattagcttattgctgtaagtcaattatgttattaagaataactattagcctggcacagtggctcatgcatgcagtcccatctacttaggaggctgagattggaggatggcttaagcccaggagtttgagaccagcctgggcaacataaaaaaaaatatatatatatatatagtttaaattaggctggaatggtggtgtacacctctactcccagctactggggaggctcaggcgggagaatctcttaagcccaggagttcaaagttgcagtgagctatgac

SEQ ID NO: 22534 - DNA, 450 bp, Homo sapiens
caagctaaactacacacgacgctactttgggtttaagttggtgacagcctttcctgcccctttccttctagtaccagaggggaaatcagagctttgtcatcttttggacaagttcactgccaagctatgcatcgttacacttaatttactcttcctaagtgtgtgtggatgctctaaagaaaatccaggccgggcacagtggctcgcctgtaatcccagcactctgggaggatcacgaggtccagagatagggaccatcctggccagcatggctaaaccctgtctctactaaaattacaaaaattagctgggtgtggtggtgcacacctgtagtcccagctacgcgggaggctgaggcaggagaatcgcttgatcccaggagtgggaggttgcagtgagctgagatcgtgccactacactccagcctggcgacagagcgagactgtctca

SEQ ID NO: 22535 - DNA, 1169 bp, Homo sapiens
ttagaggatccaagctccaacaagaacaaggaggcttctctttttttatttgaatatctaaatgcatttaataataataattatttaatttcagagttcactcttgtgccaggctggagtgcagtggtgcgatcttgggctcactgcaacctccgcctcctgggagtgtacgtcattgttttaaaccacttatgtgttgtagattttactctgtgtattcgtttggtgggttatagtttaccaagttgtccaaaatggataattcatgtgagataggcaagagcaagtgttgtatcccaataccatttggtgaaaaagttgaacttcagaaaggataagtagtttgccaagatcacctgtcaacctgcatagtcaaatttgagatggaactcagctactccaatatctgtatttgcagaataattctgttgtgtttattttgttggtggtggtgtttttgagacggagtctcactctgttgcccaggctgcagtgcaatggcacgatctcagctcactgcaacttccacctccttgcttcaagtgattctcctgcctcatcctcctgagtagctggaattagaggcgcctgccaccacgcccagctaatgtttgtatttttagtcgagactaattttcaccagtttggccacgctggtcttgaactaatgatgtcaggtgatccacctgcctcggcctttcagtgtgttttatttttaaagcagattactttattgaatagtttgtgttgggtacttaagtactttacatgctttgcatgctgctgatttaatcagttctttgagggaggtactctgtcatccttttcagatgagggaactaaggtttagagaatttatgtgacttgcttagggtcacatgtgactgtttggtggaaccacaggacttaatcccagattaggctaagagttttttttttttttgaaaaggaattttgttcctgttgcccaggctggtgtgcaatggcatgatctcggctcattgcaacctccgcctcctgggttcaagcgattctcctgcctcagcctcctgagtagctgggattacaggcatgcaccaccatgcctggctaatttttgtaattttagtcgatgtggggtttcaccatgttggccaggatggtcttgaattcctgaccccaggtaatcc

SEQ ID NO: 22536 - DNA, 461 bp, Homo sapiens
  misc_feature (408)..(408): n is a, c, g, or t
ggacctggccttccattctgtggaagcctgagacaagcagcaacttctctcattcctcctctctatgacaagacaggaactgggacactcaccttactaccctaattcgctgagcctcggaagaaaagcagcttagatttttaatcccatccaagatggaggccctcctgctcctgctgccttgttctcaccccctttcgtgatgtgcgaggccatcggaaggtgtggaatttctccactgattcctctcattgtccctttctccctaactacactttccttttattaaaaattaataaatagatagataaataagctcagggcttttaaaaaatatgtagagactagattttccatttttcctatgatgtaaaattacactatacaaaaacatccatttcttctatnacccctaccttaagacccttcagtgacatcccattacttttttttttttttga

SEQ ID NO: 22537 - DNA, 369 bp, Homo sapiens
ctctggcctctcaggaaacaaagacagcccctgtttaaggatcaaggcccccacattgaggaatggagggtcccctttctcttactgagggcctagacagatggtcaccatctaggggccaagctgaaccatgtgtcttcagcatcctggcagcatgcacagctctggggacccagcccatcccaggctgtgccctgatggaatgggctggaagcttctggcagtgccagtctgggatttccctggccgtcttccctgtgtcctgctcagcctctgaggatttttgtcagagagtaaagaactcagaaggctttttaaaattgtgctaaaatatgcacaacataaagtttatcattttaaccattgttg

SEQ ID NO: 22538 - DNA, 278 bp, Homo sapiens
tttattttttttcatttgagtgcaatattcccagcaccaagaacagtgcctagcatacagtaggcacttgatacatattaagtaaatgcgagggtattattggagaatgaagggagggacttgtctgtttcagcatcagtagtcattgtgcttgttttgaatgtcatggtgctgtgaatcatggaaataggtgtttctgtctttgtataggccactcaaaaatcattgcctaagccaggtacattgggacacccatagtcccaggtagtcaggaggct

SEQ ID NO: 22539 - DNA, 371 bp, Homo sapiens
ccctgggagaagctgctattcagacaatttcccaccaccctctgggacaggcaggaacagcagtgtccccaattctatgacatctggcccctcctctgctggtccctctcgggaagccggaatgtggctgggtgggcctccccctcccacccgggaggcagccgtcacatctggatgacctactgccccaggacctgttcaaagtccctcaaacctgcctcccctcccaccctaggatgccagcctcagctcagcacccggctctggggccagcttcattcattcagcaaggtcttctggggccctagcaggcaccagggcactggactgagccaccatggccacgcgcctggccttgagatggtgtgggg

SEQ ID NO: 22540 - DNA, 466 bp, Homo sapiens
gggaggttggccaaggcaagatgtttaggaaaggctttcctggggaaatttctctttgggttgaatcacagttaagtaggcaaaggggaagacagagggaagggaagtatggcaggcaggaagaataggcacttaatagctttgggatattgggcaggtcgcttgatctttctgagcttcagttttctcatctgggaaatgagttaataatagtcgtttagaaagtgtgatgaggccagccaggtgtgatggctcaggcctgtaatcccagcactttgggaggccgaggcaggtagatcatgaagtcaggagattgagaccatcctcgccaacatggtgaaactctgtctctactaaaaatacaaaaattacccaggcatggtggcgtgtgggaggcagaggttgcagtgagccaagatggcaccactgcactccagcctgggtgacagagcaagactccacctca

SEQ ID NO: 22541 - DNA, 690 bp, Homo sapiens
aaatatattttatgacatcaaaattatttttctctccaattaaaattagaaataaacaaaaaagttaatcaaaatcttaactatttggatatgaagaaatatttctagtctgtttctctggttaaatacagactggagaacttggcttaatgaattgtttgaggcatgaattaactatgttatttttctgcgcggtatcatcaaagaaaaatttttgtgtttctctatatttttacgttgtctgcaataaataggaaagagcctaatttatttatttacttatttatatttttcgagatggagtctcactctgtaacccatgctggagtgcaaagacacaatctcaattcactgcaacctctgcctcctgggttcaagcgattctcctgcctctgctttctaagtagctggaattacaggggcgcaccaccaggcccggctaattttttttgtatttttagtagagacggagtatcaccatgttggcccagctggtctcgaactccttacgagtgatctgcctgtctcagccttccaaagtgctgggattacaggcgtgagccactgcgcccagcccatgaattcaatctaaaacaaataaaaaccttaaatccctcaaaatactacttccttacattgaattgttctgagaagaaaatgcagggctcttgtttactgatgagaatagaa

SEQ ID NO: 22542 - DNA, 635 bp, Homo sapiens
attagaaacagtaagaaattctagagatattaaatcaattcaaggtcaaatacgatttaaatgcttatgggctcagtttttcagggtatcattttttttttccagaaaatttggaaatagaatgatcgaataaaacctccagaaaacaaaaacttagcccaccggccctagtaccattcccattatgaaaaacaaagtaggcgatggtctctctcttacctaagcagcatacatctgatcacttggccatattatggaaactcttacttccaccaccagccatgagttcagacgcccccgggagttttaatctaaaaactcagtcatcctgttcttcctgctttgtcagcttttgtggagagttttcccttcttcccattagcagaaattgggttcacgccgttagacagtagcacattgtttccaaactgcatatcaaggctgaaacacaatcttcaggtcctgcagccattcgtaaacctcttgagctttgctcttgtgtagaacgtacaatgtctgcagagtcccgtgactgaatgacagcctttgaatgccattgttatgtgctcatacagagagatgtacatagaggcacatacacagatggtggacatagcggttgtagtaatgcgcac

SEQ ID NO: 22543 - DNA, 474 bp, Homo sapiens
gccaacgatcagggcatgatccactgccctgatcgagcctcttcacctgctcgggaatctaagcagcatacatctgatcacttggccatattatggaaactcttacttccaccaccagccatgagttcagacgcccccgggagttttaatctaaaaactcagtcatcctgttcttcctgctttgtcagcttttgtggagagttttcccttcttcccattagcagaaattgggttcacgccgttagacagtagcacattgtttccaaactgcatatcaaggctgaaacacaatcttcaggtcctgcagccattcgtaaacctcttgagctttgctcttgtgtagaacgtacaatgtctgcagagtcccgtgactgaatgacagcctttgaatgccattgttatgtgctcatacagagagatgtacatagaggcacatacacagatggtggacatagcggttgtagtaatgcgcac

SEQ ID NO: 22544 - DNA, 495 bp, Homo sapiens
ctgcatgagcgctgatgatgcccagttccaccatctcgctccagactcatctaatcagctgctttctggcagtgtctgtctccattgatacttctcactcagcatgtccaaggctgagctcatcactctcgctccacctcccttctcctcttcctgcatccctgtcctctgtgagcagcatcgccatctaccttgtggcctggacgtgaatcctgaaacttcctccctgtgttggattctccagcgagcacaaaaaaagcataggcttggaacaccaaggaaacaaacacagagtgccaaaaaattatttcaaaagtgtgtagtgacttacacgcatgtttatagcagcacaatttgcaattgcaaaaatgtggaaccaacccaaatgcccatcaaccaacgagtggataaagaaactgtggtgtgtgtgtgtgtgtgtgtgtgtatacatacatacatatatatatatatatatgatggaatactgctcagcca

SEQ ID NO: 22545 - DNA, 210 bp, Homo sapiens
cagagggactagcatgtacaaaggcttttttttttttcctctgaaaggaatatattttgagaatgaagaactgaaagaaggctactgtggcttagacacaggggtgtccaatcttttggcttcccaggggcacattggaaggaagaacaattgtcttgggccacacataaaatacactaacactaatgatagctgatgagctaaaaaaaa

SEQ ID NO: 22546 - DNA, 300 bp, Homo sapiens
aaaaagaattctttttaatgtaaactgttgaatatttgaaatagcccacttcaccttaatgggtcttgtgtatcttcatttgtcttcaaagaaaaaccatttgctaccaaagtaaatcagtatttcgaatgtgcttctcttgttttttgtttattagctagttgctgtaagcatttccaccagaacttgagccaaatcataaggaagctgtttcttttaaaatacaaaccaccaccaaaaaattaaatgtacatattaagcatttgactatttttatttttttaaaaagtataaacacca

SEQ ID NO: 22547 - DNA, 475 bp, Homo sapiens
ggatataaatatctgagggttttttttcttatccatttaagttactaaagtaaaatattttaaatgtgtaaccgttttgtgttcatattgcctggtattttcttggcatattatgcttattggaaaaatatacctttggccatctatatatagagtagcaggattattatgcactaaagaacagttgccagcaccaagctgtgagcctcatggttgtcagacagctttgcagatggaggcccagatgggtgggtgtccagaagtattctatcaatattcagaagagccaaaaggtggaaacaacggcaatgactatcaactgatggaacggataaataaaagttagtatatatccaggccttgtgcggtggctcacacctgtaatcccggcactttgagaggtaaaggcaggccagtgtcttgcatccaggagttttgagaccagcctgggcaacatagggaaactccgtttctg

SEQ ID NO: 22548 - DNA, 385 bp, Homo sapiens
taccatatacaaaaattaattcaaaatggaccaaagacctaaatgtaagaagagctataaggagaaaaataagtgtaattctttgtgaccttaggttaggcaatgattttttagatacgacgccaaagcacaagcaataaaagaaaatgaactgtacgtcatcagaatcaacttttgtacatcaaagaacactatcaagaaagggaaaagacaacccacaaagtgggagaacattttggaaatcatctatgtaacaaggaacttgtatctagactacctcaagaactcttggctgggtacggtggctcacatgggaggatggcttgaggttgggagttcaagaccagcctgggcaatgtcataagaccctgtctctgcaaaaagt

SEQ ID NO: 22549 - DNA, 591 bp, Homo sapiens
tacacaggtgccatggtggtttgctgcacccatcaacccgtcatctaagttttttcttttttttaaattatactttaagttctagggtacttgtgtacaaagtgcaggtctgttacataggtatacatgtactatgttggtttgctgcacacatcaacttgtcgtttacattaggtatttctcctaatgctacccttcccccaaccccccatccccctgacagaccccagtgtgtgatgctccccgccctgtgtccaagtgttctcattgttcaattctcacctatgagtgagaacatgtagtgtttggttttctgtccttgtgatagtttgctgagaatggtagtttccagcttcattcatgtccctgcaaaggacatgaactcatccttttttatggctgcatagtattccatagtgtatatgtgccacattttcttaatccagtctatcattgatggacatttggattggttccaaatctttgctactgtgagtagtgccgcagtaaatacgtgtgctgtttacatagtttttaactgtggaatttattttttatttctgttttattttcatgggcacaacaaacagc

SEQ ID NO: 22550 - DNA, 272 bp, Homo sapiens
ttgaaccaattctcccaaataaactctttttactatatacatatatcctattggttctgtctttctggaagaccctaatacattttgatatgcatttacaacatgaaatgattccataagtctcatgaaacaatcacttcacacatttatcattttttgtggtgaaaacatttaaattctattcttctagcaattttgaaatatgtcatttcttattatttattataatcactattctgtgcaatagatcactaaagtttatctctattgta

SEQ ID NO: 22551 - DNA, 520 bp, Homo sapiens
atgagtttatattgacagttcacgttcagatttcacatattttttcctgttttgatttcctgtttctaaattagtgtgaaaatccccgtttattaaggaaaacaaaattgtttaaaatattgaatattttcaagcccacagaaaagttgagaaaaaaacctagtacaatgagcacctcatatagtcttcactcagattcaccctcggttagcatcatacctttaagtatgtcagtatcattaccacctctttgaaaatcattaattcagtaacatcatctagcatgcattccaaacacagatttccctgtgtctcaagtatccttgtaactttttccttgcttctcttctaggatccacactgtatttggtcaaggttcacacactgtatttggggattgtatctctttggtcttccccattctagaccattccaatagtctaaattcttttctcatgcagcaaatcttctgaagagtctaggccagttgtgttgtagaatatttttatatttgggttca

SEQ ID NO: 22552 - DNA, 124 bp, Homo sapiens
tgttccccttcgggatggtctctcctggcctctgccctatgtggctcttccctttgctgattttattccgtgtccttctgctgtaataaactgtagccttggctataacagcacccctgatgct

SEQ ID NO: 22553 - DNA, 443 bp, Homo sapiens
atatatgcagcaatatggatgaaacccaaatgtgagagctgccgcaccaaaaggccaccaactgtatgattctatttatatgacatcctcgagaaggcagaactatagtagcggagagcagaccagtgattgtgggggttgagaatgatcaggactagaaggaggcgctgactgcaaagtgacactgagaaaaattttgggagcgatggagctgctctgtgtcttgattgtggtggtgattgcatgaatccaagtgttcgtcaacactcatggccctgtacatgaaaaagagtaaattttattttatgtaaaccaaaaagaaatgttttcaaagaacatttaatcacataggaaaatgtgtaagagataaaatataaaacttaattgtatgatgaaaatgtctaaagtatgatacaaatttaatatattaaaatataatatat

SEQ ID NO: 22554 - DNA, 405 bp, Homo sapiens
atctatgaaatcgggataataatagttcctatctcaaaggttgtagtgaggataaaatgaaggtatgtatatataatgtgctttggttagggccccgcataatatctgttgctgctattgttgctgctgttataggataattatactttttgcccagatattgctcaggggtctttgtaatatactcaataacctctgtccttttccttcagagcgtatatttccatttataattttacattccgtgaaatgagagcaaggactgtatcctgtttctcaccattgtccccaacacctagctggtatagtcaaggttaacaaatgtttgttgagtgaatgaatcgtttggagttgagtattttcactcttatagaatgttggacatatacacctactatgtaccca

SEQ ID NO: 22555 - DNA, 450 bp, Homo sapiens
taattataattaatgattttctgaaagtaactgtcaagacaaattttcttaactatctcttttcacctttgaggtttccacaagtgccaattgctgctacaggattccatttagattgttctcagctgcagagctcaattaggtatttttgtcttgacctggcatgaaacggaagtgctagagtcattgtttgagtctttaatttttccccagaacctttgtacaaatacttgatcttgcctttacaaagtggcaaaacaattctctgatctgtcatgtttgtttgctagccctggcttcgttctctcctttggacaattacctaggtttggcaaaattgcttttcgtggcctttggaggcacagttccctctctgcgttcatttgccttgtttagatccataattcactgaaaaaggcttcctcagttgctgttagaatcctgtggcta

SEQ ID NO: 22556 - DNA, 386 bp, Homo sapiens
attcacccaccttggcctcccaaagtgctgggattacaggtgtgagccaccgcacctggcctggaaggaaaattagtgtagtcaattcaagaagcatttactgactatatgcaagagcctgtgatgatcattaagacagcatcagcattaaaactgctgctcctataggatcaagcttagtaaacaataatataaggcaaaatcagttagcctactttttttgttttatttttgagacacggtcttgctctgtcacctaggctggagtgcagtggcatgaacacggctcactgcagcctcaatctcccaggctcaagtgatcctcccaactcagcctcccaaatagctgagaccacatgtgcacaccaccacacccagctattttt

SEQ ID NO: 22557 - DNA, 471 bp, Homo sapiens
cagctctgttatttcatcttggtgtgtattcagagtcaaatattggccaggaatggtggctcatgcctgtaatcccaggactttgggaggctgaggtgggaggatgacttgaggccaggagttcaaggccaacctggccaacgtagtgagatcgcatctctatttaaaaaatttgaaaacaaacaaaaaaaagcaaaatacagtgtcacaaccttcaaacaatgttacaacctgtcttccctcatttactagtgctccagtttccattgactataagtctttctatttccattataatggttccatgaatcatttgtctaagagagacttggtctataaattagtgaagaaatgtcattctgtgatactaaattttatgtattcataaatctctggactatagccacttccttggtctgcttatattatcgatttagggaacaatgtcagtaatccaactgtagccttcag

SEQ ID NO: 22558 - DNA, 203 bp, Homo sapiens
atcacatggagccttgatgtttaccttaagtcagatgagaaaccactggaagattttaagcagagaaggacatgaccactctggctactgaatttcagaccaaataggggcaaaggtggaagtagggaaatccgtgagcttattgcaataatacaagcaaataccatggtgacttccaccaggtggtggcatggggtgatatg

SEQ ID NO: 22559 - DNA, 191 bp, Homo sapiens
gataactatgccttttaaaaaatagcttcaaagacttctagtatatgaggtctgaggtcagttctgccttagtatcttattggaacagaaaaatatcaacatctcatgtaccctataaatatatatacctactgtgtacccacaaaaaattttctaaaaaagaaaagaatatcagtgtcagtgatttttaa

SEQ ID NO: 22560 - DNA, 489 bp, Homo sapiens
atttaaaggaagcattaattttggttaatttattctagtaatacatacattgctctttaaaaacactatatttattttaaacttttttcatatgactagaatttcatcatttttcaagttctgttcaaagcatcattttattgatgataatttcttttatccctggaagttactaatgtctcctatcaattcatacaaatcacaagagatgtctactttaaaagtttgatgcagtacggtagtaataaagtgatcaaccggaaatcaaaaggcatttagaaacaatttcataatgacctgaaaaataataatgattttaaaaaatgaacgtgtgttcagtatgtactgataaagccatggacattctttggctaggattatcagctatctctttgaaaagaattagagtgaaaagaggttaaattattttcttgaggtttaggtggaaggtaacaactgaagcaataaacagccaggcatggtggctca

SEQ ID NO: 22561 - DNA, 1794 bp, Homo sapiens
  misc_feature (1312)..(1312): n is a, c, g, or t
  misc_feature (1315)..(1315): n is a, c, g, or t
gttttcatttgctgagttttctttgtatcagtcactaattcattcaaactctatgacaaaactgattatctttgaatattctcaggtagtcactcactttcatatcttttccccaggagatggtcctgctggagccccctctctcctactccagtctggaattgtttgctccctggactactgcatagccatcatcctgggacttccctttgtcatcatcttgggaattccctttgccttcctcctgtgttaggtcttctatttcctggaccctgtgtcttccttattcttgagtagcttcctgagaaagggtacatacaaaatctgaaattccttcctgaattcagaagttacatgtctggaaatgccttcattttaccttcactcttgaatggtagtttagcttggtgttaaaatctggattgaaaattaatgtgactgttttgaagacattgttccattagcttccagtgtcactattgagaagtccaatgtcattttaatcctcattccctttttcttcccactctgaaagattttaggatcttcagtttatccctggtgttcctgacatttcatgatgtaccttggaatagatatttttctttacttttgcttgtggggtagattgtattttccaaaaaggctgtatatgtatgtgtgtgcatactccccccatctcacccaatatgctattctttgtgcctccatcaagcagtggggtctttgtttcctcctcttgaacctgtgcagacaggaattctcccccgaacgttttggatcttgagcattgtgttttaagagcacagctgcaagatcaagaacatgcacctggcactgctaggtgcccagcgccatcaggccagcatctcccttcccattttccttgtgaccactgtttaggcattgagattaagcactgtagatgtgtatgtgttcattgagagaggggattaagtttttttacttttaaatgaaatcaacaatgaaaatatcaattgacatcagagagagtttcttttaagcagtgaaatgaaccaacatgacggctgtcaggtgcattttttaaaaatccaccttaggaaatgacaaaaaaagaaatgaccaaaaagaaactaacttgagcttcatgattaaatatgtcattattaaatgtgacaaatatattgtttgcaagaatttctgtgatgagaagatggaagcaaaaggagctgcataaatcacagcttcacagaacattgtcagtatttttgtgtttatctcatggatacatattattattattattttgagatggagtctcactctgtcnccnaggctggagtacagtggcgtgatctcagctcacggcaagctccgcttcccgggttcatgccattctcctgccttctcagcctcccgagtagctgggactacaggcgcctgccacacgcccggcttattttttgtatttttagtagagacggggtttcaccttgttagccaggatggtctcgatctcctgaccttgtgatccacacgcctcggcctcccaaagtgctgggattacagacatgaaccaccgcgcccagccacaaaattgtttttaaaaaaactattttacaaaatctttgaccgtaattatttttaagatgaaaaatatgttatataaattataaaatgttacttaacacaaatataagtattgattgcccaatgttgagagagatcaacaaatgatataaaaccattcactccaaaattataattacattttaaaattaaaaaatgaaaaacattaaactttttaatttg

SEQ ID NO: 22562 - DNA, 1870 bp, Homo sapiens
  misc_feature (1312)..(1312): n is a, c, g, or t
  misc_feature (1315)..(1315): n is a, c, g, or t
gttttcatttgctgagttttctttgtatcagtcactaattcattcaaactctatgacaaaactgattatctttgaatattctcaggtagtcactcactttcatatcttttccccaggagatggtcctgctggagccccctctctcctactccagtctggaattgtttgctccctggactactgcatagccatcatcctgggacttccctttgtcatcatcttgggaattccctttgccttcctcctgtgttaggtcttctatttcctggaccctgtgtcttccttattcttgagtagcttcctgagaaagggtacatacaaaatctgaaattccttcctgaattcagaagttacatgtctggaaatgccttcattttaccttcactcttgaatggtagtttagcttggtgttaaaatctggattgaaaattaatgtgactgttttgaagacattgttccattagcttccagtgtcactattgagaagtccaatgtcattttaatcctcattccctttttcttcccactctgaaagattttaggatcttcagtttatccctggtgttcctgacatttcatgatgtaccttggaatagatatttttctttacttttgcttgtggggtagattgtattttccaaaaaggctgtatatgtatgtgtgtgcatactccccccatctcacccaatatgctattctttgtgcctccatcaagcagtggggtctttgtttcctcctcttgaacctgtgcagacaggaattctcccccgaacgttttggatcttgagcattgtgttttaagagcacagctgcaagatcaagaacatgcacctggcactgctaggtgcccagcgccatcaggccagcatctcccttcccattttccttgtgaccactgtttaggcattgagattaagcactgtagatgtgtatgtgttcattgagagaggggattaagtttttttacttttaaatgaaatcaacaatgaaaatatcaattgacatcagagagagtttcttttaagcagtgaaatgaaccaacatgacggctgtcaggtgcattttttaaaaatccaccttaggaaatgacaaaaaaagaaatgaccaaaaagaaactaacttgagcttcatgattaaatatgtcattattaaatgtgacaaatatattgtttgcaagaatttctgtgatgagaagatggaagcaaaaggagctgcataaatcacagcttcacagaacattgtcagtatttttgtgtttatctcatggatacatattattattattattttgagatggagtctcactctgtcnccnaggctggagtacagtggcgtgatctcagctcacggcaagctccgcttcccgggttcatgccattctcctgccttctcagcctcccgagtagctgggactacaggcgcctgccacacgcccggcttattttttgtatttttagtagagacggggtttcaccttgttagccaggatggtctcgatctcctgaccttgtgatccacacgcctcggcctcccaaagtgctgggattacagacatgaaccaccgcgcccagccacaaaattgtttttaaaaaaactattttacaaaatctttgaccgtaattatttttaagatgaaaaatatgttatataaattataaaatgttacttaacacaaatataagtattgattgcccaatgttgagagagatcaacaaatgatataaaaccattcactccaaaattataattacattttaaaattaaaaaatgaaaaacattaaactttttaatttgaaaaaaatttaaactcaaaaagttaatttaaaattagttacatttaaatgtaattaaatgctaaaaatctctcttc

SEQ ID NO: 22563 - DNA, 399 bp, Homo sapiens
aaacaaaagaaactttaggtatcaaaccaaaacacatcataaccacatcgtaaaagtagtgacaaaaccaacacatatgtttgcaaataccttgggaagattgtgttttatagcaatagtttttttgctaaacaaacaactaacttttaaagttaacatttgctggagatgatattttcccagggaagtatttaaatgcttggaacacacctatccaaagacaaatatttgttttcccccagccactggaaagagaccccaactggaaacattgtctagaaatgaatatttggaaactctgaggccctctataaatgccattgcagtagctcactgtccttctaagctgaggacaaaatgccctcaaaggggccttggtgtagaaaagctgttttcagg

SEQ ID NO: 22564 - DNA, 443 bp, Homo sapiens
ctggaaaaagccaagagttccttccaccagctcagcccggacctctcaaagaggtcatctccacagaactgaccaacccgattcccctacccctcccaccacctcactccctttggtttcagccagcaaagcccccccccaggccaaggcagggacaagcccaggagaagtcaaagacgggacaagtccattcacgcaggcgggaagcaccgagccccgacttcccaccaggagccccggggttgggatggacagaggtgggcccttcacccggcagacccccctcccagctccaggagaaacagaggtggggccccaacttcctaccaggagcccctgggtggggagacacagaggtgagtggggagggacagaggtaggccctccgccctcccacccggcagaccccctcccagctgcaggagggagattggggcagcagc

SEQ ID NO: 22565 - DNA, 400 bp, Homo sapiens
caagaaacaagaaaacaaaatcatcgtaggtggggatgagtgcaaagaagggaataagcaggatattattcagagaaaatgtaagtgatgtctacttttaaataggctaggcaggggcagagagtagaacagcaaagccttaaagctggacagatctggacttgtcccaggacagaaaggaggtcagtggagctgaagcacagggagcaaatcacagtggacttcggaaaggatggacgggcagggtgtaggggagccaggtgtgcaggccccgagaccaccctaaggagtctggattttatcctagtgcagaggaaatttacagatgtgcttgcaagcaggagacgtgctgagctcattttatgagttacaggggtagctctggctgccagtggagaat

SEQ ID NO: 22566 - DNA, 417 bp, Homo sapiens
aggactgtatgtcctttctttttcctctgcttcagtcacctagcttgggcagtgctgagcagtgtaccctgccagggggcagtcagagtcacactgtaaggacctgtattcctgccctgggaggaaggtgggggtcactgggtatttcttgtagtcacatcaaccagtccctgacctgtggagaactgtgaaaagagctgccccaggcccagtttggagcagacctgaccgtcctgttgctttggcttcagggatgccctttaatttcaagctcctggcttgctgtttggaataacccccatactgtgcagcacacaatgcctgctagaaggaacatctagaagagtgctgtgtgacagaaatagtgtatgaactatggatagatataaaacaacgttttctagtagtcgtgttaat

SEQ ID NO: 22567 - DNA, 480 bp, Homo sapiens
atcagaagaaaactatacaccagaaaacaagagaacttttttttttgtattggatgggaagaacataggtttatttgttgatatttacaatgaaaactcctggaaccgtaatgcttcattcaatacatgagccagtaatttcatttgtgtgtgtttcatttcacacacacacagacacacaaatattgctaaaatgatcacaaaatctcacagctacaaaagaaatcattatgacttccatgtgtgtaaattccatgagattgacaattccttagtctgataacaaatgaacaagtgaatccaaatttctttttgttttgcactctcacttgtcttgtaaagtaaaggtaacctaggtattacttcacgagattcaaactcatttaacaaagtaagtgcttttaagattgaaatatgttaaatcttatgaatactagtataactttaataaacatatcttttgtctcttactattcctta

SEQ ID NO: 22568 - DNA, 505 bp, Homo sapiens
taacagcccctctaagttctccatgacttagaccccagtcacctccctgacatccctgagtgggaggcacctggcggtttcgcgctttccccgcgttttgtttgcgtcagagcagcgcgctggcgggagctgcagggcaaatatcccgccccggtgctttggtgtgtggcacttgctgccattctgccgctgtggggtgagcggcggtggcgggactagcacccaggcgggatccgttggcagcagcagagagagctcaatcctgatgatgcagaagcccagactccagcctactgcaagttccagagcaggctgtacccacgcctgcgtgagggctagagggacttggcctgctccgcaaatgatccaacttcccggacgggctggtgaacacagacaatgccagcctggataaggaagcggccagcactgcttaggcattgttctcaggacgcgcattactgagtgtggaactttaccctcctgatgaagacgccagagttgg

SEQ ID NO: 22569 - DNA, 513 bp, Homo sapiens
gaaacgggcttaaggatctcttgcttttctggaggaaagttcagtatcgcattaataaagagaaacagtaggaatcatggcaaaaataataaaaaagcagctctgttggaaaggaggagctgaagccagcagctctctagggaatctatgcctagtcttgagctaatacttttctgaaataagtttgatctgccttaaacataattaaaaccgcttacagtttctgcagagaggatgcagtcgtcgaagttctgaagctgaactaacttgtgtggcctgtctgcttgggcatcagtcttagcggtgagctgcgtctcacccacgtgagtatgaactgaattttctctgtcctggttattgcacatgctggagaccacacaagcccagcgtgctggtatcagctgttggcaagtctgcttcccagctgggctgcaggtcccagccccagggactccatccagttggcttgtctgcccttgtggagctgaggcaggtgaagagaagcccgccgtg

SEQ ID NO: 22570 - DNA, 559 bp, Homo sapiens
  misc_feature (27)..(27): n is a, c, g, or t
gaatctacttccaccctcagaacttanaatgaactgcatcctttttttcatcttcttttcttctccagtgaatatgatctccaaacccttattttttctttgaactgtaaaatttccactcatggacgatgcaaccaacagatgcaatctctgagaagatgaaaattgggacctcttattataaaattgacctagctggactcaggaaaccagggaagaagtcaatgcaggcatttaaaatgtaaagttttttctggttaaatctatttatttttcttgtaggttgagtatttcttcccagtttttctgctctggtgtataacaaacaggtcaaaatttcccatctttcctcctgatagtagttgaatcctaccttgcatacttaatgcatagtgaaatggcatctagcagaaatacacacccccaaaacacaccaccatttcattaggtgcccaaaaaattctgtatttagcttatttatttattgttatttttgctttttcttaacccactatatattgactgcaaacgaattaataaattatcccttctggaaaat

SEQ ID NO: 22571 - DNA, 428 bp, Homo sapiens
ggtcgacctggtctcgaactccagacttcaagtgatctgtctgccttggcctcccaatgtgctgggattacaggcataagccaccgcgctgggcctgaggaaaatttttaaaaaataatcgagactgctgttatggtgacaccaccacgagaagctacaagcaaaatactgataacctcatatgtgaaaatttttcatattgtttaaaatattatgaacaaaagaaaagacaaataacaaactgggaaaaatatttacaactcatcacaaatggctaatccttttaatgttaatatttaaaaaaaaatacaaatcaggtcaggcacagtggctcatgcctgtaatcccagtactttgggaggctgaggtgagaggatcacctgaagtcaggagttcaaaaccagcctggccaacacggagaaacctgt

SEQ ID NO: 22572 - DNA, 409 bp, Homo sapiens
ggtcgacctggtctcgaactccagacttcaagtgatctgtctgccttggcctcccaatgtgctgggattacaggcataagccaccgcgctgggcctgaggaaaatttttaaaaaataatcgagactgctgttatggtgacaccaccacgagaagctacaagcaaaatactgataacctcatatgtgaaaatttttcatattgtttaaaatattatgaacaaaagaaaagacaaataacaaactgggaaaaatatttacaactcatcacaaatggctaatccttttaatgttaatatttaaaaaaaaatacaaatcaggtcaggctggtctcgaactccagacttcaagtgatctttctgccttggcctcccaacgtgctgggttccaggcatagccaccgcgctgggcc

SEQ ID NO: 22573 - DNA, 999 bp, Homo sapiens
atagctgtcacagctgaggtaaagttacagtgatttacttggtggtagaatgttgggatttttccatttgattgagttctaggaagcctttagtttccctgcctgcagaccccattctcctgcctcagatatatcaatgacatattcaatacatcattaagttgcttaatatttaagaggttaagatgcacaggtaatgacctctaaatgaatgccaataaaaatagtaaaaggtgtaaactctgactcctatctgacctaggtaggaagtaacatccagaacttctgcaggctgtcctgtgtaattgttctccggaggaacccttgtccctggggtttgagagaaggggatcgaggaaaaggatgtttgtctgagctcttgtttgatttgcccaagtgacttgacttgtttgaatcctctcagggtgccatcatgtaatctgtccactccaacttcttcctgtttttcacattggcaaaacaaaacccaactgaatcgacactgagtttaaaataaatcttggtatttaggttgtacctaaaaatgataacttttagactgtaatcagaggtagatgctatcaatttgttagtgaggaggggaggagttttcaatgccacttagtttacaatgtctaattgttcaaatatacatctaggttgtaaaggagactcaacggtaagttatagtgaccattgaaaaatgtaaaggggcttcaaatcaagaacttagaaggaatttcttgcaatctattgagacacaaagcagatgagtggttgtctgggcctaggaacaggaatggggagtggctgcaaataggtggaagagaccttttttgggtgatgaaagtgctctataattgggttatggtaataattgtacaactatgtaaatttactgaaagtcattgagttggacacttaaaacaggtgaattttatgatatgtaaattatatattcacaaagccattaaaaattgtattttttgagcagctaca

SEQ ID NO: 22574 - DNA, 552 bp, Homo sapiens
gattaaatgtgtgtgtgaccttttgtttttattatagcagttggagtaatccaaactttaacctatcacattgatattgaaactgttctctaataccaagaaggcctgttaacattgtaatatggtggactcaaaccagttgaactacatttaacctacctaaatggcaacatcctctcagttgttatacagaagcttaggatatattcttggtttgttagaaaaatgaaattgaatgttgttaaagtggtactttgtaaatctggcttttacactaaaagcaccctctcagcttgtagtattttaatttgataatattcagcctgaatttgtttgaaattctgtgaggaacagttgcattaaaaaaaaaattcagcatgctttttctggaatttatttttatggcaatttaagttttatatctcctacttgattgacatgttatttgtaattagctggtaaattgtgtgcatgagctatcagtgctgcaaatttttaggaaaataagcaatcattaaatagaaaaatttgtgttggaagctttcattgctt

SEQ ID NO: 22575 - DNA, 550 bp, Homo sapiens
taatcatactaagactaatctgtttgcaaaatcagtctaatctcattaaacttggactgatcatttatgtaactgcatcaaggatagtggttcaatgcacattctcaaatatgacattccagtcaaagttttggtgataaccaaaggggttattagctccataaagtcaatctctactcattgaaactgtctggtaataaggagtctcagattagacttttaaaagccactccaggctaagcaaccaagccatggacttgcacaattttgtaaaatggagataacttaactagtaataaaagttgtatgtctgtattataactaatattgacaactctgaaggtatatccttttctttttttaaaaaaactaaaccaacgatattcttactcaccaaagattatccgtgtcacatgaacttaaaaaacatttgagtaaattcctgtttttctgaaagttttagaattacttatacaagtgcttatttttctttgagccaattaaatagagctattttatacattaattttggaaatgccatccagaggtt

SEQ ID NO: 22576 - DNA, 515 bp, Homo sapiens
tgtcaatctttcatagaccttggttatcctccaccgtcatcagggtttttcatcgaccttgacatcagatctacctacggacattgttgttcgaagcaatgatcataaagctttttattgagtgcttaatatgtcctgggcattttggtaagcactatacaaacgttatctcaattaatcctgtcaacaaacatacaaaagaaatactattcatatcctcatcttaaaagtgtggaaactgccaggtgtggtggctcatgcctgtaatcccagcactttgggaggccgaggcagtggatcacgtgaggtcaggagttcaagaccagcctggccaacatggtgaaaccctgtccctacaaaaacacaaaaattagccgggcatgatggtgggtgcctgtaatcccagctactaggggggctgaggctggagaatcgcttgaacccaggaggcggggttacagtgagccgagatctcaccactgcactccagtctgggtgacagagactccatctca

SEQ ID NO: 22577 - DNA, 1797 bp, Homo sapiens
  misc_feature (13)..(13): n is a, c, g, or t
tggccaaccctcnccacccgggacttgggcagcggcgccggcagcccagcgtctatttgcgcttaagagccagcaaggaagctccaggggccccagctggccgtgctcccccgggatgcaagtccctgcgctgacgcccggcagcggctggcacgggcgcggctgctccgggtgcacagggatgctgctgtttcggggaccccggcgccctgccttggccagccccgcgggcccctgaggccactctccggagcgcgccgccgctgggcttctggcgctgcctgaggcatcctccccaaccaccgaacctccggcggttctcctcggcccagaccgatggagccggggatgctgggtccacacaacctcccacaccacgagccaatcagcttcggcatcgatcagatcctgagcggccccgaaaccccagggggcggtctaggcctgggtcgcgggggccagggtcatggggagaatggggcgttctcgggtggataccacggagcctcgggctacggtcccgccggctcacttgccccgctgcccggcagctccggagtgggcccaggcggcgtgatccgcgtccctgcgcaccgcccgctgcctgtgccgccgcccgctgggggggcgcctgcagtgcctgggccctcgggtttgggcggcgccggaggcctagcgggactcaccttcccctggatggacagcggccgccgctttgccaaggaccggctcacggctgcgctctcgcccttctctgggacgcgccgcataggccacccctaccaaaaccggacccctccgaagcggaagaagccgcgcacgtccttctcccgctcacaggtgctggagttggagcggcgcttcctgcgccagaagtacctggcctctgcggagagggcggcgctggccaaggccttgcgcatgaccgacgcacaggtcaaaacgtggttccagaaccgacgcaccaagtggcggcgccagacggcggaggagcgcgaggccgagcggcaccgcgcgggccggctgctcctgcatctgcagcaggacgcgttgccacggccgctgcggccgccgctgcccccggaccctctctgcctgcacaactcgtcgctcttcgcgctgcagaacctgcagccctgggccgaggacaacaaagtggcttcagtgtccgggctcgcctcggtggtgtgagcgacgcccgtccgatcggcgtggagcgccgggcccggagcggtggagcgcgcggctgcctgcgtccatggtctagtggcagccgggcgcgtgaggagcggcaggccttgaggctgtcgtcgagggctcctccaccaccggccggctcccaagccagcgttgcgcagatgcacggccagctcagaggcggcctttcccgccatttttcacttcactgccgttacgccctcgctggaacctgaggcgccgagagggcgggacctgcaggacagtagccaatgaggtgcggggagggggccgggctggccaatgggagctgctttcctgagggactcgaaattctccggcgggtggtcgggagctggggctctgaggggctctagcggcgttgcgcgcggtgccggctgggtctgtaccaaaggtgtgaaggaaagaagacaccgaccacggcgaagcaatagagggggtgctggagcgcgagaggctggctgattgtgaccgaaaccagagggttgtccaccccgggcatctcatccctcaactgtaaaataatcgctaaggattccttcctgactttgagcctcacgttgtcatgtgtgttcagcc

SEQ ID NO: 22578 - DNA, 1396 bp, Homo sapiens
gatccaaccaaggcctcagtgaggtcccacgtgtcccccgtggcgagatttcgccctcccgccgttgaggaggaagagtgtgagaacagacttcctaggcaccgggcgccgttccccagccgcttcttacgcagccgggaaaccacaacgagatttggtcttcgagagcatttaggcggggaccacaacgaatccgggagttggccagaaggatccatcgagaggcgaagagtgggggctgggggaggaggcacctgcggaggaagccggtgaggcggaggcagcccaaaggcggaggccgcccaaaggcggaggccagcaaggatggaggcgcgctgcgctctcgcccttctctgggacgcgccgcataggccacccctaccaaaaccggacccctccgaagcggaagaagccgcgcacgtccttctcccgctcacaggtgctggagttggagcggcgcttcctgcgccagaagtacctggcctctgcggagagggcggcgctggccaaggccttgcgcatgaccgacgcacaggtcaaaacgtggttccagaaccgacgcaccaagtggcggcgccagacggcggaggagcgcgaggccgagcggcaccgcgcgggccggctgctcctgcatctgcagcaggacgcgttgccacggccgctgcggccgccgctgcccccggaccctctctgcctgcacaactcgtcgctcttcgcgctgcagaacctgcagccctgggccgaggacaacaaagtggcttcagtgtccgggctcgcctcggtggtgtgagcgacgcccgtccgatcggcgtggagcgccgggcccggagcggtggagcgcgcggctgcctgcgtccatggtctagtggcagccgggcgcgtgaggagcggcaggccttgaggctgtcgtcgagggctcctccaccaccggccggctcccaagccagcgttgcgcagatgcacggccagctcagaggcggcctttcccgccatttttcacttcactgccgttacgccctcgctggaacctgaggcgccgagagggcgggacctgcaggacagtagccaatgaggtgcggggagggggccgggctggccaatgggagctgctttcctgagggactcgaaattctccggcgggtggtcgggagctggggctctgaggggctctagcggcgttgcgcgcggtgccggctgggtctgtaccaaaggtgtgaaggaaagaagacaccgaccacggcgaagcaatagagggggtgctggagcgcgagaggctggctgattgtgaccgaaaccagagggttgtccaccccgggcatctcatccctcaactgtaaaataatcgctaaggattccttcctgactttgagcctcacgttgtcatgtgtgttcagcc

SEQ ID NO: 22579 - DNA, 917 bp, Homo sapiens
  misc_feature (13)..(13): n is a, c, g, or t
tggccaaccctcnccacccgggacttgggcagcggcgccggcagcccagcgtctatttgcgcttaagagccagcaaggaagctccaggggccccagctggccgtgctcccccgggatgcaagtccctgcgctgacgcccggcagcggctggcacgggcgcggctgctccgggtgcacagggatgctgctgtttcggggaccccggcgccctgccttggccagccccgcgggcccctgaggccactctccggagcgcgccgccgctgggcttctggcgctgcctgaggcatcctccccaaccaccgaacctccggcggttctcctcggcccagaccgatggagccggggatgctgggtccacacaacctcccacaccacgagccaatcagcttcggcatcgatcagatcctgagcggccccgaaaccccagggggcggtctaggcctgggtcgcgggggccagggtcatggggagaatggggcgttctcgggtggataccacggagcctcgggctacggtcccgccggctcacttgccccgctgcccggcagctccggagtgggcccaggcggcgtgatccgcgtccctgcgcaccgcccgctgcctgtgccgccgcccgctgggggggcgcctgcagtgcctgggccctcgggtttgggcggcgccggaggcctagcgggactcaccttcccctggatggacagcggccgccgctttgccaaggaccggctcacgggtgaggttgtctgacccctccagcgtcacgcccgactctgaccccgtctcctcatttcttagctttctgctccaactcaaggacccctttcacacctcccatagatctcccaggggatctcccccaatcaaatctctgggtctgcctccgagaggtgatgggagggagctgccgtcggtgc

SEQ ID NO: 22580 - DNA, 965 bp, Homo sapiens
ccaacaaacacacaacaccacaaaaccaacacaacaacactactggcactgatcaagcccgtcgcgtataacgctgcagagaagccagagactttcgcttccggctgccgcaggcgcttcgctggtgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggcagccaaaaaaaaaaaaaaaaaaaaactgggggtttttttgggggggggaaagggttttaaggggcatgttgtatttttttctggcacctttgggaaagggaaatgcgggcccaaagagggaatga

SEQ ID NO: 22581 - DNA, 2041 bp, Homo sapiens
tcaattacctctgagaggtaagttctattacatccacattttactgataagaaaacagtagctcagagatagcaagcagtttacctaataaaaacaagagcaaacttcttaaaagccctttctctccaacggcttaatttatttaatcctcctaacaactctgagctgggtatcgtcaaaggggattccaccaaggtagcctcactccaacactctaacccaaggctgctcaacagaaatataatgtaaactgcacatgcaatttaaatgtttttagaagctgcatttaaaaagtaaaaacacaggtgaaattaataacatttttatttgacccaatatatgcaaaacattatattccaacatgtaatcagtattaaaaagtattgagataatttttacatcagttttttcgtactaagtcccgtattttacaatatagcacatctcaattcgctatatttcgagggttatcaactagctacgttgcaagagctgagtcaactcaggaggccagcggccaccataaggggcaatgcatttagagttcacttattaaatgctgacgttaacagaacccacagagccgcatttcccttggtttcggaggacacgcgaaaaataacaacagcaaagggttctcgagcatctccttcgcgccagacggtgtgttgtactttgtcatcgtcgcagtaaggccggtgctatcgccctcctagtttgaccaagcgagaggactttctccagatgggcccctcccgagagaatggtcgccgtcccgctctcctgttcgggtcaccaccggccgggcgccactcgaacgagccccggccagccgtcaccctaatcattcccgaaggaggggccatcagagctacagctcatcagggtcaatcagaaggggcgcccgcacgcaaaggtcacctgcaaaccgaagcggcgcacggataaggtccgggacttgaagtctatctccaaacattcaggctcctcctccgactcctcctcgaactggcgctcagaggcgccaccattcggaaggagcccaggcacgcgcagtcgccctcccgcaccggagggcagcagccgcctcatgcgactcgagaacgctagagggcgccgcttccgggagcccaagcggcttccgggtgctcgcgcgccgacctggacgcagagaagccagagactttcgcttccggctgccgcaggcgcttcgctggtgcaggtaagctccgcacactctcggccggtcccgagtccgactccctcaagggtgacgcgagctctgccctttaaccggaaacgtctccctgctcaccccacccccgcgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggca

SEQ ID NO: 22582 - DNA, 1933 bp, Homo sapiens
tcaattacctctgagaggtaagttctattacatccacattttactgataagaaaacagtagctcagagatagcaagcagtttacctaataaaaacaagagcaaacttcttaaaagccctttctctccaacggcttaatttatttaatcctcctaacaactctgagctgggtatcgtcaaaggggattccaccaaggtagcctcactccaacactctaacccaaggctgctcaacagaaatataatgtaaactgcacatgcaatttaaatgtttttagaagctgcatttaaaaagtaaaaacacaggtgaaattaataacatttttatttgacccaatatatgcaaaacattatattccaacatgtaatcagtattaaaaagtattgagataatttttacatcagttttttcgtactaagtcccgtattttacaatatagcacatctcaattcgctatatttcgagggttatcaactagctacgttgcaagagctgagtcaactcaggaggccagcggccaccataaggggcaatgcatttagagttcacttattaaatgctgacgttaacagaacccacagagccgcatttcccttggtttcggaggacacgcgaaaaataacaacagcaaagggttctcgagcatctccttcgcgccagacggtgtgttgtactttgtcatcgtcgcagtaaggccggtgctatcgccctcctagtttgaccaagcgagaggactttctccagatgggcccctcccgagagaatggtcgccgtcccgctctcctgttcgggtcaccaccggccgggcgccactcgaacgagccccggccagccgtcaccctaatcattcccgaaggaggggccatcagagctacagctcatcagggtcaatcagaaggggcgcccgcacgcaaaggtcacctgcaaaccgaagcggcgcacggataaggtccgggacttgaagtctatctccaaacattcaggctcctcctccgactcctcctcgaactggcgctcagaggcgccaccattcggaaggagcccaggcacgcgcagtcgccctcccgcaccggagggcagcagccgcctcatgcgactcgagaacgctagagggcgccgcttccgggagcccaagcggcttccgggtgctcgcgcgccgacctggacgcagagaagccagagactttcgcttccggctgccgcaggcgcttcgctggtgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggca

SEQ ID NO: 22583 - DNA, 2155 bp, Homo sapiens
tcaattacctctgagaggtaagttctattacatccacattttactgataagaaaacagtagctcagagatagcaagcagtttacctaataaaaacaagagcaaacttcttaaaagccctttctctccaacggcttaatttatttaatcctcctaacaactctgagctgggtatcgtcaaaggggattccaccaaggtagcctcactccaacactctaacccaaggctgctcaacagaaatataatgtaaactgcacatgcaatttaaatgtttttagaagctgcatttaaaaagtaaaaacacaggtgaaattaataacatttttatttgacccaatatatgcaaaacattatattccaacatgtaatcagtattaaaaagtattgagataatttttacatcagttttttcgtactaagtcccgtattttacaatatagcacatctcaattcgctatatttcgagggttatcaactagctacgttgcaagagctgagtcaactcaggaggccagcggccaccataaggggcaatgcatttagagttcacttattaaatgctgacgttaacagaacccacagagccgcatttcccttggtttcggaggacacgcgaaaaataacaacagcaaagggttctcgagcatctccttcgcgccagacggtgtgttgtactttgtcatcgtcgcagtaaggccggtgctatcgccctcctagtttgaccaagcgagaggactttctccagatgggcccctcccgagagaatggtcgccgtcccgctctcctgttcgggtcaccaccggccgggcgccactcgaacgagccccggccagccgtcaccctaatcattcccgaaggaggggccatcagagctacagctcatcagggtcaatcagaaggggcgcccgcacgcaaaggtcacctgcaaaccgaagcggcgcacggataaggtccgggacttgaagtctatctccaaacattcaggctcctcctccgactcctcctcgaactggcgctcagaggcgccaccattcggaaggagcccaggcacgcgcagtcgccctcccgcaccggagggcagcagccgcctcatgcgactcgagaacgctagagggcgccgcttccgggagcccaagcggcttccgggtgctcgcgcgccgacctggacgcagagaagccagagactttcgcttccggctgccgcaggcgcttcgctggtgcaggtaagctccgcacactctcggccggtcccgagtccgactccctcaagggtgacgcgagctctgccctttaaccggaaacgtctccctgctcaccccacccccgcgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggcaaaaaaaaacacacacacccagctctctatccgggcggaaaaagatacaagggaggaaaaggtctgcccttctggccgtggaacgcggccctgtgggcatatgaacagcacaaca

SEQ ID NO: 22584 - DNA, 2157 bp, Homo sapiens
tcaattacctctgagaggtaagttctattacatccacattttactgataagaaaacagtagctcagagatagcaagcagtttacctaataaaaacaagagcaaacttcttaaaagccctttctctccaacggcttaatttatttaatcctcctaacaactctgagctgggtatcgtcaaaggggattccaccaaggtagcctcactccaacactctaacccaaggctgctcaacagaaatataatgtaaactgcacatgcaatttaaatgtttttagaagctgcatttaaaaagtaaaaacacaggtgaaattaataacatttttatttgacccaatatatgcaaaacattatattccaacatgtaatcagtattaaaaagtattgagataatttttacatcagttttttcgtactaagtcccgtattttacaatatagcacatctcaattcgctatatttcgagggttatcaactagctacgttgcaagagctgagtcaactcaggaggccagcggccaccataaggggcaatgcatttagagttcacttattaaatgctgacgttaacagaacccacagagccgcatttcccttggtttcggaggacacgcgaaaaataacaacagcaaagggttctcgagcatctccttcgcgccagacggtgtgttgtactttgtcatcgtcgcagtaaggccggtgctatcgccctcctagtttgaccaagcgagaggactttctccagatgggcccctcccgagagaatggtcgccgtcccgctctcctgttcgggtcaccaccggccgggcgccactcgaacgagccccggccagccgtcaccctaatcattcccgaaggaggggccatcagagctacagctcatcagggtcaatcagaaggggcgcccgcacgcaaaggtcacctgcaaaccgaagcggcgcacggataaggtccgggacttgaagtctatctccaaacattcaggctcctcctccgactcctcctcgaactggcgctcagaggcgccaccattcggaaggagcccaggcacgcgcagtcgccctcccgcaccggagggcagcagccgcctcatgcgactcgagaacgctagagggcgccgcttccgggagcccaagcggcttccgggtgctcgcgcgccgacctggacgcagagaagccagagactttcgcttccggctgccgcaggcgcttcgctggtgcaggtaagctccgcacactctcggccggtcccgagtccgactccctcaagggtgacgcgagctctgccctttaaccggaaacgtctccctgctcaccccacccccgcgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggcaggcaaaaaacaaaaagacaaaaaaaaccgcgggttttggggggcaaagtagagggctgtatatttccacccctttaaagggaaggcgccacagagaaataacgagaacacaaacct

SEQ ID NO: 22585 - DNA, 2057 bp, Homo sapiens
tcaattacctctgagaggtaagttctattacatccacattttactgataagaaaacagtagctcagagatagcaagcagtttacctaataaaaacaagagcaaacttcttaaaagccctttctctccaacggcttaatttatttaatcctcctaacaactctgagctgggtatcgtcaaaggggattccaccaaggtagcctcactccaacactctaacccaaggctgctcaacagaaatataatgtaaactgcacatgcaatttaaatgtttttagaagctgcatttaaaaagtaaaaacacaggtgaaattaataacatttttatttgacccaatatatgcaaaacattatattccaacatgtaatcagtattaaaaagtattgagataatttttacatcagttttttcgtactaagtcccgtattttacaatatagcacatctcaattcgctatatttcgagggttatcaactagctacgttgcaagagctgagtcaactcaggaggccagcggccaccataaggggcaatgcatttagagttcacttattaaatgctgacgttaacagaacccacagagccgcatttcccttggtttcggaggacacgcgaaaaataacaacagcaaagggttctcgagcatctccttcgcgccagacggtgtgttgtactttgtcatcgtcgcagtaaggccggtgctatcgccctcctagtttgaccaagcgagaggactttctccagatgggcccctcccgagagaatggtcgccgtcccgctctcctgttcgggtcaccaccggccgggcgccactcgaacgagccccggccagccgtcaccctaatcattcccgaaggaggggccatcagagctacagctcatcagggtcaatcagaaggggcgcccgcacgcaaaggtcacctgcaaaccgaagcggcgcacggataaggtccgggacttgaagtctatctccaaacattcaggctcctcctccgactcctcctcgaactggcgctcagaggcgccaccattcggaaggagcccaggcacgcgcagtcgccctcccgcaccggagggcagcagccgcctcatgcgactcgagaacgctagagggcgccgcttccgggagcccaagcggcttccgggtgctcgcgcgccgacctggacgcagagaagccagagactttcgcttccggctgccgcaggcgcttcgctggtgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggcagccaaaaaaaaaaaaaaaaaaaaactgggggtttttttgggggggggaaagggttttaaggggcatgttgtatttttttctggcacctttgggaaagggaaatgcgggcccaaagagggaatga

SEQ ID NO: 22586 - DNA, 2049 bp, Homo sapiens
tcaattacctctgagaggtaagttctattacatccacattttactgataagaaaacagtagctcagagatagcaagcagtttacctaataaaaacaagagcaaacttcttaaaagccctttctctccaacggcttaatttatttaatcctcctaacaactctgagctgggtatcgtcaaaggggattccaccaaggtagcctcactccaacactctaacccaaggctgctcaacagaaatataatgtaaactgcacatgcaatttaaatgtttttagaagctgcatttaaaaagtaaaaacacaggtgaaattaataacatttttatttgacccaatatatgcaaaacattatattccaacatgtaatcagtattaaaaagtattgagataatttttacatcagttttttcgtactaagtcccgtattttacaatatagcacatctcaattcgctatatttcgagggttatcaactagctacgttgcaagagctgagtcaactcaggaggccagcggccaccataaggggcaatgcatttagagttcacttattaaatgctgacgttaacagaacccacagagccgcatttcccttggtttcggaggacacgcgaaaaataacaacagcaaagggttctcgagcatctccttcgcgccagacggtgtgttgtactttgtcatcgtcgcagtaaggccggtgctatcgccctcctagtttgaccaagcgagaggactttctccagatgggcccctcccgagagaatggtcgccgtcccgctctcctgttcgggtcaccaccggccgggcgccactcgaacgagccccggccagccgtcaccctaatcattcccgaaggaggggccatcagagctacagctcatcagggtcaatcagaaggggcgcccgcacgcaaaggtcacctgcaaaccgaagcggcgcacggataaggtccgggacttgaagtctatctccaaacattcaggctcctcctccgactcctcctcgaactggcgctcagaggcgccaccattcggaaggagcccaggcacgcgcagtcgccctcccgcaccggagggcagcagccgcctcatgcgactcgagaacgctagagggcgccgcttccgggagcccaagcggcttccgggtgctcgcgcgccgacctggacgcagagaagccagagactttcgcttccggctgccgcaggcgcttcgctggtgcaggtaagctccgcacactctcggccggtcccgagtccgactccctcaagggtgacgcgagctctgccctttaaccggaaacgtctccctgctcaccccacccccgcgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcatcatcggaacagagttgctgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagcctttt

SEQ ID NO: 22587 - DNA, 1771 bp, Homo sapiens
tcaattacctctgagaggtaagttctattacatccacattttactgataagaaaacagtagctcagagatagcaagcagtttacctaataaaaacaagagcaaacttcttaaaagccctttctctccaacggcttaatttatttaatcctcctaacaactctgagctgggtatcgtcaaaggggattccaccaaggtagcctcactccaacactctaacccaaggctgctcaacagaaatataatgtaaactgcacatgcaatttaaatgtttttagaagctgcatttaaaaagtaaaaacacaggtgaaattaataacatttttatttgacccaatatatgcaaaacattatattccaacatgtaatcagtattaaaaagtattgagataatttttacatcagttttttcgtactaagtcccgtattttacaatatagcacatctcaattcgctatatttcgagggttatcaactagctacgttgcaagagctgagtcaactcaggaggccagcggccaccataaggggcaatgcatttagagttcacttattaaatgctgacgttaacagaacccacagagccgcatttcccttggtttcggaggacacgcgaaaaataacaacagcaaagggttctcgagcatctccttcgcgccagacggtgtgttgtactttgtcatcgtcgcagtaaggccggtgctatcgccctcctagtttgaccaagcgagaggactttctccagatgggcccctcccgagagaatggtcgccgtcccgctctcctgttcgggtcaccaccggccgggcgccactcgaacgagccccggccagccgtcaccctaatcattcccgaaggaggggccatcagagctacagctcatcagggtcaatcagaaggggcgcccgcacgcaaaggtcacctgcaaaccgaagcggcgcacggataaggtccgggacttgaagtctatctccaaacattcaggctcctcctccgactcctcctcgaactggcgctcagaggcgccaccattcggaaggagcccaggcacgcgcagtcgccctcccgcaccggagggcagcagccgcctcatgcgactcgagaacgctagagggcgccgcttccgggagcccaagcggcttccgggtgctcgcgcgccgacctggacgcagagaagccagagactttcgcttccggctgccgcaggcgcttcgctggtgcaggtaagctccgcacactctcggccggtcccgagtccgactccctcaagggtgacgcgagctctgccctttaaccggaaacgtctccctgctcaccccacccccgcgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctcgcgctctgtgcggactggggccatgatcgggcccgggggcctgagcctgggaccccaccccgtgttaatgaaaaatgagttttggca

SEQ ID NO: 22588 - DNA, 1842 bp, Homo sapiens
tcaattacctctgagaggtaagttctattacatccacattttactgataagaaaacagtagctcagagatagcaagcagtttacctaataaaaacaagagcaaacttcttaaaagccctttctctccaacggcttaatttatttaatcctcctaacaactctgagctgggtatcgtcaaaggggattccaccaaggtagcctcactccaacactctaacccaaggctgctcaacagaaatataatgtaaactgcacatgcaatttaaatgtttttagaagctgcatttaaaaagtaaaaacacaggtgaaattaataacatttttatttgacccaatatatgcaaaacattatattccaacatgtaatcagtattaaaaagtattgagataatttttacatcagttttttcgtactaagtcccgtattttacaatatagcacatctcaattcgctatatttcgagggttatcaactagctacgttgcaagagctgagtcaactcaggaggccagcggccaccataaggggcaatgcatttagagttcacttattaaatgctgacgttaacagaacccacagagccgcatttcccttggtttcggaggacacgcgaaaaataacaacagcaaagggttctcgagcatctccttcgcgccagacggtgtgttgtactttgtcatcgtcgcagtaaggccggtgctatcgccctcctagtttgaccaagcgagaggactttctccagatgggcccctcccgagagaatggtcgccgtcccgctctcctgttcgggtcaccaccggccgggcgccactcgaacgagccccggccagccgtcaccctaatcattcccgaaggaggggccatcagagctacagctcatcagggtcaatcagaaggggcgcccgcacgcaaaggtcacctgcaaaccgaagcggcgcacggataaggtccgggacttgaagtctatctccaaacattcaggctcctcctccgactcctcctcgaactggcgctcagaggcgccaccattcggaaggagcccaggcacgcgcagtcgccctcccgcaccggagggcagcagccgcctcatgcgactcgagaacgctagagggcgccgcttccgggagcccaagcggcttccgggtgctcgcgcgccgacctggacgcagagaagccagagactttcgcttccggctgccgcaggcgcttcgctggtgcagacgcagtgctgagcacacagctaccggacaaagagtgacgcccggagctggagttatggcggctacggagccgatcttggcgctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggcaaaaaaaaaaataacaaaccctttctcataaattcactccataataatcataaccatattacaacctacaactcaatccaattcaaccgggcagggttttacatttctggattgggcaaactctgctattccccactaaactccttgggtttaatcaccctttcctttgcttcggcactgcgaagcggcccgcactcttctcccttcaataactccgtaaccttattgcaattggcaatcttaagctaacttctggttaaattttcc

SEQ ID NO: 22589 - DNA, 769 bp, Homo sapiens
ctctaggtcgaggcggtgttatcggacgaggggctgcgcaggcgcttcgctggtgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggca

SEQ ID NO: 22590 - DNA, 1722 bp, Homo sapiens
tgtgacttgctcctccttgtcttccaccacgattgtgaggcctccctagccacgtggagctctcaaaggtggagacaacccaaatgtccttcaatggatggttaaatataccatggtacatctataccatagattactactcagcaataaaaaggacaaactattgatacaagcaaccacttgggtgaatctccaggaattgtgccaagtggaaagagccaagcccaaatgattatacactatatgattccagaacccacagagccgcatttcccttggtttcggaggacacgcgaaaaataacaacagcaaagggttctcgagcatctccttcgcgccagacggtgtgttgtactttgtcatcgtcgcagtaaggccggtgctatcgccctcctagtttgaccaagcgagaggactttctccagatgggcccctcccgagagaatggtcgccgtcccgctctcctgttcgggtcaccaccggccgggcgccactcgaacgagccccggccagccgtcaccctaatcattcccgaaggaggggccatcagagctacagctcatcagggtcaatcagaaggggcgcccgcacgcaaaggtcacctgcaaaccgaagcggcgcacggataaggtccgggacttgaagtctatctccaaacattcaggctcctcctccgactcctcctcgaactggcgctcagaggcgccaccattcggaaggagcccaggcacgcgcagtcgccctcccgcaccggagggcagcagccgcctcatgcgactcgagaacgctagagggcgccgcttccgggagcccaagcggcttccgggtgctcgcgcgccgacctggacgcagagaagccagagactttcgcttccggctgccgcaggcgcttcgctggtgcaggtaagctccgcacactctcggccggtcccgagtccgactccctcaagggtgacgcgagctctgccctttaaccggaaacgtctccctgctcaccccacccccgcgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggca

SEQ ID NO: 22591 - DNA, 957 bp, Homo sapiens
gatccagggtccctgggtgggtgggtcagcagccaggctctatcgatgggaatcagtgccaccttctctggagccctgggtgctgatgccctcagctgcaaatctaggttggcaggggtcccattttccttggcattcaccagcaataaagctccaaggtgctccactcctgaccaccactccccactctggtgctgagtgagaggggctgtcctcagaggaccctgggacctgcctcaggccccctacccacctctgccatgcctaggagtcccattcacacaggcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggca

SEQ ID NO: 22592 - DNA, 2540 bp, Homo sapiens
tcaattacctctgagaggtaagttctattacatccacattttactgataagaaaacagtagctcagagatagcaagcagtttacctaataaaaacaagagcaaacttcttaaaagccctttctctccaacggcttaatttatttaatcctcctaacaactctgagctgggtatcgtcaaaggggattccaccaaggtagcctcactccaacactctaacccaaggctgctcaacagaaatataatgtaaactgcacatgcaatttaaatgtttttagaagctgcatttaaaaagtaaaaacacaggtgaaattaataacatttttatttgacccaatatatgcaaaacattatattccaacatgtaatcagtattaaaaagtattgagataatttttacatcagttttttcgtactaagtcccgtattttacaatatagcacatctcaattcgctatatttcgagggttatcaactagctacgttgcaagagctgagtcaactcaggaggccagcggccaccataaggggcaatgcatttagagttcacttattaaatgctgacgttaacagaacccacagagccgcatttcccttggtttcggaggacacgcgaaaaataacaacagcaaagggttctcgagcatctccttcgcgccagacggtgtgttgtactttgtcatcgtcgcagtaaggccggtgctatcgccctcctagtttgaccaagcgagaggactttctccagatgggcccctcccgagagaatggtcgccgtcccgctctcctgttcgggtcaccaccggccgggcgccactcgaacgagccccggccagccgtcaccctaatcattcccgaaggaggggccatcagagctacagctcatcagggtcaatcagaaggggcgcccgcacgcaaaggtcacctgcaaaccgaagcggcgcacggataaggtccgggacttgaagtctatctccaaacattcaggctcctcctccgactcctcctcgaactggcgctcagaggcgccaccattcggaaggagcccaggcacgcgcagtcgccctcccgcaccggagggcagcagccgcctcatgcgactcgagaacgctagagggcgccgcttccgggagcccaagcggcttccgggtgctcgcgcgccgacctggacgcagagaagccagagactttcgcttccggctgccgcaggcgcttcgctggtgcaggtaagctccgcacactctcggccggtcccgagtccgactccctcaagggtgacgcgagctctgccctttaaccggaaacgtctccctgctcaccccacccccgcgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggcaaaaaaaaaaaacaaaaaaacaaaaaaaactataaaagacaaataacacaaatctacaacacaaaagaagggcggcgagccgataataacaaaataactcaccagaagaggcgcacacaaaaaaagaatacaacacgcaattataataataaaaacgagttgccacaccaataagaaggacgataataaataacacgcaaaccacgtgcgccagacatttaaaaaaacgaagccagtatggatagggacacactagataatacacaggagacacaacacgtgcaaaaaaagaaaccacacaaaaaactaaaccagggagccctaaacaatatggggacacaaccaacaaccaaaacaagagataaaacaaccaccaagagaggaaaaacaaaaaaactctaacacgagtattaaagtgcggtgacaaccacagcacgagaattaagcacagaagaaaaaatattaggctactaaacaatcagatccgagaacaaatttac

SEQ ID NO: 22593 - DNA, 1873 bp, Homo sapiens
tcaattacctctgagaggtaagttctattacatccacattttactgataagaaaacagtagctcagagatagcaagcagtttacctaataaaaacaagagcaaacttcttaaaagccctttctctccaacggcttaatttatttaatcctcctaacaactctgagctgggtatcgtcaaaggggattccaccaaggtagcctcactccaacactctaacccaaggctgctcaacagaaatataatgtaaactgcacatgcaatttaaatgtttttagaagctgcatttaaaaagtaaaaacacaggtgaaattaataacatttttatttgacccaatatatgcaaaacattatattccaacatgtaatcagtattaaaaagtattgagataatttttacatcagttttttcgtactaagtcccgtattttacaatatagcacatctcaattcgctatatttcgagggttatcaactagctacgttgcaagagctgagtcaactcaggaggccagcggccaccataaggggcaatgcatttagagttcacttattaaatgctgacgttaacagaacccacagagccgcatttcccttggtttcggaggacacgcgaaaaataacaacagcaaagggttctcgagcatctccttcgcgccagacggtgtgttgtactttgtcatcgtcgcagtaaggccggtgctatcgccctcctagtttgaccaagcgagaggactttctccagatgggcccctcccgagagaatggtcgccgtcccgctctcctgttcgggtcaccaccggccgggcgccactcgaacgagccccggccagccgtcaccctaatcattcccgaaggaggggccatcagagctacagctcatcagggtcaatcagaaggggcgcccgcacgcaaaggtcacctgcaaaccgaagcggcgcacggataaggtccgggacttgaagtctatctccaaacattcaggctcctcctccgactcctcctcgaactggcgctcagaggcgccaccattcggaaggagcccaggcacgcgcagtcgccctcccgcaccggagggcagcagccgcctcatgcgactcgagaacgctagagggcgccgcttccgggagcccaagcggcttccgggtgctcgcgcgccgacctggacgcagagaagccagagactttcgcttccggctgccgcaggcgcttcgctggtgcaggtaagctccgcacactctcggccggtcccgagtccgactccctcaagggtgacgcgagctctgccctttaaccggaaacgtctccctgctcaccccacccccgcgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggca

SEQ ID NO: 22594 - DNA, 1828 bp, Homo sapiens
tcaattacctctgagaggtaagttctattacatccacattttactgataagaaaacagtagctcagagatagcaagcagtttacctaataaaaacaagagcaaacttcttaaaagccctttctctccaacggcttaatttatttaatcctcctaacaactctgagctgggtatcgtcaaaggggattccaccaaggtagcctcactccaacactctaacccaaggctgctcaacagaaatataatgtaaactgcacatgcaatttaaatgtttttagaagctgcatttaaaaagtaaaaacacaggtgaaattaataacatttttatttgacccaatatatgcaaaacattatattccaacatgtaatcagtattaaaaagtattgagataatttttacatcagttttttcgtactaagtcccgtattttacaatatagcacatctcaattcgctatatttcgagggttatcaactagctacgttgcaagagctgagtcaactcaggaggccagcggccaccataaggggcaatgcatttagagttcacttattaaatgctgacgttaacagaacccacagagccgcatttcccttggtttcggaggacacgcgaaaaataacaacagcaaagggttctcgagcatctccttcgcgccagacggtgtgttgtactttgtcatcgtcgcagtaaggccggtgctatcgccctcctagtttgaccaagcgagaggactttctccagatgggcccctcccgagagaatggtcgccgtcccgctctcctgttcgggtcaccaccggccgggcgccactcgaacgagccccggccagccgtcaccctaatcattcccgaaggaggggccatcagagctacagctcatcagggtcaatcagaaggggcgcccgcacgcaaaggtcacctgcaaaccgaagcggcgcacggataaggtccgggacttgaagtctatctccaaacattcaggctcctcctccgactcctcctcgaactggcgctcagaggcgccaccattcggaaggagcccaggcacgcgcagtcgccctcccgcaccggagggcagcagccgcctcatgcgactcgagaacgctagagggcgccgcttccgggagcccaagcggcttccgggtgctcgcgcgccgacctggacgcagagaagccagagactttcgcttccggctgccgcaggcgcttcgctggtgcaggtaagctccgcacactctcggccggtcccgagtccgactccctcaagggtgacgcgagctctgccctttaaccggaaacgtctccctgctcaccccacccccgcgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctcccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggca

SEQ ID NO: 22595 - DNA, 1411 bp, Homo sapiens
aagaaatgggagaaaaaagggaccctggggtcctcttggagaagagagggaccattcaaatgttatttggggcaaatttttttttttggagacggcctgcactctgtcgcccaggctgaagtgcagtggcacgatcatggctcactgcagcctcaaccttcccaggcttaaccaatcctcccacatagctgggactatagacacaccaccacgcctggctaatctttctttttttgtagagatgtgatcttcctgtgttgcccaggctggtcctaaactcctggcctcaggcaattctctcacttcagctccccaaagtgctgagatgatggcactggcacccagcatatactttttttttttaatgtgcaacttctttcctatctttgtgttaaggataacatatgtttagctaaggaaagactagtacagacatgagccactgcaccaggcctggaccttttccttgagtgctttatacttaggctggcttcagttaccaactggatgttgatggcctacctctagatctctaggtcagacctcttccatgtacttcagactcatgtatctcatttccacagacacctcagacagtatggctgcgacagactgtctccttccttctcacctctcctttccttctctttccttggcttggagagtggcagtgccatccatcaaaatcagacactaggcctcatccagtgtttctcctgatttttttcagctcccaaatctgttgctttggcctccttgtcacagcctctccctcagttcctctgctatgcctctgccaggttgacctcccaccaccatcttccatagctgagtaggtgctacgccagtgtggtttttgctccctctcaatttttcatgaatctgcctcccttctctgcgtctttgtctccacttccatcaccttagtccactctgtcatcatctgtcccccctggatccttgcagtagcctcatgactgatcatctacatctgctcttaggccctataatccattcttcacatggcagccctatgatgtgttcagaatgcagctctgagcatgtcattcccctgtttaaacatttaagtagcttctcattattcctagttcttcgaatatgggcccagtggccaggtgtggtggttcacacctgtaatcccagcactttgggaggctgaggcaggcggatcacttgagtccaagagtttgagaccatcctgagctacatggcaaaaccccgtctctatcaaaaattaaaaaattagctgggcatcgtggttcatgcccagctactggggaagctgaggcaggaggatcacttgagcccaggaggtgaaggctgcaatgagccatgatcgtgccactgcacttcagcctgggcgacagagtgcaggctgtctcaaaaaaaa

SEQ ID NO: 22596 - DNA, 1053 bp, Homo sapiens
aagaaatgggagaaaaaagggaccctggggtcctcttggagaagagagggaccattcaaatgttatttggggcaaatttttttttttggagacggcctgcactctgtcgcccaggctgaagtgcagtggcacgatcatggctcactgcagcctcaaccttcccaggcttaaccaatcctcccacatagctgggactatagacacaccaccacgcctggctaatctttctttttttgtagagatgtgatcttcctgtgttgcccaggctggtcctaaactcctggcctcaggcaattctctcacttcagctccccaaagtgctgagatgatggcactggcacccagcatatactttttttttttaatgtgcaacttctttcctatctttgtgttaaggataacatatgtttagctaaggaaagactagtacagacatgagccactgcaccaggcctggaccttttccttgagtgctttatacttaggctggcttcagttaccaactggatgttgatggcctacctctagatctctaggtcagacctcttccatgtacttcagactcatgtatctcatttccacagacacctcagacagtatggctgcgacagactgtctccttccttctcacctctcctttccttctctttccttggcttggagagtggcagtgccatccatcaaaatcagacactaggcctcatccagtgtttctcctgatttttttcagctcccaaatctgttgctttggcctccttgtcacagcctctccctcagttcctctgctatgcctctgccaggttgacctcccaccaccatcttccatagctgagtaggtgctacgccagtgtggtttttgctccctctcaatttttcatgaatctgcctcccttctctgcgtctttgtctccacttccatcaccttagtccactctgtcatcatctgtcccccctggatccttgcagtagcctcatgactgatcatctacatctccaaggaacccacgcatgacaacctgaaacagatggaaggaacgtgctccaggtctatca

SEQ ID NO: 22597 - DNA, 490 bp, Homo sapiens
tgctggttagccctttgacaagtctcacagtaccttaaaacacatatttatagtgaggtttgagtaacttggaagtctattttagaccaaatacacgtttggttaatgttgctaggcatagagtgtagccctcctcccttcatatgagatcctttagacgtgacaagacccgcctgtgatgcctagacccttctcccatttagaaggacatcactgaatgcaaatttgcaaaaagctatggcagaacctgtggttaaaatctcataagattcaaagagtctggaatttaagaagctaagggaaaatatatgtccagagcctatcttctaccagtcagccttgtttttgcttacataagtttattctttttctgagccaatgttgaattgaagtaatagtgatcacagcttatcacagttctctaaagattattgcctccttcactgccttcatgaattaacaccaatttcttccaaatggaattctttaa

SEQ ID NO: 22598 - DNA, 883 bp, Homo sapiens
gtccccacgaactgtctctgtgtgcggctgagctgtgcttcaccaggctggctggttctcacctgccttcctcctcacacctcctggtgatacaccctgtttctgagtcatcagtcatcggacatatgacatctaaaacgtgacagatggcaccttctattctgggctcacaggaagcaccaactggggcaaatctgttgtatttggggcacaggacacaatcgatcccaaggcccggagctgtggagaggaagccgagtgttaggatctgctgccggggcctccacgcgcccaccgggaaaagcctgagaacatcgtgtttatttcctgccgcccgttccgagagaaggaagtggaaatatcaagtaggcatctgcgaatctcccatcccagtcatgtgctacatgggtgtagtgaacagattaacctcatttagttcattagcttgcctgttgctgcaatatttggtttgttattaattaagaaaaaattaattaagaagtaactaagactcctggagcctcagagctggcaggagcctcagagatcattttgtttgattttgtttgactgtgaccccaaagcaggaatcccatctttagcctccctgaccagatggtctgagtggacccctgcataggtggggtgctggtcatgtggccagcgtgtccacaacaagcactgccaggggtccctgcatgcccagcactgtgctgggagccctgggtgagggaaggaaatcagacatggataagaaccagagcaagaggagtagtgtatgtcagacctggtgccagggtcaggggagctcacactgtcttccatgagaccctttccttgtctccatctgtatccccaggtagcccccctctcggaggaaacg

SEQ ID NO: 22599 - DNA, 1356 bp, Homo sapiens
ttagtagagatgaggtttctccatgttggccaggctggtctcgaactactgacctcaagtgatccacgcacctcggcctcccaaagtgctgggattataggcatgagccactgcgcccagccaggagctgggttttaatgggggcatttcattgtggacattttacaaggctttgagctaggtttaaatcttatataactttccccagctctctccgtgtctctgagactcaacttcctcatctgcaaaatagggttaaccgaacttccttcataggtctgtgtgagagatttggtctgcacatggccataaaatgcccagctagtgcctggtgggcacagtgggcactctgtgagtgagttagccctgttaggagtttctggaatggagacggtggtggggagcggggctagctcttgctgacatccttgtggctggaggtgggccttcccagggcagcgtagggcagctgtgtgcaccccctcatccagtctctttgttcacagggatgtgtctgcaggccttcgtagaagctttctttttcctggctcagaggaagttcaagatgctgccacttcatgagcaggtggcctcactgattgacctttgcgagtaccacctgtccctgctggatgaaaaacgcctggaagcaccaactggggcaaatctgttgtatttggggcacaggacacaatcgatcccaaggcccggagctgtggagaggaagccgagtgttaggatctgctgccggggcctccacgcgcccaccgggaaaagcctgagaacatcgtgtttatttcctgccgcccgttccgagagaaggaagtggaaatatcaagtaggcatctgcgaatctcccatcccagtcatgtgctacatgggtgtagtgaacagattaacctcatttagttcattagcttgcctgttgctgcaatatttggtttgttattaattaagaaaaaattaattaagaagtaactaagactcctggagcctcagagctggcaggagcctcagagatcattttgtttgattttgtttgactgtgaccccaaagcaggaatcccatctttagcctccctgaccagatggtctgagtggacccctgcataggtggggtgctggtcatgtggccagcgtgtccacaacaagcactgccaggggtccctgcatgcccagcactgtgctgggagccctgggtgagggaaggaaatcagacatggataagaaccagagcaagaggagtagtgtatgtcagacctggtgccagggtcaggggagctcacactgtcttccatgagaccctttccttgtctccatctgtatccccaggtagcccccctctcggaggaaacg

SEQ ID NO: 22600 - DNA, 445 bp, Homo sapiens
taaaggatcagacctagaaccttgcctggcacaacagaagccctcacagaataattggatctgcttctcagaaaagaaataagtaaacattaagttttatataaattttatgaaggttcacagcccatctatgcatttcagtgtaagaatctcattgcaggctgggcacggtggttcacacctataatcccagcactttggaagggtgaggcaggaggatcacttgagtctaggagttcaaaaccaacctgggcaacacagtgggaccccatttctaaaatatatacatatatatatagccaggtgtgatagtgcacacttaacagtctcagctactcaaaaagctgagggaggaggatccctacaggccaggagttcgaggctgcagtaagctgtgactgcaccactgcactccagcttgggtaacagagccagatactgtccc

SEQ ID NO: 22601 - DNA, 256 bp, Homo sapiens
attaaaaccatgaagtggatgcaaagagcagaagacaaaaacaagaacaaataataagggccacaaatagaaagcagtaacaaatatgatagatattaacccaatgatattagcaactgctttgaatatcaatggtctaagtgcactaattaaaagaaattttcagagtggatccaaaaaaaagacctaactatatgttgtctataataaatctactttaagtatagaaacacaaatatattagaaatatatggat

SEQ ID NO: 22602 - DNA, 666 bp, Homo sapiens
agcaatgttagctggcacaaattatgccagcaagtcctctggactctcccttcatcccacctttactaagtattgcctggttgccaggaactgtgctggattctaggaatgtctccaaagcctggcatgaaacccactggcctccctctggagaggctgtcacaggcctctgggcatcctttaatctctgcagccacagtgcctgatgcaatggctgatcctgcattagtgagcagtgtttaggaaatgggtttatgaataaatcacatatgaataaacaagggatgagtgggcagctggatagatggacagatggatggatgtacaaatagagtatattatgttgcacatacattttaagcctcctctggagtatctctcatagtgcctttaattttatagtgtcattctcatctctctatgatttttttctctattttttttatatttggtctaggtccacggcaaatagggtaggggagtcggagctggccatgctggaggttggaaaggtgttaacaagctataaatgaccttccctggcctattcaggcataagtaatgtctccaaattgcctacagtcaaaactgccaattccaagctgattgcaatgaatcaggctccccctatacgcaataatgtgatcaatttctcatttcgctgaa

SEQ ID NO: 22603 - DNA, 253 bp, Homo sapiens
atagctcaccgcagccttggactcctggacacagtgatccttccacctcctgagtagctgggactataggcacacaccactatgcccagttacttttgttttgtagagacagggtctcgctatattgcccaggctggtcttgaactcctggcctcaagtgatccctgcctcagcctcccaaaatgttgggatgacaggtgggagccactgcaccctgctgagaccagtgacttttaaagtcgactagtggctg

SEQ ID NO: 22604 - DNA, 704 bp, Homo sapiens
ctcccaaagtgctgggattacaggagtgagccactgcccccagcctctttctcatttaaaaagaaatggattaaaagttcatttagaacatgagtaaatgttttatatctttttctagtaaaaccttatagtttttgttgctataaaaatgagccccctttttttcctgtttgataatctaattagttattactagagagtaagttgatttttatgttaatcttgttttcagcagctttgatgatttgttagttgtaatagttctaatctggcagttcttataatctacctgttgattcttttagatttattatatagaaaatcattatgttctcccatagttttgtctgcttcttttaaacctaatgttctatataatacttgatttattgcattgaataggttttctattcagtgttaaatagcaggcaccttttcttgttcctgattttagtggggaatacacctataatattacaaataagtataatatttactatagttttttagcgtagatcttttagttttacagtttatctgccccatgtcagtattaccctgaatttaaggtttccccattaatagttttactcaaatcagaatcatgtatgaaattaaaaacatatatacatctggctagagttccagatattctgatatctggagtctaggcatttgtatttttaaaaagcattgtgcttact

SEQ ID NO: 22605 - DNA, 636 bp, Homo sapiens
cagaggagctgggattttccatcctaaagaggatgtggccgggatggaactccatcaccatcctgaagccacagcagaggtggcaggtaacagacagtccagagctgctcactgtcttcatacatgacgtgaggacggtggttccagtgcgccgcaaggtgggactgaggttcagagttgagaggaaacaataggaaggggctgagatgctgcaacaggtcacgggctgctattgtaaacacttttttaaggataggttcaaataagagcttcttggcttggagaactgaggggaagtatgactaagaagtattaggttggtgcaaaactaattgcagtttttgccattaaaagtaatgacaaaaactgcaatttcttttgcactaacctaatattctgaggacaagaagacatttaataccacatgactttttttaagtaagaggtctcattttctaaataacttgaaaatagaggctctccaagggttccgttacaggagagaataatcagaggtgaagaaaacccatttagagctgactccctttcccagggaatgagcttttggtcctcatagactggcatcctgcagacacgcagagagaaagaataaagcctgcctgtgcattgttaatt

SEQ ID NO: 22606 - DNA, 554 bp, Homo sapiens
cagaggagctgggattttccatcctaaagaggatgtggccgggatggaactccatcaccatcctgaagccacagcagaggtggcaggtaacagacagtccagagctgctcactgtcttcatacatgacgtgaggacggtggttccagtgcgccgcaaggtgggactgaggttcagagttgagaggaaacaataggaaggggctgagatgctgcaacaggtcacgggctgctattgtaaacacttttttaaggataggttcaaataagagcttcttggcttggagaactgaggggaagtatgataacctaatattctgaggacaagaagacatttaataccacatgactttttttaagtaagaggtctcattttctaaataacttgaaaatagaggctctccaagggttccgttacaggagagaataatcagaggtgaagaaaacccatttagagctgactccctttcccagggaatgagcttttggtcctcatagactggcatcctgcagacacgcagagagaaagaataaagcctgcctgtgcattgttaatt

SEQ ID NO: 22607 - DNA, 694 bp, Homo sapiens
gagcccgtccctttgtttcccataaggaatacttttagtaaatcttaccactggcttgctgtcaataaatatgtgggtaaatctctgttcaaggctctcagctctgaaggctgtgagacccctgatttcccacttcacatgctgtatttctgtgtgtgtgtctttaattcctctagcaccactgggttagggtctccacaaccgagctggtctcagcagtaaatattgaaaaggaatagatacaattgtcattatttacagatagaatttccaaacaattcccagggaataaactgaaaaactaacagaaacaaaacaagaatgtagtaaggtgtctgggtaagagatttgtatctaaaaatcagtagctttgcaatgtgcaagcagtaatctgcttagacatcagtaaatacctcattcatattttaaacaaaaaattaaaaatgccttgaaataatgtaaccagaaatacaaaaaaaaaggatatgaaaacgtggctgctaatggacatgaaagaatgtaatactagattctgagatgcaatttttttcatttgttcttcctgaaaaatcattaggttgatgtgcattacagtgttacgattatgtatgagtctaaggaaaatcagatgaaatttccaaattaaaccatgaaggtgcattggtagaggaagagacaattagggtcagtggag

SEQ ID NO: 22608 - DNA, 390 bp, Homo sapiens
atggccactagagtgacgtcagattcagcccagctcaaatgcctccgcagtgctccctgggtgcttcctgccacacgtcctccgcatgctattctcatcagctagatcgtgtgcttcctgaggacaggaaccatatgttaaattttcacagctcctagcaacttgcaagaggctcagagggaaaacttgtaattgaatcttcttccagcatttttgaagatggatattcaatgactggttaacattagctttgaagagaggatctaggaggtggtaccgggagggacagggagggagaattttacttttcatcttacaacttatgcacttttagaatttttttctggccatgtggcaaaaatgttttacataaatatttttaaaacaaga

SEQ ID NO: 22609 - DNA, 409 bp, Homo sapiens
aggtgtgcaccaccatgctgtctttgaaaaacgggtctgactgttgcacaggctgaatgagtctttagctgatccctgagaccttttggtggccatccctgtggccccaaggttggagtccatgctccatgtgagaggccgatggttgcctggggcttttctctgtggctcatcagtgattcttatgcaacctgctctttgcaaacaaggtgctgagaaataccactggctggagcgcagctgagctgcttgggaaaggaatggcctgtagcgttgccacctacactcctggcctcgggtcgtttaagtcaggactggacagtttaggtggcacggagcagagtgaggctggggggtgtgggagccaagcagggctccaccgtcgccttctttcctgttagagagactc

SEQ ID NO: 22610 - DNA, 2082 bp, Homo sapiens
ttttcatgaagttggggttttaccattttggctggctggtcttgaactcctgacctcaggtgatccacccaccttggcctcctgaagtgctgggattacagacctgagccacagcacccggccttggtggtggtcttattgaaggggaaacgctttttgaaatcaataggatgaaggttttttaaaaacaatgaagtcttaaatcattagattttaaagtggggtctggaggtggaagacagcttatttctgctgtgtaacatttagtacttaaccatacataattatcaatgcaagttttttgtcctaggtgcaagattatatttatttgagagtatcaggtgaacaagtttacatttaaaggcgagaattgtgttaagcatttggtattgacattatagttttagtaaaaccatcaagttatctcgatagagtttgaaactaagctctttggtggactgctactgtttattaagtaggtatcacatttctatagcaagacatagttgagttttgtaaatctacttgtattttgaaggattgaattgtgaaaattatttgtcttttggcaatctttctgaatagagagcgtgcatgagcaagtttgcattgcaattaataggtgaaaattgctgagcacctaagtaaccaaaaaggaggtgatgaattaggttacagaattagttttgtccaccctttacctgtctactccattatttgatttttggcagcattcagcatgctttttctgtaaaggaccagtaaatagtaattattttaggctttgtggccaggatgcaaaattgaagatattatgtaggtacttaatattaaaagaaagaaaaaatttacagttttttaaaatttcagtccaaaatgtcaatctgtaaattttttgttgataaaaatacaacaatataagatacaacattttgtaatacaggcctactaatgagaaatgagaattttatttttgtgagggtaggggagataacacttagctgaattggggttcagagttagtgttttctataatcaaatcaattgctaatgtttatctgtaaaaaccattcttaccttccaggctgtacaaaaacaggcgataggccagatttgaccatggtccatacttccccacccttgatttattctataaaactagtagaattcgactaactgttttgtttcatcaaagctttttttttttttttttttttgagacagagtcttgctctgtcgtctaggctggagtgccgtggtgcaatttcggctcactgcaatcttcgcctcccaagttcaagcaattctgcctcagcctcctgagtagctgggattacaggcgtgtggcactacgcccagctaatttttgtatttttagtagagacagggtttcaccatgttggtcaggctggtctcaaactcctgacctcatgatccgcctgccttggcctcccaaagtgctgggattacagtcgtgagccaccgtccctggccatcaaagcatttttaatatagaaggtcagttgagttgctgcctaggatgcaacctgatcttaatttacaaagtaattaaattattataaaataagtttgcattcatagattaaaaagtacacatttattttattattattataattttttgagatggagtttcgctcttgttgcccaggctggagtgcaatggtgcaatcttggctcactgccacttccacctcctgggttcaagtgattctcctgcctcagcctcccgagtaactgggattagaggcatgcgccaccatgcctggctaattttgtatttttaggagagatggagtttctccatgttggtcaggctggtctcgaactcccgacctcaggtgatctgcccacctcagaatcccaaagtgctaggattacaggtgtgaaccaccacgtcctgctaaaaagtacacatttaaaatctaagttccattttcccgtcatgtttattaatttgtcccattgcaagatatgtttctgttgtctgcatgggtagagataattttaaaagcttggttaagtaaaaactgattttcttaattattgccctttaggtta

SEQ ID NO: 22611 - DNA, 263 bp, Homo sapiens
gtgatgatgacttattagaaatattgggccagtctaccaacccatcagtgattcagtctcacctgaagaagctttttgctggtattaacagtgtttgctttgatgagaaatcaaaacatataactgcaatgaaatctttagagggagaagttgtaccttttaaaaataaagttcctctatcaaataatgtagagacatggttgaatgatttggccttagaaatgaagaaaactttggaacagttgttgaaggaatgtgttact

SEQ ID NO: 22612 - DNA, 577 bp, Homo sapiens
tttgctgaacctcaggagttcactcagcacatcgttcgctctcagctgccccagcaggagctgcgcagaaccgccttggaggcgtgctcagaggacacttcctcacttttataatgaatcgtgagcactctctcctcgctttggccggcagagcctgcctttctggccacgtggacgtcttcatgcagggtcctgctggccccttgacatcaacaggcatgaagctgcagccatcctctcccctccccaagttttgggcaccaccatctcctagtctcttgagactggcccctggcttctcccgttaccccagcctcagtcccatccaatctgctccccattgagaagtccaagtggaccctcttctccggcctcactgcccccagcccactccttgggctccatcccagcctcttccttggcggtcccccagctactctccagtcctacgtgcagctgcatcttccagatccacctggcacggcatctccttctgcctcaatgcctgggattcaggaccttgatcacagctgggttttgtatagaaataaataaataaaactgaaagaaaaaaaca

SEQ ID NO: 22613 - DNA, 328 bp, Homo sapiens
tctctcttctactgtggctcttcctatccctggtgtcccttgaatgccctatcttcccttttgtgcctcccaaacctctcacgcccgccccaagttactcatttccttagttgttctgaactttaaataaggtaatgcatgtaagattgcataaatgctcaataattgtcatctgttattattttcatcagtaacatcatctgaatcatcagtattgtctatttttaacagctgcatttttcattgtccgaatatagtcacatacatttgaacattttataattattgaataataaattcgttctgctattttacaataaaaaaaaaa

SEQ ID NO: 22614 - DNA, 492 bp, Homo sapiens
tcagaatgcaaagccatcctggcccaatgggaagagtttcagattgaagatcctttcggaaataatgctttctttgagcacctgcctgtgatgcagtacgcacctggcagaaggctggcttactctcatgcactcactgcccctctctgcctttcagaaactgccctaatctgccccacatcccatgccagcctctcctctccatttgctgctctaggaagatggatcatcttctgtccccccgtagccctgcctctgggcccaggatctactcttgcctgcctctcctcctccctcctcctctctaccagcctctccccatcctcccctgggggccccctggctggtctggcccatctgaagcctttcctccccaaactctcttgcatgtagactctttaactctagcatggcattccctgtccttctcttcctttgtgttttttttctctctccaaatagatggtcagcttttgtggaagcatggatcat

SEQ ID NO: 22615 - DNA, 288 bp, Homo sapiens
actcaggaacattcaagaatattctcagcatctcctcctcttttgtacctccaataactggcttcttcgcttctgtgtatttcctattcataacttggcttgcaagtagctttggtttgccatggccctaattccaatttatggcatccttatttttttcagttccactggtaaattctctccataattcttagctgaaattcccagtccatggccagcctggtgattggctgccgttggatccagtgtccactctagtccaatcagctctgtgctggtgggtcagat

SEQ ID NO: 22616 - DNA, 339 bp, Homo sapiens
gtgaaccccctggtcaccatcaaagttagcacacaacaaagccaaccacgtgtccccctcacagatgacaatggctgaactctgagtgaaaccacctgtatggccgggcacagtggctcacgcctgtaatcccagcactttgggaggttgaggtgggtggatcacctgaagtcagaagattggcctggccaacatgatgaaaccccgtctctaataaaaatgcaaaaattagctgggcgcagtggcacgtgcctgtaatcccagctacttgggaggctgaggcaggagaaccgctggaacccagaaggcagaggttgcagtgagtggagatcatgccac

SEQ ID NO: 22617 - DNA, 377 bp, Homo sapiens
gatgggaaaggagaaaagccagcatggtcggagggtcagaactatatggaggggaaactgggtgaattctgagcccactctggcctgagttaaaatcttctaaaggcagatcagtatcttgtttgagcccaaaagagtcctttgataatttaccatgttattatgcttattgtacacatttcctctttctctcagcaaacctagagtactatacatacattattgatttatctttatcatgttcaaatgaaaggcctggtgagtgaattgccttaacagactttacaaaatgaaaaattattaatgtgatatattagtgaagtgcagaagcttcacttaaaaagtagagctgttagctttcctaaagagatactaga

SEQ ID NO: 22618 - DNA, 1348 bp, Homo sapiens
aaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttgtatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgatttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgaaaaaaaaaaaaaaaa

SEQ ID NO: 22619 - DNA, 1294 bp, Homo sapiens
aaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaagaatttgtatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgatttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgaaaaaaaaaaaaaaaa

SEQ ID NO: 22620 - DNA, 927 bp, Homo sapiens
acttggcatccccctgtggtgagaccacaggcatgagccatcgcgcccagccataactccccacccggacatggcatgtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgatttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgaaaaaaaaaaaaaaaa

SEQ ID NO: 22621 - DNA, 1717 bp, Homo sapiens
  misc_feature (1398)..(1398): n is a, c, g, or t
  misc_feature (1400)..(1400): n is a, c, g, or t
aaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttgtatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgatttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgaaaaaaaaaaaaaaaaaaaaaaaaaaaaaaaaaaaaaaaaaaaaaaaaaaaaaaaaaaaaaaaaananaaaaaaaaaaaccttgtcgcccccttggcccaatccaattttaaactcaaccaacttaatccatccgccccaaattcaacctaattggccaaattccccctatagggagccgtttaaaaatcaactgcccgccgtttaaaaacgtcgaaactggaaaacccctggcttacccaaactaaatccctttgaaaaaaatccccttttcccaagttggctaaataccaaaaagccccgaaccaatcgcctttccaaacagttgcccaccctaaatgccaaaggaaaattgaaaccgtaaaaatttggtaaaaatccccgta

SEQ ID NO: 22622 - DNA, 1537 bp, Homo sapiens
aaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttgtatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgatttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgaaaaaaaaaaaaaaaatcatggctttaaaaaaaaacaaaaccacacacacatgaactcagatttgcaaactaggtcaggatttcaagaccagcttggccaatatggtgaaccctgtctctactaaaaatacaaaattagccgggcatggtgacgacgcctgtagtcccagctacttgggaggctgaggcagaatggctttcaccc

SEQ ID NO: 22623 - DNA, 1383 bp, Homo sapiens
  misc_feature (1257)..(1258): n is a, c, g, or t
  misc_feature (1375)..(1375): n is a, c, g, or t
aaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttgtatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgatttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaatgctgtcaaaggatccaaagtttcagttagacagnnaaaataaacttcagtgatctattgcacagcatggtgaccacagttaaaaataatgtatggtacatctccaaattgcttaaataaaaaaaaatggtttcaaatgttgtcaccacgggnaatccaaa

SEQ ID NO: 22624 - DNA, 323 bp, Homo sapiens
gtctcatttgacaaatgaggaactacaaatgggaacagtttaagatgagatttgggtggggacacagccaaaccacatcagtggtgctaatagacagtggtgctgtggtgtgtagtagggaaaactatggcctgtgggccaaattttgaagtccttttactttttggttctaaaaattattaattgtagccagagttgttaacttaatatgtcttggaccccttgggctctctgaagactgtactctttctttccacttaataatatacatggaattgcaaaggaaaccaatgatattgaaatagatatcagaaataaaattt

SEQ ID NO: 22625 - DNA, 302 bp, Homo sapiens
aatattattatgaacacccatgtacctagtattccagatttaaaaaaataaacatgccaaatgtttgtgaaacctcacatacactatgtctgtttgacatctcctctctttttctaggacttagtttgctataaagctgaatctgcagactattattttatttaacattttgtatttaagatttccccatgatgtcttgtaagcactgggacttgcattttcactgttatctatatgtatatttatttgtttgtttatctatccatgtttcttgtgactaagaatatttaagattgttatat

SEQ ID NO: 22626 - DNA, 459 bp, Homo sapiens
tgagacagagtcttgctctgtcacccaggctggagtgcagtggcaccatctcagctcactgcaacctccgcctcccgggttcaatagattcttctgcctcagcctcccaagtagctgggactataggtgcatgccaccacgcccggctaatttttgtatttttttagtagagacggggtttcaccatattggccaggctgggctcgaactcctgacctcgtgatccacctgcgtcagcctcccaaagtgctgggattacaggcatgagccatcgtgcccggccagccactaacatttaattagtatattactataattagtatattactaaaaagagaaaactgaaatcatctaggtttgatttcagaattggctacagctggtagatgaccatgaaaatggaatcttcacaagagactgatgtcctcctgctatattttacaattcaacatcatgtgt

SEQ ID NO: 22627 - DNA, 347 bp, Homo sapiens
ttaagacagggtcttgttgtgcaggctgcagtacagtggtatgatcacagcttactgtggcttcgacctcctagctcaagagagcctcttggcttagcctgccacgaagccaggactacagagagtcacacgccactaggcccagctaattgtattttttgtagagatgggatttttccatgttgcccagggtggccttgaactcctggctcaaacaatcctcctgcttcagcctcccaaagtgctgggattgcaggtgtgagccactgtgcccagcctacataccttggtcttgaccctttaccatattttgttttgttttgttttgagatggagtctcactctgt

SEQ ID NO: 22628 - DNA, 362 bp, Homo sapiens
ctgaactgcctgcagcttttacgacatccttccttccttttatgcagtggtaaaactgaatacagtcaaatgtaaattcattttgacttgcagctctgctattatcaagtccgtattatagaagtttataaacagaatggaatttcccaggattttcccagcagcactttctgctgaatatgcagatagatgaggaaagtctagtgttttttttgaacaaagtatcaacaattttttgttttctgctttctgtagtttcactaaaatcttcatagaaataaggcaattgtttgaaactcaatttttcaaattaaagtaactaagagcaggaaaacattttgttgttgctataattcgactca

SEQ ID NO: 22629 - DNA, 430 bp, Homo sapiens
gtggacccttttaaagaagaacaatttcttaagaagcccagtgttcacttacatattatataaatatatacacacattaaactagttctaaactcttggtgtttagctcttaaaagaactctaagaccacagcaaatttataattataaataacattacagtccaggtgcggaggctcacgtcccagcactttgggaggccgaggtgggcagatcacctgaggtcagaagttctagaccagtctggccaatatggcgaaaccccgtctctactaaaaatacaaaaattagccaagcatcgtggcgggcacctgtaatcccagctacttaggaggctgaggcaggagaatggcttgaacccgggaggtggaggttgcaatgagttgagatcacgccactgcactccagcctgggcaacagagtgagactcc

SEQ ID NO: 22630 - DNA, 538 bp, Homo sapiens
caggcccaggttccttgtaactagttctgtagccttgggcaaatctttagtattctctgggtcttgctttcttcacctttaaactgaaagagttgacaagatgatctctgaagtccctttcagctctgatttctatgcttttatgactagattcacagagatagactgacccataaccagaaggcaatataatgctctttcatctgtttcctgcagcttggatttgtgaaagcgcagtattggctgggcacggtggctcatgcctataatcacagcacttttggaagctgaggcaggtggataacttgaggtcaggagttcgagaccagcttggccaacatggtgaaatccccatctttactaaaaataccaaaaaaaaacaaaaaaaaatagccaggcgtggatgggtacctgtagtcccagctactcaggaggctgaggtaggagaatcgcttgaacccgggaggcagaggttgcagtgagccgagatcacaccattgcactcccgcatgggcaacaagagcaaaactccatctca

SEQ ID NO: 22631 - DNA, 691 bp, Homo sapiens
tatttattcagatctagtgtgtgtcaagcattgtcctaaatccagggtgtgcagcagtgaataagtcagatgagatctgtgtttgctgaagctacaattacatggcttcagagtgactcagcatcttctttctggagttagctccttttgacttcttgatcctttgtccttctaaggctttgtttgttttttaatttataatttcaacttttatttgtattttcaaattatttttgtagaggcaaggcctcgcttttttgcccaggctggtctcgaactcctgacctcaagtgatcttcctgccttggcctcccaaagtgctagggttgcaggtgtgagccctccatgcctggcctctgagactttgccttgtcagttgttttcttcatatttaactcttccttcactccaacttaggaatgtactcagatctctcctctcctaaaacaaaaacaaaaacaaaaacaaaaactatgaacttccaaccccaagcttctgctcgaatacctttttctaccaagattactgaatcagcccactgctttcgttactagtactctgtcctttgccctctgtgtacctcctctcaccaactatgctcttgaaaaggaggatgaccactttctagttttcttagtttttttctatttcagtgtttcttaaactttttctggagagtccctgtatagcc

SEQ ID NO: 22632 - DNA, 444 bp, Homo sapiens
agaggtatacatcagggcacagaggagaaaagctaacatgatactgatgacttcaagtcttcactgtccaattcagaggataggggagggtttaagctgattaaacagtgggctttttttctcctgcaagagggtggaggtctataactgtgcagattttatcagatgcatgctaatacatgttattctgggggactctcttataccttgaagtagacattgctgctatttggcgtgaaaaaaataggaggacttatttgaattgagaatggggataggctgagttccaccgagatgttggcttagagatgcctgggccatgctgtacagtaggaagcccagcagaggagattgggctgtgtgggtcatgacaaagggagttgttagcttatggttggctattaaagtcatgggcaaggatgggcaagaaaagtgtgtaaaatg

SEQ ID NO: 22633 - DNA, 404 bp, Homo sapiens
atggaggtgcagtgtagccctccttagaaatcgactcctataaattgggctggcggggaagagaggcagcttcttgaagtttcaagaggtgtccggtgccccaaacaaattttcctggattcttcccctataagaaaggcactgtgggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctacttgggaggctgaggcaggagaatggcgtgaacccgggaagcggagcttgcagtgagccgagattgcgccactgcagtccgcagtcc

SEQ ID NO: 22634 - DNA, 811 bp, Homo sapiens
agacagggattctgctgctgggtgctgaggagcgccgatggggcattagtgggacccagagtgtggcactgtaaatgagagctgtgtggagtgcttggggaaggcttccccgaggaggcaaagtcttgctggtggagaatttgtcagcaggaaagggaagggatcatcatgtgcaaaggcaggcagcctggagccagcatgtgtgtcaggtacccaggagcagctggagtgttcctggcacccacgatactgtgcagaagtggggaggtgggcagcagagggaaggctggggtgagtcatgaggatctgtgaatgccacactaagcaacttgtactttattctaggggtgcaggggctttgagaagtttcaagcatgggagaactttttttgttgttctttttgagacagggcctctctcactctgtggccaaggctcgagtctgagatcacgccattgcattccaccctgggcaacaagagcaaaactccgtctctaaataaataaataaataaataaatataataaaaacaccaagagcgatctctataacaagaaaaaagagcctgtcttactgaggccctacgacagtcacccagctccagccgcctctagccttcctgtctcacctaaggaggtgggacaaagctaagacacctgtgaagacaccagggatacggatgcactaaaagaccaagatttaatcataaaattagaaacgtgcttccccgtttcctaaatcataccaccacatcaacggggctccagtgtaacagcagtggattgtagctgagggagctattaggcacag

SEQ ID NO: 22635 - DNA, 140 bp, Homo sapiens
cagaattagctaagaatgagttctaatgggggaagttactgtacaagtactgcctctaatatggcagagttatgatgggccaaagatgataattcacaccaataaactcacctcagggactctgatgtcccaatctcagt

SEQ ID NO: 22636 - DNA, 596 bp, Homo sapiens
gcttccccaaatacttcccaatcaaaacactaaaaggcagacctgaaattaataaaaatgttaattaaatctgttcaacagaaagcataaagccagtctttttaattatgaaatgtagcattcatataaatttcattgcttttgaaaacaatctatggctagattctcctgggtttgtatgatgattactgaaaactgtagaaaatctaaaatcaagcaagttgtttataggcaattactttcagaagcaaaaattataaaagaaccatgagatttttaaagagaaaaaattacatttgatatgagataatcatgcattttaagatgtttaaaatgacatggagtggggtccccagaccaggagagctgagggcttatgaaggacctaagggagtgagacctgttatgtaataagcccccattctgggggcagcaccacagaggcgggaccccagaagtagaagaagagccctcctgcactgggtggtgaagttggtatcagcccctagtttgtgaccctggacagatttctctgctctccagccctcagagtcctcaataaaacaaaaacatatgcaaatatacaaaaaaacaaa

SEQ ID NO: 22637 - DNA, 2073 bp, Homo sapiens
gttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaagtcatctgagcacatccagcgcatcgaccgggacgtaagcgggacattaaggaagcatatattcttcagggatcgatacggaaccaagcagcgggaactactccacatcctcctggcatatgaggagtacaacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagaagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccggcccctcccagcacccccagccccacgaccatcgttctgaattctgacgacaccgtgagcctgcctttgtacttcaaactcatggaaggataaccaccttcatgttttgaaataaatgtttcctgttgaaatgaaaaaaaaaaa

SEQ ID NO: 22638 - DNA, 308 bp, Homo sapiens
ggtgggaggccttggggtttgggggcctctccagctgcccagctcttgcagctgatggctccacatcttgggggaaggctctgatttcatgatgggctgggggcttctcaggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcagggctcaccactgcgtattatatacg

SEQ ID NO: 22639 - DNA, 2443 bp, Homo sapiens
gttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaagtcatctgagcacatccagcgcatcgaccgggacgtaagcgggacattaaggaagcatatattcttcagggatcgatacggaaccaagcagcgggaactactccacatcctcctggcatatgaggagtacaacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagagtaagtctacgtgtgcccagcggggcctggggagccctggggtcagaccccgactggcccgagggcagcttcctcacactgtcctcatgatcctctgttctggcccagagggaggtctggccaggtgggctgggcaggacactgtgacaccgagcccatcccccacatgacccagatgaaagtcgagagtgtggtgagcacttccctgtccggatcgccccccagccacagtctcctgtgtatatctggacacctggggtggccacaaaaggatccggcaccgcccagtaggagactgaagtggccacggggtatgagctgtgaccattcccaggtaactcccctggcctgatatccaccctgtccctagagcgcctcacgaagacgtccaggtgtggcccgtgggcacgtttttgcaaccggttcgttgatacctgggccagggatgaggacactgtgctcaagcatcttagggcctctatgaagaaactaacaagaaagaagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccggcccctcccagcacccccagccccacgaccatcgttctgaattctgacgacaccgtgagcctgcctttgtacttcaaactcatggaaggataaccaccttcatgttttgaaataaatgtttcctgttgaaatgaaaaaaaaaaa

SEQ ID NO: 22640 - DNA, 1575 bp, Homo sapiens
actgcaggtcgactcatagtagcgatcccctgtatatccgggacgtaagcgggacattaaggaagcatatattcttcagggatcgatacggaaccaagcagcgggaactactccacatcctcctggcatatgaggagtacaacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagaagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccggcccctcccagcacccccagccccacgaccatcgttctgaattctgacgacaccgtgagcctgcctttgtacttcaaactcatggaaggataaccaccttcatgttttgaaataaatgtttcctgttgaaatgaaaaaaaaaaa

SEQ ID NO: 22641 - DNA, 2070 bp, Homo sapiens
gttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaagtcatctgagcacatccagcgcatcgaccgggacgtaagcgggacattaaggaagcatatattcttcagggatcgatacggaaccaagcagcgggaactactccacatcctcctggcatatgaggagtacaacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagagtaagtctacgtgtgcccagcggggcctggggagccctggggtcagaccccgactggcccgagggcagcttcctcacactgtcctcatgatcctctgttctggcccagagggaggtctggccaggtgggctgggcaggacactgtgacaccgagcccatcccccacatgacccagatgaaagtcgagagtgtggtgagcacttccctgtccggatcgccccccagccacagtctcctgtgtatatctggacacctggggtggccacaaaaggatccggcaccgcccagtaggagactgaagtggccacggggtatgagctgtgaccattcccaggtaactcccctggcctgatatccaccctgtccctagagcgcctcacgaagacgtccaggtgtggcccgtgggcacgtttttgcaaccggttcgttgatacctgggccagggatgaggacactgtgctcaagcatcttagggcctctatgaagaaactaacaagaaagaagggggacctgccacccccaggtgggctccagtgccatgtcccctcccatgtcaccctctggggtagtcagtagtaggggagtgcccgggacccgcaaccctactacctgggccttcctcttcaccttttcttcctcctcttcctcctggactctaagaaagtacaggaggcccaccggtcctcagggcaggcgctcagtgcgtgtatactggacatgctgtgcacgcaggagggggatgtgggcaagaccctccaacaagccccctcccactttccacggtgtctccctctccccctcgcagggccctccaagttactagacgagcccagacccatttgtgggagaccccgcccctccctgcaagcacccacagcctcagagagcagcagaggcccctcactcctgcacgctcctccaaggttgccaggacaagaagcctggagccagggagacaagggaatccgtgtccctgacccacagagcattcagggagagggcacaggcgggaccccgggcccagagccagagccaagagttcag

SEQ ID NO: 22642 - DNA, 978 bp, Homo sapiens
gttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaagtcatctgagcacatccagcgcatcgaccgggacgtaagcgggacattaaggaagcatatattcttcagggatcgatacggaaccaagcagcgggaactactccacatcctcctggcatatgaggagtacaacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcctgcgcgcaatgggtgtgtggtacgtgtatgctctcagcgcgt

SEQ ID NO: 22643 - DNA, 469 bp, Homo sapiens
gacaagaaagatctatgtgggcagtgttccccgttaggctgcctcatccggatattgattgacggggtaaggaggcatagggagaccctggctcagggaccttccttgccctgcagtgccctgcttccccagcccgggggtctggctcactcccagcccacaggaggctcaggcgggtccccaaaggacacacaagcaaaaccctctgcccaaggggggtcatcccagggccatggctggggctcaggcccagcctcatgggcagactgggccaggacccgacttgagagggctcagggaagcctcaagccctgggcaagcccctctctccaggagccacatccccactcaaatgagtgccccccatgaggagcttcaagaccttgtctgacccagcgtcctggagggctcaggcgaccctcatggggaaggtcactgactctggagactgaagccccagtgtgcgcag

SEQ ID NO: 22644 - DNA, 389 bp, Homo sapiens
acatgagtcctcccaggtgacctcagccctcccaggtgatgtccttccatggtgactctggctcttgcaggaggtgggctactgcagggacctgagccacatcgccgccttgttcctcctctatcttcctgaggaggatgcattctgggcactggtgcagctgctggccagtgagaggcactccctgcagggtaagtgaacagctgccccggggacctcctgcagccagacctggggatggccaccctggccaggtgatcacagctttcagccaaggcaccctccttgtgtcgccagcttgttgggagactttaggatgtctctgctgagggtcccacaggagtccacggctgacccccaaagcccaaatcagacgcctctcatcccca

SEQ ID NO: 22645 - DNA, 613 bp, Homo sapiens
ctgctcaacaggcgttattcctaaagtggcttcactgttcagactgaagagccacggtagccaaagtgatgagcggagtagaaccgagcagtcgggagagatcttgttccctgtaggaaactgggcatcgctgaggccctgagcatcccaggaggccgattgcacagagacctctggtcgctgaccccagtctgcctccacatccctggaatagcccatcatgggcccttcacccttggcaggtggaaaccattcaacctgctggggccggtgtgtccccatttcatggcattgggggacaacaggattctctgtctaggtcccactgtactcaagtccttgggaagatgcccacccctgcttgggacttgagactccagagactggagcagctgtgggccactgggtctggcccctttttccctgggggcggcggtggaatgggggttacgcagccagccagcatctgggagcccggcgagagcggttcaggtgttctccgaagccgccgcgtacagtgtgacctttagacaattctgtctcacaggatggacgtggtagaggtcgcgggcagttggtgggcacaagagcgagaggacatcattatgaaata

SEQ ID NO: 22646 - DNA, 1633 bp, Homo sapiens
tgcattagacctctcccagagaccctctctggagactgaagccccagtgtgcgcagctcgagccaccagccccagcctggaaggaccaggttctttcacacctgctgtccccacagatctctctcgggctcaccctgcgcctgtgggacgtgtatctggtagaaggcgaacaggcgttgatgccgataacaagaatcgcctttaaggttcagcagagtaagtctacgtgtgcccagcggggcctggggagccctggggtcagaccccgactggcccgagggcagcttcctcacactgtcctcatgatcctctgttctggcccagagggaggtctggccaggtgggctgggcaggacactgtgacaccgagcccatcccccacatgacccagatgaaagtcgagagtgtggtgagcacttccctgtccggatcgccccccagccacagtctcctgtgtatatctggacacctggggtggccacaaaaggatccggcaccgcccagtaggagactgaagtggccacggggtatgagctgtgaccattcccaggtaactcccctggcctgatatccaccctgtccctagagcgcctcacgaagacgtccaggtgtggcccgtgggcacgtttttgcaaccggttcgttgatacctgggccagggatgaggacactgtgctcaagcatcttagggcctctatgaagaaactaacaagaaagaagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccggcccctcccagcacccccagccccacgaccatcgttctgaattctgacgacaccgtgagcctgcctttgtacttcaaactcatggaaggataaccaccttcatgttttgaaataaatgtttcctgttgaaatgaaaaaaaaaaa

SEQ ID NO: 22647 - DNA, 1438 bp, Homo sapiens
aatcctcgggagccttaacctcaagcagcgggaactactccacatctccttggcatatgatggagtataacccgggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcagatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagaagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccggcccctcccagcacccccagccccacgaccatcgttctgaattctgacgacaccgtgagcctgcctttgtacttcaaactcatggaaggataaccaccttcatgttttgaaataaatgtttcctgttgaaatgaaaaaaaaaaa

SEQ ID NO: 22648 - DNA, 991 bp, Homo sapiens
gttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaagtcatctgagcacatccagcgcatcgaccgggacgtaagcgggacattaaggaagcatatattcttcagggatcgatacggaaccaagcagcgggaactactccacatcctcctggcatatgaggagtacaacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcagatctctctcgggctcaccctgcgcctgtgggacgtgtatctggtagaaggcgaacaggcgttgatgccgataacaagaatcgcctttaaggttcagcagaagcgcctcacgaagacgtcccgataagcagg

SEQ ID NO: 22649 - DNA, 541 bp, Homo sapiens
gagacttgtacagttttcctgatttaagagtgtagaagtcatttttccctggaacatgacaggcgtttccttagaagcaagtcacagcatgtttattcatcagagaccatgcgaacattggcagctgtctagaggaaacatggaaaagtctcaaagcaacatgactaatctaaaagatatttagtataatttttacatagaggaaacatgtagtgtattaattatttcattttgctcaaattaactttctcctttctgcaaatattactcccactgttgactttcatttcttttctttccccaggtttttcattgcttaaatattttcatatatcctgacatatattctcacattaggatgagtaaagaaatatatcggtagaaagatattgagcatacaagcaaggttcctaagtggagctgcaaaattatgtgaattgacgatgagacagctgtcaggataccgaaatgtattcagggattgcaaaatgagatagaattaaattggatttggaaatggattaggttaaggtactttaaa

SEQ ID NO: 22650 - DNA, 382 bp, Homo sapiens
acaggacttgaattcagaacttttgcctgattgcaaagctcaccttcctaatagctttgctctgttgcctgccttctgtgaacagtgcttttaaaaaagtaaagattgtcgggtgtgggtggctcacgcctgtaatcccagcactttgggaggccgaggtgggtggatcatctgaggtcaggagtttgagaccatcctggccaacatggtaaaaccccgtctctactaaaaatacaaaaaattagccaggtgtggtggcatctacctgtagtcccaggtactcgaggcaggagaattgcttgaacctgggagacggaggttgcagtgagctgagactacgccactgcattctagcctgaacgacagagtcagactctttctc

SEQ ID NO: 22651 - DNA, 501 bp, Homo sapiens
attttttattgctctggacatcactttgaggtcctggaatttacagatgagaaaaattaaacaatgaatgaggacagttttcttgtatgagggatttttgttttcttcatatttttaatgtgtttaatatactggagtgagcatgtcttattcttgttaacagacaagctatctaaaaattaaaacacaaactaaaagtagaggaagattgttatgagaaacatgtcatgtatgtgaaatacattttataaggaatagattagattctttatggaaccaggatgggtataaatacatcactagataaatattaagtaggaagatcattatggacaaagattgtttcttaggaattttgcatcgtatagcactgtgttagacagagtccttaactgattatttttgtagcatttgtttacacattcacttattaattaattttgccaatgtattgagccatctatggagatgtgtggaggtctgtgttgaaagcttgagata

SEQ ID NO: 22652 - DNA, 672 bp, Homo sapiens
attttaggtttgaattttctcaggagcagagtaatctgctttcggactggagagaagctcttgtcagggtggccagactcaggacatggcagcagctgtgaggggtttttaggtatggctgaatgttgccatatttcattttcttattttgggcttatagcaaaatgtctctatgaagccctaagaccagacacttgaccttctagaatggacaaggaatgtcaaaaggcctttctaaccattaagtaaaaattactaatggatctggctactgagaccccctgaactaagaaagccatttgatttgttcatacatgagagagaagggatgggtttaggagtagtaacccaagacttggggaatatcatgaggcctgtagcctacttttcaaaacagctggacattgttatgatgggttggacttcttatctctgaccactggcaccacttgtgatcttctccaggaggcagaagagttcactttgggttaacctagcactgtacacaccccacactgtgtatgctatttgttggaacagaagtggagctactgacttacctctagaagactgaataggtatcaggtcatcctcctggataatcctagtgttactttgagagctgtttctgctttaaatcctgctaaataaacctatacatgattgcatata

SEQ ID NO: 22653 - DNA, 336 bp, Homo sapiens
attcccatcagtaatgtacaagggttccgtttccctcacaatcttgccaatactcgctcttttcgtttcttttcttttttggttaatagttttgtaatgtatgtgcaaagtggtgtattgttgtggttttaatttgcatttccttaatggttagtgatattggacatttacttgccatttttatagcttctttggagaaggtctttaattgtgcagacagaaaattacaacctgggataaatgctctgggaacacagcaagcatcacctaagtcaacctggagagtcaggaaaagtctctagagaagtacttgttggaactcttttatctgtgtct

SEQ ID NO: 22654 - DNA, 430 bp, Homo sapiens
gtattaaaattattgtttttatttttatcatatgttttaattgatcttagtcactttcccttttcagtctgttagtgtcttttttttattcctaactcccctaacctaggttgataccagtctctgtactgtccaaccagggatacttttctgggtctctttggctgcaaattcatacgaattctaaattctgagtgcagatgttagagttccttcctacactccatagcacagatggaaaagaggatggagattggggaaagtaccagaacttgaatcaggtctttcccaacaccaacactcatcttaaagagcatggctattgtaagagagttatctattggaagttgtggaatttactgataggaaaatgttggacatatattgtaaagtttctttttttttgtcaaaagtataaggctttccttgc

SEQ ID NO: 22655 - DNA, 444 bp, Homo sapiens
tgacgttccctcggaaagcagggctgaaggcatcctcagagaatgccccgatgcccagggatctgggacggccatggcttcacctgcacaggcacccctggcccaatcctcacagctgccactcccacactgctcccgatggaaattccagagctttacagaatcccctgttttatgaaaaggggtagacgtggcagctcaccccaggttgcacagcctcatggccagccggggtttgaaccctggaccacctgcttcccccacacccaggggctttccagggggtgcctggagggggagggaagccgatgtttggtgggtgagcctccctgagtccatccgttttttgtttgtttgtttacttgcttgtttgtttttgagacagtttcacagtttcattcttgttgcactccagccagggcgacagagggagactctatctca

SEQ ID NO: 22656 - DNA, 983 bp, Homo sapiens
ccactcgagcagctgagagccctcttaaagggcaagtgacatcgagacctgctctcggaactgtctgcaggaagactggtgttagactaggattgaagatgaagcacatcttgaagtttactgatctctgccatcggatgctgggtgaggtacagctcattcatgccttccttggctcatgcttaaaacccatcacactcctatcctcccatagttctgcacgtttctcatccactcgggcagctaagagccctcttaaagggcaagcgaccctgacacctgctttaggaactgtttgcaggagtcagtgcaggccagctccacatcctgaaggggatgccatccgggtacgaacagctcagaggctgaatggccctatcacccgggaggagcctggagggtattccatctaatcctgtggctaagcggggtggatgagggaacacacggacttgttcgagaatttgcccagcagcacgaaactacttagaagcagaaaactggggcaggacctggcgtgggagttagggagccctccactgccttctcagggatccacatgtgctcctctgtgcaggaactttcaacagcgcctcaagatagagtcacagagaacgatggcaaattccatagcactcactttttctttcctgagaaataaacagatttgggagctcagtacatcagtaatataaaagacagtgggttcagaaaaaaaaaaaggaaaaaaatgcacaaattacaaaaaaatatgtataaagagcttcataccttttttcgtttttggttacctgtaacgttttagaattcaagaaggtttccaatgaggaaagacggaattattcagaaacagcgttcacctgatacggagaacagctccccagcgggaagtcatcatgtctcatctgacagtctagcgagctgcgtggcccctggtcactcactcactcaccctcatgggtggtctctgtgcactcatttat

SEQ ID NO: 22657 - DNA, 321 bp, Homo sapiens
ggcttttaccatgttgaccaggatggtcttgatctcctgacctcgtgatccgtccgccttggcctcccaaagtgctgggattacaggtgggagccatcacacctggccatattttaatttttctagtttggtcagaatctttctcttaacctctgggaaacagatgtattccttaactggctgtagaaagtcacatatcagcatttttattggtggagctgattctgagtcagtacctcatgctgtttaagagcagccacggccaggccagcagcagctgaaaggcatgggggctggctgtgatggcccagtcatcaggga

SEQ ID NO: 22658 - DNA, 1393 bp, Homo sapiens
gccaggcatgagcgacctgctgcagtttgtggcaaaacagggcgcctgcttcgaggtgattctcatctccgatgccaacacctttggcgtggagagctcgctgcgcgccgccggccaccacagcctgttccgccgcatcctcagcaacccgtcggggccggatgcgcggggactgctggctctgcggccgttccacacacacagctgcgcgcgctgccccgccaacatgtgcaagcacaaggtgctcagcgactacctgcgcgagcgggcccacgacggcgtgcacttcgagcgcctcttctacgtgggcgacggcgccaacgacttctgccccatggggctgctggcgggcggcgacgtggccttcccgcgccgcggctaccccatgcaccgcctcattcaggaggcccagaaggccgagcccagctcgttccgcgccagcgtggtgccctgggaaacggctgcagatgtgcgcctccacctgcaacaggtgctgaagtcgtgctgagtctggccgcctgcaggggggtacccgggccaacggcggagggggcggggaagggagattcggcaaagacagctttactactcccttttccctttggctttgttatgtccctctgggaatttctggaatctcgtatttgggggcttggggaagggggctcagagccgtccctatctattcagttaacccacctcggctgcctcccccactccactgtgcacggttgagttctggagtctgacccatcgcggggtggcgcgcaaaccttggaaggcagcagtatttcctggtcctcccaactgggaggaaggggcccccccggcaggtgagagaaggaacatctcccgccgctgtaacttgttgcctcgggctgcgtgaccgcccctcctccagtctactgtggagggaacccaggatcctgaaattctcctggccgcaagaactccccacagaggcagaagagggtctccacctatggccccaggcctttgcgatcttgcttcacccaccgcgaccccacactatttctgtgctgtccacactctcttgcctcccgacccccgcactcccttctagcacccccaaaggaaaagccagaggaacaatcgcctcctggtggtggtacgaggtagcgcaccgtccggctcgggtccggacagccagtaacctcgcagagagtgacggtgtctccttgcatcccagcctcgtctatgcagcaagagaccagggacttcaccaaagtcaccctcgcgggctgggccttccacgcatcccccccaccccccatggaacagaaagccatgtttttaagcagaaccagcgaaacccaagcccctccttcctctggtgttttacaactataaaggaggtgaagggggaagaaat

SEQ ID NO: 22659 - DNA, 1583 bp, Homo sapiens
ctgtggttgcgctgggatatgctgctgtcccatgctggagaatcaacttactggaggtgcccccccgccaagccacaggagcagagagctgtcacggtggggaatgctgctgggacccgtgcaggacgaaaggagacagaagaaaaaggccatcttcctcctctagccttgttagccccttcagagcccactgtgggtcaggctggcaaagggtaaaggagttttcagagccccctcttcagtgtgacaaggaagggcaaggtcagggaaatttggagttaagaggcaataaatgagtacctggcacacctagtcgaggtgtgtccactttctccatagcatggttactgtttttttcttttcaactaataagaaatctctggagacacactgtctccatgtacataccctgttcctcatgagactcttccccattccccgaccaggttcagcaaatgttgctgattctggcctgattcaatctttatgatgactgccaagcgacgtttctgcagcccagcactccttcctcatttgccagtcatccctcccttctccttcatttattttcatatatccactatggattcccattttttcaaaagtcgacttcatcattgacctttggggatgggggaagagttcctcagatagttcccgacttgggcagcgagagccccttcgagtgcctcctatatcccagcatttttggaagcactcccctaatttctgatctaacaagatgttccgggcccctgggcaccagccatggatcagtgtttgtcccaggagccctggtccctggcactaggtgtgcttattgcagctggggtgtctttgcttcttgtcctatagatgattgacagagcttgtcttactgccttttttaagtgtatttttttaaacaaaagtaattggtgctttaaaaaatgtgaacaatacagacatctgtaaagaagtacccacagggaagcaagttcagcagttcagcaatggcatgtgtctttgcagactacatacacagaaacagacttggtattgggttttggtttttgctttttgctaataggaattttatcctacaagatcctctttctgtcttcacaacatagtctgatgctccttccatgtctaactgtaggatttgtcattccattgtgttagctgtgtgggtacattagtaccatgattaaccaaggtgtataaagggcaggcctgcaggctgcctccagtgcctccactactcgccacagtgatcatctctatacacacactgcagtcatttacaatttttaaaatgaaaacaatttttattgagatgcaattcacatggcataaaattaacgattttaaagtaaagaagttgccttgagtacattcaccatgctatagaaccactgcctgtatctagtttcaaagcactttcatcaccctgtgtcatgtatttttacatgaactccaagggtggattcttgttagttggatttactctggatggaaaagtcatgtttggctgggtgcagtggctcatgcctgtaatcatagcactttgggaggtcgagacaggtgggtcacttgagatc

SEQ ID NO: 22660 - DNA, 1356 bp, Homo sapiens
ctgtggttgcgctgggatatgctgctgtcccatgctggagaatcaacttactggaggtgcccccccgccaagccacaggagcagagagctgtcacggtggggaatgctgctgggacccgtgcaggacgaaaggagacagaagaaaaaggccatcttcctcctctagccttgttagccccttcagagcccactgtgggtcaggctggcaaagggtaaaggagttttcagagccccctcttcagtgtgacaaggaagggcaaggtcagggaaatttggagttaagaggcaataaatgagtacctggcacacctagtcgaggtgtgtccactttctccatagcatggttactgtttttttcttttcaactaataagaaatctctggagacacactgtctccatgtacataccctgttcctcatgagactcttccccattccccgaccaggttcagcaaatgttgctgattctggcctgattcaatctttatgatgactgccaagcgacgtttctgcagcccagcactccttcctcatttgccagtcatccctcccttctccttcatttattttcatatatccactatggattcccattttttcaaaagtcgacttcatcattgacctttggggatgggggaagagttcctcagatagttcccgacttgggcagcgagagccccttcgagtgcctcctatatcccagcatttttggaagcactcccctaatttctgatctaacaagatgttccgggcccctgggcaccagccatggatcagtgtttgtcccaggagccctggtccctggcactaggtgtgcttattgcagctggggtgtctttgcttcttgtcctatagatgattgacagagcttgtcttactgccttttttaagtgtatttttttaaacaaaagtaattggtgctttaaaaaatgtgaacaatacagacatctgtaaagaagtacccacagggaagcaagttcagcagttcagcaatggcatgtgtctttgcagactacatacacagaaacagacttggtattgggttttggtttttgctttttgctaataggaattttatcctacaagatcctctttctgtcttcacaacatagtctgatgctccttccatgtctaactgtaggatttgtcattccattgtgttagctgtgtgggtacattagtaccatgattaaccaaggtgtataaagggcaggcctgcaggctgcctccagtgcctccactactcgccacagtgatcatctctatacacacactgcagtcatttacaatttttaaaatgaaaacaatttttattgagatgcaattcacatggcataaaattaacgattttaaagt

SEQ ID NO: 22661 - DNA, 1714 bp, Homo sapiens
gaaatgggatttcaccatgttggccagggtggtcttgaactcctcacctcaagtgatctggctgcttcggccaccctaagtgctgggattacaggcataagctactgtgcccagccaggagaatgaattttaaaaatctatgttagtgtttaaaatgagtgctttgttttaaagcagcaatttagtagcattattaaaatgcttacttcactatagtagcaattaggtaaagatgggcaatatcaaaatgggctaaacttattttccactatgttccacacctttgaaataggaattcctaacttgagaatcatgaacccttagggaatcctttataattgtgtataagaagttctagtttacatgcatttttcttggggaaagtgcatagtttagatcagcttctcgaagtggcaaaagtatgggagttagggttaggaaccaccaggattgaataatcctggaatattatataattttctacttttgattttgctgtggtatatttctgaaaatgtgctgtggctcctaactagtaaaatgggctggtgagggactctggaattctgaatttctaagtttataacctaaaatgaaactgtaaagtcctcggtatttagaaaaatgcttaatctcagatttacagatggcctcatgataacttagattcgttaacagggtcaaactttagttcaacaaatttcaacccaatattatcacagtacaatagcttagaatgatcattagaaatggtagaaaatagaataaatcattaaagatcccaaaatgttgagttctgtagcatgaaaactctcttgctcctccatgtttgtagttcaggccagaacaaactaaacagaccaataaatataaaagtgatagtttagggaaaaaaaaaaactttgtataaataaaattgtatgtgtgttcaaataactacctattaaatcatccaaagcttagaatttaaattggtcatagtagcaaatagtgcagatgatggaagaaaaccagtctcaataatggttttttttttccaattgcataaggtcacgtcatcccccaaattgtctattttttcttttctttttttttaagatggagtctcgctccgtcacccaggctggaatgcagtggcgcaatctgggctcattggcaacctccacctcccaggtgcaagcgattctcctacctcagcctcccaagtagctgggactacaggcgcccgccaccatgtgggcctggctaatttttgtagagatggggtttcaacatgttggccaggctggtctcaaactcctgacctccagtgatgcacccgcctcggcctcccaaagttctgggattacaggcgtgagccaccgtgcccagcccctattttttctgaaataatttttcggatatacttttatatttgaaattagttgaacataagatgatcatcaagcttgctataagttttaagctattgctacatttgaacaaagacccacgtacttatcttagaaagtacttaggatatctttgagattaatggtgctacatcactctacagtactatgtaaaatgaatggagctgctgttcctttctagctagctgtttgtgtagttcatattaatttaccctgccttttatttggattgtctgatttcttagttgtacacatgaacctcattatttgcctggaataagtaatcaaataaaattgctttg

SEQ ID NO: 22662 - DNA, 520 bp, Homo sapiens
gcagcagtgattcggtcaggatgtcttttaccagacactaaagcatatggagatagaatagaaagaatgccttgcctcagtttgaacacatcctgatgcaaaggtggaagaacccgacgaagaacctgaggagacagcagaagacaaagagcaagacaaagacaaagaaatggatgtgggaacagatgaagaaaaacaagaaacagcaaaggaatctacagctgaaaaagatgaattgtaaattatactctcatcgtttggatcctgtgtggagagggaatgtgaaatgtaagtcatttcttttggcagagacttgttttggatgccccccaccagtccccttctcccctgcactgtaaaatgtgggattatgggttacaagaagaagtgggttttttagttgattttttttaaacatacctcatgaatgtaaatttgtactatttaactgactattcttgatgtaaaatcttgtcatgtataaaaataaaaaagatttcctccccaccaaaagttaaac

SEQ ID NO: 22663 - DNA, 1400 bp, Homo sapiens
cgttcaggttttctgaatagctgaaatatcaacatgtttatctcttcccttgccttagtatatcctagagcagtgttttccccggctttatctttattccttcatttaatgaactccgtgttttcatcactcacattttgttcccttccctcagtttccttcctttgccttcatttatgtatttagtttacagaataacaaaagcactcgtgttacttttaaacaaggtaaaacttaaacagttttttcctccgtttctttttttatggaaataagaggcaagtgatagcaagtgggtaattcaatggcagtggtaactgaagcactgacctgttacaagagagacggaagcttctacttgagcagatacaaatactgtcatccgtggagatttgaaagaagtctttctatcactgggtagtttgagagctcattagtcttctttagaatgggtttaaacttggaaacatcaaagcaagttacaaggaaacttagttttacagtgttggcagcctaggcgccagaatttgttataaagtgtctgaaagtggcacaggtatcacttaacttttcttcaagaaggtctatgagttacattttactcggtatcccaggcatcaaggagtgtaactttcaatgaatcaaagagaaacagaatcattttaaattccagcctctgtttaaagaaggatcttatgaaggggagaaattaaccacctgacccagggaaggatcccgcctcctccagaaagtgaaatcgccgggtgtggtggctcacgcctgtaatcccagcactttgggaggtcgaggtaggtggatcacgtgaggtcaggacttcaagaccagcctggcgaacatggtgaaaccccatctctactaaaatgcaaaaaattagccgggcacggtggtgcacccctgtaatcccagctactggggaggctgaggcaggataatcactcaaacctggaaggtggaggttgcagtcagctgagatcacgccactgcactccagcctggacgacagagtaaggctccgtctcaaaaaaaaaaaaaaaagaaaaagaaaaggagttaaatctttgcatatatttaactggcaagagcatccttacatcagtgcatgggaagttttatccaagtagcagtttccctgggattataaaaatccccgaggcatttgtcttggtgttgtgcctttttttggttgtgttttttcacgtccctcccctcccctttctccataaacaagagaggcattaacttggaatgtccgtggaaagtcttagaagctgattggtgtaatttgcctgccttccctttagtttgaacagcgtttactctggaagaggtcagtggcctttttcttggttgtgatttatgcaagtgttatctgaaggcga

SEQ ID NO: 22664 - DNA, 104 bp, Homo sapiens
acagggccagatagtaaatatttcaatctttgctggccacacggtctctgttgtaattactcagctctgtgagtgcatgtggaagcagccataggcaatacaca

SEQ ID NO: 22665 - DNA, 400 bp, Homo sapiens
aattttgaataccagatagtacgagtacttttgtttcaaccttctgggaaagaatttttccactaaagccaatacaggaggaacctaaagaatgcttttagagtaccatagtgggtccgggtgcagtggctcacacctgtaatccctgcgctttgggaggacaaggcaggtagatcacctgaggtcaggagtttgagactagcctggccaacatgatgaaaccccgtctctactaaaaatacaaaaagaattagccaggcgtggtggggggtgcctgtaatcccacctactcaggaggctgaggcaggagaatcgcttgaacccaggaggtggaggttgcagtgtgccgagatcgcgacactgcactccagcctgggcaacggagtgaaattctgtctca

SEQ ID NO: 22666 - DNA, 464 bp, Homo sapiens
tgggcaaatgactgaaactccttgatgcttattttctttatcttaaaaacataaaaaataaatgaggataagatgatggatgacccatccatagggttgttttaacgctgggatgcagtgatgtgtgtgcaagctcctggcacagcaacttaataccagtctcctctgtcctgtcttgcatctgctgaggatgaagaaggagagcagttgagtgtggccctgcctggctgggggcccttcctctatagttatcttctttataagccatttatagtcttggtataattttaaggaaaaaaaatcaaggcgctactttgcatttaaaattcatttttgaaacatactggcagcaaacgccacactattgcagttagggaagacaggagagcaaatgtcaggtcttggcaaagtggggtggggaattttttgagtgtgacatttgaataaagaaatctaaactagga

SEQ ID NO: 22667 - DNA, 426 bp, Homo sapiens
ttgtgggcaacccagggacaaaataaagtacagtactcatacttactttgttaatcatttctttcttcattctctccacatatacaaccttttttctgacttattaaaatctctagcttctctgttattaaaattgcaggcagtcagcacacttatgaagtattcaatgtgcacaaaaccagtagttccaaacctcgactttagctaaacaaaagaactggggttatttttaaaagactcctgacaatgaccctcactctcctcccattactgtgagccccgtgagaacaaagagtcagtatcatgcatttctcagcatctagccctgcgcttggcattttggctaacacatatctgtggagtgaattaagatgatggcaaatacagttacttaaaggaaggtgagtcaatcaggaggatgtaggt

SEQ ID NO: 22668 - DNA, 716 bp, Homo sapiens
ttcttcatccaaatgtctcctgcctttcaaaactgtggcctcgagggatctgttccagtagatatctatgaacttggcagtggagacagtcaaagatcaagtcattcttctgaaaaggctattccatccagagtcacaggaaatgggagaggacagaatttgccagagaatctaaacagtacagcacctcccgaggggcaaacacggtggagggccattcagatatacacgaagccatcttgacgtggttgtttaaagagataatcgcaagccacatgacccaatgttaaaacagtttctaaaggcacttggccagagagctaggaagccatcctatgacaattaaattagtgaacagataaggctgtttattcttctcatgggcaagagaaaaaaaagggggggcacgttgtaattcagggcacagtcaacacaggactcatcttcaaggtgttcaggataaagtttggaaagctctcaaatactccaggctagataaagtttggaaagctctcaaatactccaggctggataaagtttgaaaagctttcaaatactccaggctggaagagagagtaggaacagcagctgctgtcttctctgggaaaatcagatccctaaggagaagcctggagcaacaggaagcttccagggcctgtgagacaggaagaggggaggccgctccagctgcctggatgaggggaacagtgagctcc

SEQ ID NO: 22669 - DNA, 447 bp, Homo sapiens
gaatcttctcacctttcattagactctaagttccttggagagtcagtactcacggggagtacttttaggatcaacacttgtggacgggagaagatggaagcaggactgggtagaagaagaagctgggctgcaatgaagtcccattgaagacctcagctgaccttgcatggagcctgcatcccatccaggatacctgttacatttacttgtcatatctcctcaagcttctcttggctatgacagttttttagactttccttgattttgatgaccttgacagttttgaggagttctgggcccgatgttgcagaatgcctccttattgaaatttgtctgatgttttcctcatgattagattggggttgtgagttttggggggaaggtaatagaggaaaagtgtcatcttcatcacatcatattaaaggtacatattagtgacatgattta

SEQ ID NO: 22670 - DNA, 507 bp, Homo sapiens
agaaagatcctaagacaaggtaccgcttttcgaagtgtcatagttttcacagtacaatggcctcttagctgggatgtgaaggatacacaggaattcatgaagtcttctttagtaaagaaagcttaggctgggcacagtggctcattcctgtaatcccagctctctgggaggccaaggcaggaggatcgcttgaagccaggagttcaagaccagcttggacaacatagcaagaccccatctctataaaaaaaataagctggtgcttactgccagtcccatggtgggtctcaacctgggagggatggaggacatggtttctggtcctgctcacaacacccaaatacatggctcttagtgaccctgttagctccccacataacctcgagttggttttaggagcgaaaactaaatttggggcatggagtttggacacaagtgtgtcaggggcattttgggaaaactcattgtattaaaatccaaatttacaaaccagatccatttcggggg

SEQ ID NO: 22671 - DNA, 902 bp, Homo sapiens
  misc_feature (3)..(3): n is a, c, g, or t
  misc_feature (22)..(22): n is a, c, g, or t
  misc_feature (24)..(24): n is a, c, g, or t
tangctagtacgaggctgggtntnaatcggccgagcctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggagggcccacgcgcgcatccatctgcgggactatgtgatcgaagacgacgtcaacatggccatccgcgtgatgctgggagagcttcatagacacacagaagttcagcgtcatgcgca

SEQ ID NO: 22672 - DNA, 2187 bp, Homo sapiens
  misc_feature (3)..(3): n is a, c, g, or t
  misc_feature (22)..(22): n is a, c, g, or t
  misc_feature (24)..(24): n is a, c, g, or t
tangctagtacgaggctgggtntnaatcggccgagtctggatgatgaggacgtagaggagctgacggccagtcagagggaggcagcagagcgggccatgcggcagcgtgaccgggaggctggccggggcctgggccgcatgcgccgtgggctcctgtatgacagcgatgaggaggacgaggagcgccctgcccgcaagcgccgccaggtggagcgggccacggaggacggcgaggaggacgaggagatgattgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggagaccatctatcagaactaccagcgtatccgaatccaggagagtccaggcaaagtggcggctggccggctgccccgctccaaggacgccattctcctcgcagatctggtggacagctgcaagccaggagacgagatagagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaagatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggagggcccacgcgcgcatccatctgcgggactatgtgatcgaagacgacgtcaacatggccatccgcgtgatgctgggagagcttcatagacacacagaagttcagcgtcatgcgca

SEQ ID NO: 22673 - DNA, 1820 bp, Homo sapiens
gtatctaagatccgcagttagggctacccaagagcgcatcagcgaatgtgcaagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggagaccatctatcagaactaccagcgtatccgaatccaggagagtccaggcaaagtggcggctggccggctgccccgctccaaggacgccattctcctcgcagatctggtggacagctgcaagccaggagacgagatagagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaagatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggagggcccacgcgcgcatccatctgcgggactatgtgatcgaagacgacgtcaacatggccatccgcgtgatgctgggagagcttcatagacacacagaagttcagcgtcatgcgca

SEQ ID NO: 22674 - DNA, 1191 bp, Homo sapiens
tacggctaggtacgaggctgggtgtgtgctcacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaagatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggagggcccacgcgcgcatccatctgcgggactatgtgatcgaagacgacgtcaacatggccatccgcgtgatgctgggagagcttcatagacacacagaagttcagcgtcatgcgca

SEQ ID NO: 22675 - DNA, 1299 bp, Homo sapiens
ctcttggtctgtgatcttgggaaaggcctttctgaaatatgtcaagattaggggttcagatgaaggttcttctaaactccaaagttctgtgactcttgggaagagccaactaatgaaaagctttagagtcgggcacggcttgataccagggcctgatgcagttgcagcagctgtggaagtgggtgtctttgagctggggatgtcgtggttccctgatgccagagcatgtgggtgacctactctgtgagtatctgttcccattcttgtcggtctccctccctttctcagatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggagggcccacgcgcgcatccatctgcgggactatgtgatcgaagacgacgtcaacatggccatccgcgtgatgctgggagagcttcatagacacacagaagttcagcgtcatgcgca

SEQ ID NO: 22676 - DNA, 2563 bp, Homo sapiens
tggacgccgacgtcatgacgtcgcgttccgtagggctcttcccgggctttggtgggtcacgtgaaccacttttcgcgcgaaacctggttgttgctgtagtggcggagaggatcgtggtactgctatggcggaatcatcggaatccttcaccatggcatccagcccggcccagcgtcggcgaggcaatgatcctctcacctccagccctggccgaagctcccggcgtactgatgccctcacctccagccctggccgtgaccttccaccatttgaggatgagtccgaggggctcctaggcacagaggggcccctggaggaagaagaggatggagaggagctcattggagatggcatggaaagggactaccgcgccatcccagagctggacgcctatgaggccgagggactggctctggatgatgaggacgtagaggagctgacggccagtcagagggaggcagcagagcgggccatgcggcagcgtgaccgggaggctggccggggcctgggccgcatgcgccgtgggctcctgtatgacagcgatgaggaggacgaggagcgccctgcccgcaagcgccgccaggtggagcgggccacggaggacggcgaggaggacgaggagatgattgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggagaccatctatcagaactaccagcgtatccgaatccaggagagtccaggcaaagtggcggctggccggctgccccgctccaaggacgccattctcctcgcagatctggtggacagctgcaagccaggagacgagatagagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaagatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggagggcccacgcgcgcatccatctgcgggactatgtgatcgaagacgacgtcaacatggccatccgcgtgatgctgggagagcttcatagacacacagaagttcagcgtcatgcgca

SEQ ID NO: 22677 - DNA, 2498 bp, Homo sapiens
tggacgccgacgtcatgacgtcgcgttccgtagggctcttcccgggctttggtgggtcacgtgaaccacttttcgcgcgaaacctggttgttgctgtagtggcggagaggatcgtggtactgctatggcggaatcatcggaatccttcaccatggcatccagcccggcccagcgtcggcgaggcaatgatcctctcacctccagccctggccgaagctcccggcgtactgatgccctcacctccagccctggccgtgaccttccaccatttgaggatgagtccgaggggctcctaggcacagaggggcccctggaggaagaagaggatggagaggagctcattggagatggcatggaaagggactaccgcgccatcccagagctggacgcctatgaggccgagggactggctctggatgatgaggacgtagaggagctgacggccagtcagagggaggcagcagagcgggccatgcggcagcgtgaccgggaggctggccggggcctgggccgcatgcgccgtgggctcctgtatgacagcgatgaggaggacgaggagcgccctgcccgcaagcgccgccaggtggagcgggccacggaggacggcgaggaggacgaggagatgattgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggagaccatctatcagaactaccagcgtatccgaatccaggagagtccaggcaaagtggcggctggccggctgccccgctccaaggacgccattctcctcgcagatctggtggacagctgcaagccaggagacgagatagagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaagatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggtatagctcacatgtgcccggtttccatgaactgtggtttggggacctcaggtgaggcttggggtcatacagtgtgcccaacacaggggacaggtgctgcaggggccataggctgttttctagtcctgttccctcggtctcttctcatgtccagaagtcgccctgatttctctttccttcacagcacccccgacccccaccctacataacccacaatccaccaaatcctgttgtcccaactcctgagcctacccacctccctcacttctgcctctgacttgaggcactaccatcatctgaactggcctcctggcacccatgtagactgtcttccagttgaaggcataaatcagatcagccc

SEQ ID NO: 22678 - DNA, 1106 bp, Homo sapiens
ccaaattaggctaggtagaggcctggtgtgaatcggccgatgaagatgtgaagatgatcactagcctctccaaggatcagcagatcggagagaagatctttgccagcattgctccttccatctatggtcatgaagacatcaagagaggcctggctctggccctgttcggaggggagcccaaaaacccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggagggcccacgcgcgcatccatctgcgggactatgtgatcgaagacgacgtcaacatggccatccgcgtgatgctgggagagcttcatagacacacagaagttcagcgtcatgcgca

SEQ ID NO: 22679 - DNA, 872 bp, Homo sapiens
ggtgggactcccccacctactatacccccagatgaaactttggggggagagtgcccagaccagccttgtccactagtgacaaggaggaggcatctgatgtggagatctccttggaaagtgactctgatgacagcgtggtgatcgtgcccgaggggcttcccggtgggactgaccgaggagtgtctcgcattgatgaatttgacaagatgaatgaccaggacagaaccagcatccatgaggccatggagcaacagagcatctccatctcgaaggctggcatcgtcacctccctgcaggctcgctgcacggtcattgctgccgccaaccccataggagggcgctacgacccctcgctgactttctctgagaacgtggacctcacagagcccatcatctcacgctttgacatcctgtgtgtggtgagggacaccgtggacccagtccaggacgagatgctggcccgcttcgtggtgggcagccacgtcagacaccaccccagcaacaaggaggaggaggggctggccaatggcagcgctgctgagcccgccatgcccaacacgtatggcgtggagcccctgccccaggaggtcctgaagaagtacatcatctacgccaaggagagggtccacccgaagctcaaccagatggaccaggacaaggtggccaagatgtacagtgacctgaggaaagaatctatggcgacaggcagcatccccattacggtgcggcacatcgagtccatgatccgcatggcggagggcccacgcgcgcatccatctgcgggactatgtgatcgaagacgacgtcaacatggccatccgcgtgatgctgggagagcttcatagacacacagaagttcagcgtcatgcgca

SEQ ID NO: 22680 - DNA, 285 bp, Homo sapiens
cagcctgtctaagcagaggaaaacggagcaggcagagccggcctgatctcggaataaaggctgcatgcgacaaacactgagggaccctaaaagtctcgaccatagggcctcttctggccatctccgtggtcgtgtcccgctggaggaggaggcgattagagactgtgaggtgaagatgcgggacccaaaccacatttcaccagactgtatcctcacccccatctgaccttactgctgctcacactctccgtcccagaatgaaatccccagaagatggaagagtgc

SEQ ID NO: 22681 - DNA, 346 bp, Homo sapiens
aagaatattgaatcattctgtggttgcaataaaatttaaatcttttaagattcacattttatatttgaatagtgcttttggaaatcaccaattttactggatatttggaataggaagggtagccaatttaatttattgggcaacatttaggttattagctgtatatgaaattttcaatgtgtacatatcttagatgatgagctttttaagacacctaacagaattaagaaacagcccattctcattgtgaatttgacaccaattctactttggtggtattagttggtattctgaaattatcataccgaattacctacctctaattcattaccctaccagtggtaga

SEQ ID NO: 22682 - DNA, 276 bp, Homo sapiens
gttattgtgattaattgtatatagtgccctctattataataataagaaaaatagtttctcaaattggttcagtatacatttttggctaatttatattcatatttcttctattgcagctattgctttttctttatagttggatagatttttttaacatgtaaatatttaatacctttgattttacttttatttacctcaaagaactgagactggagtaaaaagacaagaggttacagatagaatacttttattagacagtcaaactaggttaggagg

SEQ ID NO: 22683 - DNA, 968 bp, Homo sapiens
ggaattgggaagaaggataaatacatacatggaggagcaatagaagtctaccttatggagcatgtggaaatatcaggtggcttcttcatatgatttttaagtatctcgatgatgatgaagaacaaagacatcaatcaggattcaggaagacagcttttgcggaaaatgcttaaagggaagcatcaaggattggtgttgatatttgaaagtttaagagtggtatacttttattcagtcaacacatgacaaatgtaaaaggcactcatttgttgttcctggaagaagcctggcagcattccattcagacatctgccctttcatcgtcccactttttacttattgcagtcctttcagtctgaatatttcctcctgacgcatcttctgccgtccgaaatgactccctgctcccagatcctgtagcccttattattgacacctttcatttagaaatttagcacatgtcacattacaccattattgaataaataatgaataaataaataaataaagatgtatgtccttcccaagtatatcagagaactatctggacaatttctttctttcccaattctcagaatcagcagtattctgtcaagaaacatttatcgacgatgatggcaatagtcgattaaaatcagatgaagttttatttttaaaaaaaggttgagcggagagacaaggctgaaggtttggaagttgagacaaccatcttcaataaacgttttctcatctaagggctgtatgtacatcattttggggaaggtagagattgaaggaggaagaacatcactggaggaagagacagcagtttgtctttcgagtttcaataaagtttcaaaaatcttgcctaagttatatatttttttggcctttcccttttgatgtgacaataaactgtaatgcggctgtcgtttgtacgaaccgatattcagcagaataaatctgagcactttcagaaaaagaagcgt

SEQ ID NO: 22684 - DNA, 1029 bp, Homo sapiens
atagctgccgctaatggagttggactcatgagtgagggagaaagtgcctgtgaatgacatcattatgcgacatcataggacagttttttttttcttttattcactcgtctttcttttatttcaactgatgatatcaggtggcttcttcatatgatttttaagtatctcgatgatgatgaagaacaaagacatcaatcaggattcaggaagacagcttttgcggaaaatgcttaaagggaagcatcaaggattggtgttgatatttgaaagtttaagagtggtatacttttattcagtcaacacatgacaaatgtaaaaggcactcatttgttgttcctggaagaagcctggcagcattccattcagacatctgccctttcatcgtcccactttttacttattgcagtcctttcagtctgaatatttcctcctgacgcatcttctgccgtccgaaatgactccctgctcccagatcctgtagcccttattattgacacctttcatttagaaatttagcacatgtcacattacaccattattgaataaataatgaataaataaataaataaagatgtatgtccttcccaagtatatcagagaactatctggacaatttctttctttcccaattctcagaatcagcagtattctgtcaagaaacatttatcgacgatgatggcaatagtcgattaaaatcagatgaagttttatttttaaaaaaaggttgagcggagagacaaggctgaaggtttggaagttgagacaaccatcttcaataaacgttttctcatctaagggctgtatgtacatcattttggggaaggtagagattgaaggaggaagaacatcactggaggaagagacagcagtttgtctttcgagtttcaataaagtttcaaaaatcttgcctaagttatatatttttttggcctttcccttttgatgtgacaataaactgtaatgcggctgtcgtttgtacgaaccgatattcagcagaataaatctgagcactttcagaaaaagaagcgt

SEQ ID NO: 22685 - DNA, 956 bp, Homo sapiens
  misc_feature (56)..(56): n is a, c, g, or t
gttttatagtgtattaacacttaccacgtaacttacaagttaagaagctgatatanaatatcaggtggcttcttcatatgatttttaagtatctcgatgatgatgaagaacaaagacatcaatcaggattcaggaagacagcttttgcggaaaatgcttaaagggaagcatcaaggattggtgttgatatttgaaagtttaagagtggtatacttttattcagtcaacacatgacaaatgtaaaaggcactcatttgttgttcctggaagaagcctggcagcattccattcagacatctgccctttcatcgtcccactttttacttattgcagtcctttcagtctgaatatttcctcctgacgcatcttctgccgtccgaaatgactccctgctcccagatcctgtagcccttattattgacacctttcatttagaaatttagcacatgtcacattacaccattattgaataaataatgaataaataaataaataaagatgtatgtccttcccaagtatatcagagaactatctggacaatttctttctttcccaattctcagaatcagcagtattctgtcaagaaacatttatcgacgatgatggcaatagtcgattaaaatcagatgaagttttatttttaaaaaaaggttgagcggagagacaaggctgaaggtttggaagttgagacaaccatcttcaataaacgttttctcatctaagggctgtatgtacatcattttggggaaggtagagattgaaggaggaagaacatcactggaggaagagacagcagtttgtctttcgagtttcaataaagtttcaaaaatcttgcctaagttatatatttttttggcctttcccttttgatgtgacaataaactgtaatgcggctgtcgtttgtacgaaccgatattcagcagaataaatctgagcactttcagaaaaagaagcgt

SEQ ID NO: 22686 - DNA, 590 bp, Homo sapiens
atagctgccgctaatggagttggactcatgagtgagggagaaagtgcctgtgaatgacatcattatgcgacatcataggacagttttttttttcttttattcactcgtctttcttttatttcaactgatgatatcaggtggcttcttcatatgatttttaagtatctcgatgatgatgaagaacaaagacatcaatcaggattcaggaagacagcttttgcggaaaatgcttaaagggaagcatcaaggattggtgttgatatttgaaagtttaagagtggtatacttttattcagtcaacacatgacaaatgtaaaaggcactcatttgttgttcctggaagaagcctggcagcattccattcagacatctgccctttcatcgtcccactttttacttattgcagtcctttcagtctgaatatttcctcctgacgcatcttctgccgtccgaaatgactccctgctcccagatcctgtagcccttattattgacacctttcatttagaaatttagcacatgtcacattacaccattattgaataaataatgaataaataaataaataaagatgtatgtccttcccaagt

SEQ ID NO: 22687 - DNA, 1052 bp, Homo sapiens
tattccgtgatattgaataagtctcacaagatctggtgggtttatcaggggtttctgcttttgcttcttcctcagtttctcttgctgccgccgtgtaagaaggaccttttgcctcccaccatgattctaaggcctccccagccacgtggaactatatcaggtggcttcttcatatgatttttaagtatctcgatgatgatgaagaacaaagacatcaatcaggattcaggaagacagcttttgcggaaaatgcttaaagggaagcatcaaggattggtgttgatatttgaaagtttaagagtggtatacttttattcagtcaacacatgacaaatgtaaaaggcactcatttgttgttcctggaagaagcctggcagcattccattcagacatctgccctttcatcgtcccactttttacttattgcagtcctttcagtctgaatatttcctcctgacgcatcttctgccgtccgaaatgactccctgctcccagatcctgtagcccttattattgacacctttcatttagaaatttagcacatgtcacattacaccattattgaataaataatgaataaataaataaataaagatgtatgtccttcccaagtatatcagagaactatctggacaatttctttctttcccaattctcagaatcagcagtattctgtcaagaaacatttatcgacgatgatggcaatagtcgattaaaatcagatgaagttttatttttaaaaaaaggttgagcggagagacaaggctgaaggtttggaagttgagacaaccatcttcaataaacgttttctcatctaagggctgtatgtacatcattttggggaaggtagagattgaaggaggaagaacatcactggaggaagagacagcagtttgtctttcgagtttcaataaagtttcaaaaatcttgcctaagttatatatttttttggcctttcccttttgatgtgacaataaactgtaatgcggctgtcgtttgtacgaaccgatattcagcagaataaatctgagcactttcagaaaaagaagcgt

SEQ ID NO: 22688 - DNA, 486 bp, Homo sapiens
gcaccgtgtctggaacaagatagatgttcagcaaacacttcgggagtggatatgcttgtaacatggaaataagaaccgtttctaactcacagtcttatgcagattcatctggctgaatgtgagctgctggtgactccagggagtctggctgggttcaaagaagttgggaaatggaagaaagaggaacaggtggggctgaaagctttattatatccaacagggtcgatacagatgacataggcctgggcttgctcatggaatcccacctggaggcaggttgggctggaagctgcaaccttccgcatggtggggagaatgctgcctcctggagaagggaagacctggaggcagcagcctggtttcctcctcccctgtcagaggattgtctcctgcttgacttggggcgtagtcttaggccctcagggagctatttcagacacccaccaaatatttaactcatttaatatttaccactctctaatgtac

SEQ ID NO: 22689 - DNA, 519 bp, Homo sapiens
agaaaagttacggtgctttcacctattggtgctcaggtagttaaagtctgttttcagggcataagagacattttaatatccaaaatgaaaatttaaggtgaaggagaacatttcagaatctgctgtttattaaggtaaagatacctgttagtcgtgtggagccagttatttctaaccaagcagtatctggtgagagtttgtgtaacaccatgtgtggatattttacaattgaagttcagtggccttccctaaaggcatcctcttttaaaagggatttctgcaaaaccaaaattctctccgaaatacgcagaaaaactggcagctatgttagtgaggctccttagtgctgctgttgctgttagacagcataattaactttaggatgctaacatatgcgaaggatttatgtctctagaaccatttcccagggcgcagacttaccagctcctttcacttgtaaatctttccatttgccttccagtatctgaagaagggtggcagacacatctacggctggaa

SEQ ID NO: 22690 - DNA, 366 bp, Homo sapiens
agagtgtttttgggtgagatttacatttaaagtggtgaactctgagtaaagcagatcaccctccacaatgtgggtagtcctcatctaatcagctgaagggcctgaacagaacaaaacgctgacctccctgggcaagtgggaattttccagtagactgtttttggactgaaatttcaactctttcctgagtctccatcctgtcaggctgtcccatcagattttacactagccaagcctccacaatcacatgggccaattccttaatatatatacacagacagacacacacatacacacacacacacacacacacacacgttgatggttctttttctttggagaaccctgacttatacagtggttatg

SEQ ID NO: 22691 - DNA, 534 bp, Homo sapiens
gttttggcaaaacacagagtgccagggataacgtggagttcggcttattcatctgttatttgacttaggtttattgctgccatgattctgctctgtcccgggctcactgacctcagtgtgtttctgtttagcttgaccattggacacttctccagggttcgtggacagacgattactgcatgtccaagttcaagaatacctgctggattccaggatatagtgcaggggtcagcaaactctggcccacgggccctggcccgctgcccgtgtttgtaaataaagttttactgtcacacagacacaaccattcctttacatattgcctgtggctgcttttctcaccacaaaggcagagttgagtattcatctgggatggcctgcaaaatctgagatggttgctgtctgaccctttgcagagagaatttaccaatgtctgaaatgaaatcggccctccggatctgcaagttcctcatctgtggtttcaactaaccatggattgaaaatacgtggggaaagagaaaccaaaaaatgaca

SEQ ID NO: 22692 - DNA, 8035 bp, Homo sapiens
ggcgcagctccgacttcggacatggcgcacgctggcggtggcagcggtggcagcggtgccggcggccccgcgggccgggggctgagcggcgcccgctggggtcgctcgggctccgcaggccacgagaagctgccggtgcacgtagaagacgccctcacctatctggaccaggtgaagatccgctttggcagcgaccctgccacctacaacggcttcctggagatcatgaaggagttcaaaagccagagcatcgatactcctggagtcatcagacgtgtctcgcagctcttccacgagcaccctgacctcattgttggattcaacgcttttcttcccctcggatatagaatagacattcccaagaatggcaagttaaacatacagtcgcctctgacaagccaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctgttcacaggaaacgggccgtgcgagatgcacagcgtgcagaagaacgagcacgacaagaccccggagcacagcaggaagcgctcccggccctcgctcctccgccccgtgtctgcacccgccaagaaaaaaatgaaacttcgtggtaccaaagacctgtccatcgctgcagtggggaagtacgggactctgcaggaattttctttctttgacaaggtccgccgggtgctgaagagccaggaggtgtatgaaaacttcctccgctgcatcgcactcttcaaccaggagctggtgtctggctctgagctcctgcagctcgtcagcccatttctggggaaatttccagaactctttgcacagttcaagtccttcctgggggtaaaagagctgtccttcgcgccacccatgagcgacagatccggggacgggataagccgggaaattgattatgcatcctgcaagcgcataggatccagctaccgggcactccccaaaacctaccagcagcccaagtgcagtgggaggacagccatctgcaaggaggtactgaacgacacctgggtctccttcccttcctggtctgaggactccacgttcgtcagctccaagaagacaccgtacgaggagcagcttcaccgctgtgaggacgagcgcttcgagttagacgttgtcctggagacgaacctggccacaatccgtgtgttggaaagtgtgcagaagaagctgtctcggatggcgccggaagaccaggagaagttccggctggacgactccctgggaggcacgtcggaggtgatccagcgccgtgccatttatcgcatctatggcgacaaggccccggagatcatcgagagcctcaagaagaaccctgtcaccgctgtccccgttgtcctgaaaagactgaaggccaaggaagaggagtggcgggaggcccagcagggcttcaacaagatctggcgggagcagtatgagaaggcgtacctcaagtcccttgaccaccaggctgtgaacttcaagcagaacgacaccaaggccctgcgctccaagagcttgctcaacgagatcgagagcgtctacgacgagcaccaggagcagcactcggagggccgcagtgccccctctagcgagccgcacctcatctttgtgtacgaggaccggcagatcctggaggacgcagcagcgctcatcagctactacgtgaagcggcagccggccatccagaaggaggaccagggcaccatccaccagctgctgcaccagttcgtgcccagcctcttcttctctcagcagctggacctgggcgcctccgaggagtcagctgatgaggaccgggacagcccccaggggcagaccacagaccccagtgagcggaagaagccggcgccaggaccccacagtagccccccagaggagaagggggccttcggggatgccccggccactgagcagccacccctgccgcccccagccccgcacaagcccctggacgatgtctacagcctattttttgccaacaacaactggtacttcttcctgcgcctgcaccagaccctgtgctccaggctgctgaagatctaccgccaggcgcagaagcagcttctggagtatcggaccgagaaggagcgggagaagctgctgtgtgagggccgcagggagaagggcagcgaccccgccatggagctgcggctgaagcagcccagtgaagtggagctggaggagtactacccggccttcctggacatggtgcggagcctgctggagggcagcatcgaccccacgcagtacgaggacaccctacgcgagatgttcaccatccatgcctacgtgggcttcaccatggacaagctggtgcagaacattgcgcggcagctgcaccacctcgtgagcgatgacgtctgcctgaaggtggtggagctctacctgaacgagaagaagcggggtgccgctggtgggaacctgtcctcccgctgcgtccgcgctgctagggagaccagctaccagtggaaggctgagcgctgcatggccgacgagaactgcttcaaggtgatgttcctgcagcgcaaagggcaggtgatcatgaccatcgagctcctggacaccgaggaggcccagacggaggaccctgtggaggtccagcacctggctcggtacgtggagcagtatgtggggaccgagggcgcgtccagctcgcccactgagggcttcctcctgaaacctgtgttcctgcagaggaacctcaagaagttccgccgccggtggcagagcgagcaggcgcgggccctgcgcggtgaggccaggagctcctggaagcggctggtgggcgtggagagcgcctgcgacgtggactgccgcttcaagctcagcactcacaagatggtgttcatcgtgaactccgaggactacatgtaccgtcgcgggaccctctgccgggccaagcaggtgcagcccctggtcctgctccgccaccaccagcactttgaggagtggcacagccgctggctggaggacaatgtgacggtggaggcggctagcctggtgcaggactggctgatgggtgaggaggacgaggacatggtaccctgcaagacgctgtgtgagacagtgcacgtgcacggcctgcccgtgacccgctaccgcgtgcagtacagccgccgcccggcctcgccctgacccgccctcatgggcaccgggcaggcgcctcacagagcacagacgtgccctcggccttggtcgtgtcggggccgttttcttgaacgacgtgagaggcatctcccagcccctctgctgccggacagcgcactccagggcaggacgccgcccccgtggctcccggtctcctgtgggcctgctgtgtgccaaacctgagctacctgcacccgagccctggggctcagccccaccacaggggcgggtggacgtgctggccgaggaacaagcaatcatgtttgcgtccccgtccgtcacatgtgccaaatccctggcaggcagatggctcctgccccatattcttgccgtgtcttggaaaagtcacaggtgacagccctcctgaggcccacactttggagggggtccatgtccaagagaccctgacaaggaaggagttgagccctgggtaggcttgcttgaaaagtgagtccttccagaatattctcagagctgccagaaacatcatctgagggtttgggcatcagctctgcctggctggtgttcaggccctcagtcactttggaagtgagaagaacccttcagccaaacctttgggatcccattttgaagtccagagctggagcaggcgggcagtgccctgggagaccccgctctggataagacacccaaccccaactccagcagctggactctgggcccacaaggggagggaccccagccagtattccctcagagccggcacgaccctgctgtggggcggcgggcccagtcgtgttcctgcagtgggcaccctaggcgtatgtgtatacacgcacagatatttattcctttcgcttttagtggttgttatttctgtagcagccaagtcctgcggctccctggggctgagatctccctttgtggaactccgagagccgccctgacagtcccagccgccacccaaggagccccatccgcccacccaccctgggacccacgcggccactccagggatcattgttgtccttttgtgaggggctgaggcgactgtcccatggaggcatccaaggctttctgtgccaagaatcccaagtgactggggctggggaccacttctccaggcctctctccccgaccatgagagcccctggccctggcccctgcacaccagtaggcccagaataaccgccacccttgccatcctgcaacagctggactcaagtttccaggaagtggagatgtgtttctagaagtttcctgtggaacctggaggctcctgacgcctttgactccaggctgggcgattccgatgctgacccgtcctcctgggctccccacccccgctccccaagtgtcacacaggcactttgtacacatcctggttttctaagaagggaacttgccatcaagattcctgtaccaggcccacggccgtctcgggcagagccacctgggccccgggtgcagccggagaccccgccgagcccctcctcccagtattcccatccccgcatgcttctagggagcgcctcttttccgttcttgaggaatttctgttctggggcttgtccttcctttgcagctgttttgaatgtagttttccttttctatttatttgcacattaaagttaataattgaatattgaaaaaaaaaaaaaaaaaactcgagactagttctccccccatccctcaaattggcagcaccccagagttacccggtgacctggccaggctctgggcgtgaggccttcaccaatccaagggctattagtacagacgtgtaaatccttccaccccgacccgcacacacacccacactgctgccctggcgggggccatgggggtgatgaatgaccctccaacagccccacatgggttgtttctgtttctttggcttttctcgctccgcagtggagggtttactaggatttaagcttttgagtgcattgagaaccaagacagggcctggctccaactctgtgggccagaggtgggggactgctaggtcgagtctgcagcttcgccagtttcttggttgggacactcctctggcagccccagcaccaccacaaccccttgcagtgtgccccagtcccctggattcgctggactgcaaaaaggagcaccagggaaagctcagcaaaggctcaggaggcctcccgggtcctcgggagatgaagcatccgtgcctaggaaaaggggacagagggcaaggagagaagtgagagctacaattccagcattggagaagcgaggggcggggcgtcaacggcactgcttcaggacgcgcttgctgaaacgactccaacagctagttcacagcccagctttgtacgttggttaccatagctactgctgtcactgtagctgctcccgtagggtcgttgattcctgaacgtatcacatctcacctgcccccttcctcgtgggacgtgtcaagttgactttaaagcctaaggtggcttgtggggactgcaccagaaagtgtctaaccttgtgttccccgaaatcctttctctgacttaggaaccagcgccccctgctggagaagttttttcattttgttagccgacttctggtagcttagcaaagagaccagctgactgtctctcggcccagcccaccacgccgagtagcttgtgtggatgcagtcctgtgagggtgtgcataaccgttcccaggtgtacgcacgcgcgcgcgcgcgcacagacacacacacacacacacacacacacacacacacagtaaccacgggtaggcaccaggggctttgtacattcaggagctgcagagaggaaaggtctcccatgtaccagagaaggaaaagtctgatcccgaaacagcttgaacgaaaggtggttaacacgtgaccaatccccatggcagacagcgggctggtgaacaggaagagcacagaatctctgtggggcgatgctgcagcggctgaaaccacgtcaagtcccccagagcccggcattctatgtaagcatccacctgtgacgccgtggagcaggatcttcattcatctcaccagagcaacagcccagtcctgaggatgggagggacgtgacttagccttgggattccacgctcgccgccctcccttggccgccctactccccagtttcctggcgatgagccatttattgtgtctcacaccagcctcatttccaactccgacttcctacttagaatgtggcagtggctttgtgagtgagaatcctgatgagttttccagtggcctctgcagaagctggcccccttctaagggcatagctaacccccttcccactcctgagtcactgaattcgaggagggtggggcagggaaagggctggcccccctgctgaaatcttgattctgcatttgaggaaggtcagggtgccgctgggggagcagggagcggggagggaggaagaggggaatgcacatcttttgcgccactattaaggcacctgtcaccttacatctcaatctggaatcaaagtgccctgggttgagaagcagacctgggctctggtcacactttggtcactcattagctctaggaccagtcactaatctctgagactccattttctccagggaaacgaggcttgcccagatagactaacaaccctttagtgctccaagaagtgagaatttccgaaaaagatctgccggcccagagcactccctcttgccctaatcctggcagggtctggatgtatttacccaactctgatcttgcgtgcagggatgcttgctgatggatgaaagaccacaataaaacaagattagcagcaaaacaattttaattgtcagtgaaaagcaaacatgtttgtcagactctcctgtggagtcatttcaaatggtaactcttctcttgtaccaggaagcagctgtaggtggggtaatgggatctgtctcctggtgcagaggggcagcttatggcggcagcagcttcaacaagcccgtcccacggccagccctaactgggccaagtgcaagctcctgatgagctgctgggcctggcagcgttccccacttcctagtgccttgctcccctggaattccacagccaatcaaccacagcagccgtgtcctccttgccagaaataacatcattcgtacgtcctgcctttgtaaaaatcaagacccagttaaccatcacccacttcttgcccctgattgatggggtccctgagtacaagcgtcctgtgcaatcccctccctcctaccgctttcctagctaagccctgctagccccacaaatcagaatctgggtttggggtgctggagagatggtgggccccagctcttccccacatagcccacgctgctcagggcacggtctccaaccaggctcgagattgcctgcctgcccgctgcagccgcagggccccaccctgtggaaaaggaagcttcccccactcaactgcactgtccttttctgctgtctagtctgtgctaagggacactacttgtacacttttcaaacggtgccctaaattggaagagaaggaggggccaggaacacagccctctccgccgtctttctccacctccacttcaccactcctgctctagacttcttgtcttgcatctttgataacttggagtcataaccgagtggatgtcggaataaatgagagatttgaagtag

SEQ ID NO: 22693 - DNA, 6646 bp, Homo sapiens
ggcgcagctccgacttcggacatggcgcacgctggcggtggcagcggtggcagcggtgccggcggccccgcgggccgggggctgagcggcgcccgctggggtcgctcgggctccgcaggccacgagaagctgccggtgcacgtagaagacgccctcacctatctggaccaggtgaagatccgctttggcagcgaccctgccacctacaacggcttcctggagatcatgaaggagttcaaaagccagagcatcgatactcctggagtcatcagacgtgtctcgcagctcttccacgagcaccctgacctcattgttggattcaacgcttttcttcccctcggatatagaatagacattcccaagaatggcaagttaaacatacagtcgcctctgacaagccaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctgttcacaggaaacgggccgtgcgagatgcacagcgtgcagaagaacgagcacgacaagaccccggagcacagcaggaagcgctcccggccctcgctcctccgccccgtgtctgcacccgccaagaacaactggtacttcttcctgcgcctgcaccagaccctgtgctccaggctgctgaagatctaccgccaggcgcagaagcagcttctggagtatcggaccgagaaggagcgggagaagctgctgtgtgagggccgcagggagaagggcagcgaccccgccatggagctgcggctgaagcagcccagtgaagtggagctggaggagtactacccggccttcctggacatggtgcggagcctgctggagggcagcatcgaccccacgcagtacgaggacaccctacgcgagatgttcaccatccatgcctacgtgggcttcaccatggacaagctggtgcagaacattgcgcggcagctgcaccacctcgtgagcgatgacgtctgcctgaaggtggtggagctctacctgaacgagaagaagcggggtgccgctggtgggaacctgtcctcccgctgcgtccgcgctgctagggagaccagctaccagtggaaggctgagcgctgcatggccgacgagaactgcttcaaggtgatgttcctgcagcgcaaagggcaggtgatcatgaccatcgagctcctggacaccgaggaggcccagacggaggaccctgtggaggtccagcacctggctcggtacgtggagcagtatgtggggaccgagggcgcgtccagctcgcccactgagggcttcctcctgaaacctgtgttcctgcagaggaacctcaagaagttccgccgccggtggcagagcgagcaggcgcgggccctgcgcggtgaggccaggagctcctggaagcggctggtgggcgtggagagcgcctgcgacgtggactgccgcttcaagctcagcactcacaagatggtgttcatcgtgaactccgaggactacatgtaccgtcgcgggaccctctgccgggccaagcaggtgcagcccctggtcctgctccgccaccaccagcactttgaggagtggcacagccgctggctggaggacaatgtgacggtggaggcggctagcctggtgcaggactggctgatgggtgaggaggacgaggacatggtaccctgcaagacgctgtgtgagacagtgcacgtgcacggcctgcccgtgacccgctaccgcgtgcagtacagccgccgcccggcctcgccctgacccgccctcatgggcaccgggcaggcgcctcacagagcacagacgtgccctcggccttggtcgtgtcggggccgttttcttgaacgacgtgagaggcatctcccagcccctctgctgccggacagcgcactccagggcaggacgccgcccccgtggctcccggtctcctgtgggcctgctgtgtgccaaacctgagctacctgcacccgagccctggggctcagccccaccacaggggcgggtggacgtgctggccgaggaacaagcaatcatgtttgcgtccccgtccgtcacatgtgccaaatccctggcaggcagatggctcctgccccatattcttgccgtgtcttggaaaagtcacaggtgacagccctcctgaggcccacactttggagggggtccatgtccaagagaccctgacaaggaaggagttgagccctgggtaggcttgcttgaaaagtgagtccttccagaatattctcagagctgccagaaacatcatctgagggtttgggcatcagctctgcctggctggtgttcaggccctcagtcactttggaagtgagaagaacccttcagccaaacctttgggatcccattttgaagtccagagctggagcaggcgggcagtgccctgggagaccccgctctggataagacacccaaccccaactccagcagctggactctgggcccacaaggggagggaccccagccagtattccctcagagccggcacgaccctgctgtggggcggcgggcccagtcgtgttcctgcagtgggcaccctaggcgtatgtgtatacacgcacagatatttattcctttcgcttttagtggttgttatttctgtagcagccaagtcctgcggctccctggggctgagatctccctttgtggaactccgagagccgccctgacagtcccagccgccacccaaggagccccatccgcccacccaccctgggacccacgcggccactccagggatcattgttgtccttttgtgaggggctgaggcgactgtcccatggaggcatccaaggctttctgtgccaagaatcccaagtgactggggctggggaccacttctccaggcctctctccccgaccatgagagcccctggccctggcccctgcacaccagtaggcccagaataaccgccacccttgccatcctgcaacagctggactcaagtttccaggaagtggagatgtgtttctagaagtttcctgtggaacctggaggctcctgacgcctttgactccaggctgggcgattccgatgctgacccgtcctcctgggctccccacccccgctccccaagtgtcacacaggcactttgtacacatcctggttttctaagaagggaacttgccatcaagattcctgtaccaggcccacggccgtctcgggcagagccacctgggccccgggtgcagccggagaccccgccgagcccctcctcccagtattcccatccccgcatgcttctagggagcgcctcttttccgttcttgaggaatttctgttctggggcttgtccttcctttgcagctgttttgaatgtagttttccttttctatttatttgcacattaaagttaataattgaatattgaaaaaaaaaaaaaaaaaactcgagactagttctccccccatccctcaaattggcagcaccccagagttacccggtgacctggccaggctctgggcgtgaggccttcaccaatccaagggctattagtacagacgtgtaaatccttccaccccgacccgcacacacacccacactgctgccctggcgggggccatgggggtgatgaatgaccctccaacagccccacatgggttgtttctgtttctttggcttttctcgctccgcagtggagggtttactaggatttaagcttttgagtgcattgagaaccaagacagggcctggctccaactctgtgggccagaggtgggggactgctaggtcgagtctgcagcttcgccagtttcttggttgggacactcctctggcagccccagcaccaccacaaccccttgcagtgtgccccagtcccctggattcgctggactgcaaaaaggagcaccagggaaagctcagcaaaggctcaggaggcctcccgggtcctcgggagatgaagcatccgtgcctaggaaaaggggacagagggcaaggagagaagtgagagctacaattccagcattggagaagcgaggggcggggcgtcaacggcactgcttcaggacgcgcttgctgaaacgactccaacagctagttcacagcccagctttgtacgttggttaccatagctactgctgtcactgtagctgctcccgtagggtcgttgattcctgaacgtatcacatctcacctgcccccttcctcgtgggacgtgtcaagttgactttaaagcctaaggtggcttgtggggactgcaccagaaagtgtctaaccttgtgttccccgaaatcctttctctgacttaggaaccagcgccccctgctggagaagttttttcattttgttagccgacttctggtagcttagcaaagagaccagctgactgtctctcggcccagcccaccacgccgagtagcttgtgtggatgcagtcctgtgagggtgtgcataaccgttcccaggtgtacgcacgcgcgcgcgcgcgcacagacacacacacacacacacacacacacacacacacagtaaccacgggtaggcaccaggggctttgtacattcaggagctgcagagaggaaaggtctcccatgtaccagagaaggaaaagtctgatcccgaaacagcttgaacgaaaggtggttaacacgtgaccaatccccatggcagacagcgggctggtgaacaggaagagcacagaatctctgtggggcgatgctgcagcggctgaaaccacgtcaagtcccccagagcccggcattctatgtaagcatccacctgtgacgccgtggagcaggatcttcattcatctcaccagagcaacagcccagtcctgaggatgggagggacgtgacttagccttgggattccacgctcgccgccctcccttggccgccctactccccagtttcctggcgatgagccatttattgtgtctcacaccagcctcatttccaactccgacttcctacttagaatgtggcagtggctttgtgagtgagaatcctgatgagttttccagtggcctctgcagaagctggcccccttctaagggcatagctaacccccttcccactcctgagtcactgaattcgaggagggtggggcagggaaagggctggcccccctgctgaaatcttgattctgcatttgaggaaggtcagggtgccgctgggggagcagggagcggggagggaggaagaggggaatgcacatcttttgcgccactattaaggcacctgtcaccttacatctcaatctggaatcaaagtgccctgggttgagaagcagacctgggctctggtcacactttggtcactcattagctctaggaccagtcactaatctctgagactccattttctccagggaaacgaggcttgcccagatagactaacaaccctttagtgctccaagaagtgagaatttccgaaaaagatctgccggcccagagcactccctcttgccctaatcctggcagggtctggatgtatttacccaactctgatcttgcgtgcagggatgcttgctgatggatgaaagaccacaataaaacaagattagcagcaaaacaattttaattgtcagtgaaaagcaaacatgtttgtcagactctcctgtggagtcatttcaaatggtaactcttctcttgtaccaggaagcagctgtaggtggggtaatgggatctgtctcctggtgcagaggggcagcttatggcggcagcagcttcaacaagcccgtcccacggccagccctaactgggccaagtgcaagctcctgatgagctgctgggcctggcagcgttccccacttcctagtgccttgctcccctggaattccacagccaatcaaccacagcagccgtgtcctccttgccagaaataacatcattcgtacgtcctgcctttgtaaaaatcaagacccagttaaccatcacccacttcttgcccctgattgatggggtccctgagtacaagcgtcctgtgcaatcccctccctcctaccgctttcctagctaagccctgctagccccacaaatcagaatctgggtttggggtgctggagagatggtgggccccagctcttccccacatagcccacgctgctcagggcacggtctccaaccaggctcgagattgcctgcctgcccgctgcagccgcagggccccaccctgtggaaaaggaagcttcccccactcaactgcactgtccttttctgctgtctagtctgtgctaagggacactacttgtacacttttcaaacggtgccctaaattggaagagaaggaggggccaggaacacagccctctccgccgtctttctccacctccacttcaccactcctgctctagacttcttgtcttgcatctttgataacttggagtcataaccgagtggatgtcggaataaatgagagatttgaagtag

SEQ ID NO: 22694 - DNA, 5761 bp, Homo sapiens
gaggagccacctgggcccagctcccagtcacaatttttgcggggacagatgtttcctgctcacctcccgcatcctggtgacagtgaggcattgacccgtgtgtgtccccagggtggtcattggggcctgcagctcccggcacctgccaacaggtccagtgtgtgtgcacattactcagctaggccaaccccattcatttcctggggctaccaccacaatgaccacaaaccacgtggcttcaaacaacagaagtctattccctcaacgtcctggaggtcagcagtccacaaccacagtgtgggccgggcggtgctcctgccaaaggctctggggcggatccttcctgctcttccagcttccgggggcttctggcgctcctcagctgtggcctggttgtgtgagtcccgctgtcactgggtcctctgtcaagagctatagtctgttggggtctccgtcagggatcagagtcctctgcagcggctctcctcatgctctggcagtggggggcacagaacccctgtgagctcctgaactcagagtccagagtaagagtggccatagccctgctgtaggggcatcacgggctgtgtctctccctgtccccagcacctggctcggtacgtggagcagtatgtggggaccgagggcgcgtccagctcgcccactgagggcttcctcctgaaacctgtgttcctgcagaggaacctcaagaagttccgccgccggtggcagagcgagcaggcgcgggccctgcgcggtgaggccaggagctcctggaagcggctggtgggcgtggagagcgcctgcgacgtggactgccgcttcaagctcagcactcacaagatggtgttcatcgtgaactccgaggactacatgtaccgtcgcgggaccctctgccgggccaagcaggtgcagcccctggtcctgctccgccaccaccagcactttgaggagtggcacagccgctggctggaggacaatgtgacggtggaggcggctagcctggtgcaggactggctgatgggtgaggaggacgaggacatggtaccctgcaagacgctgtgtgagacagtgcacgtgcacggcctgcccgtgacccgctaccgcgtgcagtacagccgccgcccggcctcgccctgacccgccctcatgggcaccgggcaggcgcctcacagagcacagacgtgccctcggccttggtcgtgtcggggccgttttcttgaacgacgtgagaggcatctcccagcccctctgctgccggacagcgcactccagggcaggacgccgcccccgtggctcccggtctcctgtgggcctgctgtgtgccaaacctgagctacctgcacccgagccctggggctcagccccaccacaggggcgggtggacgtgctggccgaggaacaagcaatcatgtttgcgtccccgtccgtcacatgtgccaaatccctggcaggcagatggctcctgccccatattcttgccgtgtcttggaaaagtcacaggtgacagccctcctgaggcccacactttggagggggtccatgtccaagagaccctgacaaggaaggagttgagccctgggtaggcttgcttgaaaagtgagtccttccagaatattctcagagctgccagaaacatcatctgagggtttgggcatcagctctgcctggctggtgttcaggccctcagtcactttggaagtgagaagaacccttcagccaaacctttgggatcccattttgaagtccagagctggagcaggcgggcagtgccctgggagaccccgctctggataagacacccaaccccaactccagcagctggactctgggcccacaaggggagggaccccagccagtattccctcagagccggcacgaccctgctgtggggcggcgggcccagtcgtgttcctgcagtgggcaccctaggcgtatgtgtatacacgcacagatatttattcctttcgcttttagtggttgttatttctgtagcagccaagtcctgcggctccctggggctgagatctccctttgtggaactccgagagccgccctgacagtcccagccgccacccaaggagccccatccgcccacccaccctgggacccacgcggccactccagggatcattgttgtccttttgtgaggggctgaggcgactgtcccatggaggcatccaaggctttctgtgccaagaatcccaagtgactggggctggggaccacttctccaggcctctctccccgaccatgagagcccctggccctggcccctgcacaccagtaggcccagaataaccgccacccttgccatcctgcaacagctggactcaagtttccaggaagtggagatgtgtttctagaagtttcctgtggaacctggaggctcctgacgcctttgactccaggctgggcgattccgatgctgacccgtcctcctgggctccccacccccgctccccaagtgtcacacaggcactttgtacacatcctggttttctaagaagggaacttgccatcaagattcctgtaccaggcccacggccgtctcgggcagagccacctgggccccgggtgcagccggagaccccgccgagcccctcctcccagtattcccatccccgcatgcttctagggagcgcctcttttccgttcttgaggaatttctgttctggggcttgtccttcctttgcagctgttttgaatgtagttttccttttctatttatttgcacattaaagttaataattgaatattgaaaaaaaaaaaaaaaaaactcgagactagttctccccccatccctcaaattggcagcaccccagagttacccggtgacctggccaggctctgggcgtgaggccttcaccaatccaagggctattagtacagacgtgtaaatccttccaccccgacccgcacacacacccacactgctgccctggcgggggccatgggggtgatgaatgaccctccaacagccccacatgggttgtttctgtttctttggcttttctcgctccgcagtggagggtttactaggatttaagcttttgagtgcattgagaaccaagacagggcctggctccaactctgtgggccagaggtgggggactgctaggtcgagtctgcagcttcgccagtttcttggttgggacactcctctggcagccccagcaccaccacaaccccttgcagtgtgccccagtcccctggattcgctggactgcaaaaaggagcaccagggaaagctcagcaaaggctcaggaggcctcccgggtcctcgggagatgaagcatccgtgcctaggaaaaggggacagagggcaaggagagaagtgagagctacaattccagcattggagaagcgaggggcggggcgtcaacggcactgcttcaggacgcgcttgctgaaacgactccaacagctagttcacagcccagctttgtacgttggttaccatagctactgctgtcactgtagctgctcccgtagggtcgttgattcctgaacgtatcacatctcacctgcccccttcctcgtgggacgtgtcaagttgactttaaagcctaaggtggcttgtggggactgcaccagaaagtgtctaaccttgtgttccccgaaatcctttctctgacttaggaaccagcgccccctgctggagaagttttttcattttgttagccgacttctggtagcttagcaaagagaccagctgactgtctctcggcccagcccaccacgccgagtagcttgtgtggatgcagtcctgtgagggtgtgcataaccgttcccaggtgtacgcacgcgcgcgcgcgcgcacagacacacacacacacacacacacacacacacacacagtaaccacgggtaggcaccaggggctttgtacattcaggagctgcagagaggaaaggtctcccatgtaccagagaaggaaaagtctgatcccgaaacagcttgaacgaaaggtggttaacacgtgaccaatccccatggcagacagcgggctggtgaacaggaagagcacagaatctctgtggggcgatgctgcagcggctgaaaccacgtcaagtcccccagagcccggcattctatgtaagcatccacctgtgacgccgtggagcaggatcttcattcatctcaccagagcaacagcccagtcctgaggatgggagggacgtgacttagccttgggattccacgctcgccgccctcccttggccgccctactccccagtttcctggcgatgagccatttattgtgtctcacaccagcctcatttccaactccgacttcctacttagaatgtggcagtggctttgtgagtgagaatcctgatgagttttccagtggcctctgcagaagctggcccccttctaagggcatagctaacccccttcccactcctgagtcactgaattcgaggagggtggggcagggaaagggctggcccccctgctgaaatcttgattctgcatttgaggaaggtcagggtgccgctgggggagcagggagcggggagggaggaagaggggaatgcacatcttttgcgccactattaaggcacctgtcaccttacatctcaatctggaatcaaagtgccctgggttgagaagcagacctgggctctggtcacactttggtcactcattagctctaggaccagtcactaatctctgagactccattttctccagggaaacgaggcttgcccagatagactaacaaccctttagtgctccaagaagtgagaatttccgaaaaagatctgccggcccagagcactccctcttgccctaatcctggcagggtctggatgtatttacccaactctgatcttgcgtgcagggatgcttgctgatggatgaaagaccacaataaaacaagattagcagcaaaacaattttaattgtcagtgaaaagcaaacatgtttgtcagactctcctgtggagtcatttcaaatggtaactcttctcttgtaccaggaagcagctgtaggtggggtaatgggatctgtctcctggtgcagaggggcagcttatggcggcagcagcttcaacaagcccgtcccacggccagccctaactgggccaagtgcaagctcctgatgagctgctgggcctggcagcgttccccacttcctagtgccttgctcccctggaattccacagccaatcaaccacagcagccgtgtcctccttgccagaaataacatcattcgtacgtcctgcctttgtaaaaatcaagacccagttaaccatcacccacttcttgcccctgattgatggggtccctgagtacaagcgtcctgtgcaatcccctccctcctaccgctttcctagctaagccctgctagccccacaaatcagaatctgggtttggggtgctggagagatggtgggccccagctcttccccacatagcccacgctgctcagggcacggtctccaaccaggctcgagattgcctgcctgcccgctgcagccgcagggccccaccctgtggaaaaggaagcttcccccactcaactgcactgtccttttctgctgtctagtctgtgctaagggacactacttgtacacttttcaaacggtgccctaaattggaagagaaggaggggccaggaacacagccctctccgccgtctttctccacctccacttcaccactcctgctctagacttcttgtcttgcatctttgataacttggagtcataaccgagtggatgtcggaataaatgagagatttgaagtag

SEQ ID NO: 22695 - DNA, 4920 bp, Homo sapiens
ggcgcagctccgacttcggacatggcgcacgctggcggtggcagcggtggcagcggtgccggcggccccgcgggccgggggctgagcggcgcccgctggggtcgctcgggctccgcaggccacgagaagctgccggtgcacgtagaagacgccctcacctatctggaccaggtgaagatccgctttggcagcgaccctgccacctacaacggcttcctggagatcatgaaggagttcaaaagccagagcatcgatactcctggagtcatcagacgtgtctcgcagctcttccacgagcaccctgacctcattgttggattcaacgcttttcttcccctcggatatagaatagacattcccaagaatggcaagttaaacatacagtcgcctctgacaagccaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctgttcacaggaaacgggccgtgcgagatgcacagcgtgcagaagaacgagcacgacaagaccccggagcacagcaggaagcgctcccggccctcgctcctccgccccgtgtctgcacccgccaagaaaaaaatgaaacttcgtggtaccaaagacctgtccatcgctgcagtggggaagtacgggactctgcaggaattttctttctttgacaaggtccgccgggtgctgaagagccaggaggtgtatgaaaacttcctccgctgcatcgcactcttcaaccaggagctggtgtctggctctgagctcctgcagctcgtcagcccatttctggggaaatttccagaactctttgcacagttcaagtccttcctgggggtaaaagagctgtccttcgcgccacccatgagcgacagatccggggacgggataagccgggaaattgattatgcatcctgcaagcgcataggatccagctaccgggcactccccaaaacctaccagcagcccaagtgcagtgggaggacagccatctgcaaggaggtactgaacgacacctgggtctccttcccttcctggtctgaggactccacgttcgtcagctccaagaagacaccgtacgaggagcagcttcaccgctgtgaggacgagcgcttcgagttagacgttgtcctggagacgaacctggccacaatccgtgtgttggaaagtgtgcagaagaagctgtctcggatggcgccggaagaccaggagaagttccggctggacgactccctgggaggcacgtcggaggtgatccagcgccgtgccatttatcgcatctatggcgacaaggccccggagatcatcgagagcctcaagaagaaccctgtcaccgctgtccccgttgtcctgaaaagactgaaggccaaggaagaggagtggcgggaggcccagcagggcttcaacaagatctggcgggagcagtatgagaaggcgtacctcaagtcccttgaccaccaggctgtgaacttcaagcagaacgacaccaaggccctgcgctccaagagcttgctcaacgagatcgagagcgtctacgacgagcaccaggagcagcactcggagggccgcagtgccccctctagcgagccgcacctcatctttgtgtacgaggaccggcagatcctggaggacgcagcagcgctcatcagctactacgtgaagcggcagccggccatccagaaggaggaccagggcaccatccaccagctgctgcaccagttcgtgcccagcctcttcttctctcagcagctggacctgggcgcctccgaggagtcagctgatgaggaccgggacagcccccaggggcagaccacagaccccagtgagcggaagaagccggcgccaggaccccacagtagccccccagaggagaagggggccttcggggatgccccggccactgagcagccacccctgccgcccccagccccgcacaagcccctggacgatgtctacagcctattttttgccaacaacaactggtacttcttcctgcgcctgcaccagaccctgtgctccaggctgctgaagatctaccgccaggcgcagaagcagcttctggagtatcggaccgagaaggagcgggagaagctgctgtgtgagggccgcagggagaagggcagcgaccccgccatggagctgcggctgaagcagcccagtgaagtggagctggaggagtactacccggccttcctggacatggtgcggagcctgctggagggcagcatcgaccccacgcagtacgaggacaccctacgcgagatgttcaccatccatgcctacgtgggcttcaccatggacaagctggtgcagaacattgcgcggcagctgcaccacctcgtgagcgatgacgtctgcctgaaggtggtggagctctacctgaacgagaagaagcggggtgccgctggtgggaacctgtcctcccgctgcgtccgcgctgctagggagaccagctaccagtggaaggctgagcgctgcatggccgacgagaactgcttcaaggtgatgttcctgcagcgcaaagggcaggtgatcatgaccatcgagctcctggacaccgaggaggcccagacggaggaccctgtggaggtccagcacctggctcggtacgtggagcagtatgtggggaccgagggcgcgtccagctcgcccactgagggcttcctcctgaaacctgtgttcctgcagaggaacctcaagaagttccgccgccggtggcagagcgagcaggcgcgggccctgcgcggtgaggccaggagctcctggaagcggctggtgggcgtggagagcgcctgcgacgtggactgccgcttcaagctcagcactcacaagatggtgttcatcgtgaactccgaggactacatgtaccgtcgcgggaccctctgccgggccaagcaggtgcagcccctggtcctgctccgccaccaccagcactttgaggagtggcacagccgctggctggaggacaatgtgacggtggaggcggctagcctggtgcaggactggctgatgggtgaggaggacgaggacatggtaccctgcaagacgctgtgtgagacagtgcacgtgcacggcctgcccgtgacccgctaccgcgtgcagtacagccgccgcccggcctcgccctgacccgccctcatgggcaccgggcaggcgcctcacagagcacagacgtgccctcggccttggtcgtgtcggggccgttttcttgaacgacgtgagaggcatctcccagcccctctgctgccggacagcgcactccagggcaggacgccgcccccgtggctcccggtctcctgtgggcctgctgtgtgccaaacctgagctacctgcacccgagccctggggctcagccccaccacaggggcgggtggacgtgctggccgaggaacaagcaatcatgtttgcgtccccgtccgtcacatgtgccaaatccctggcaggcagatggctcctgccccatattcttgccgtgtcttggaaaagtcacaggtgacagccctcctgaggcccacactttggagggggtccatgtccaagagaccctgacaaggaaggagttgagccctgggtaggcttgcttgaaaagtgagtccttccagaatattctcagagctgccagaaacatcatctgagggtttgggcatcagctctgcctggctggtgttcaggccctcagtcactttggaagtgagaagaacccttcagccaaacctttgggaccccagccagtattccctcagagccggcacgaccctgctgtggggcggcgggcccagtcgtgttcctgcagtgggcaccctaggcgtatgtgtatacacgcacagatatttattcctttcgcttttagtggttgttatttctgtagcagccaagtcctgcggctccctggggctgagatctccctttgtggaactccgagagccgccctgacagtcccagccgccacccaaggagccccatccgcccacccaccctgggacccacgcggccactccagggatcattgttgtccttttgtgaggggctgaggcgactgtcccatggaggcatccaaggctttctgtgccaagaatcccaagtgactggggctggggaccacttctccaggcctctctccccgaccatgagagcccctggccctggcccctgcacaccagtaggcccagaataaccgccacccttgccatcctgcaacagctggactcaagtttccaggaagtggagatgtgtttctagaagtttcctgtggaacctggaggctcctgacgcctttgactccaggctgggcgattccgatgctgacccgtcctcctgggctccccacccccgctccccaagtgtcacacaggcactttgtacacatcctggttttctaagaagggaacttgccatcaagattcctgtaccaggcccacggccgtctcgggcagagccacctgggccccgggtgcagccggagaccccgccgagcccctcctcccagtattcccatccccgcatgcttctagggagcgcctcttttccgttcttgaggaatttctgttctggggcttgtccttcctttgcagctgttttgaatgtagttttccttttctatttatttgcacattaaagttaataattgaatattga

SEQ ID NO: 22696 - DNA, 4242 bp, Homo sapiens
ggcgcagctccgacttcggacatggcgcacgctggcggtggcagcggtggcagcggtgccggcggccccgcgggccgggggctgagcggcgcccgctggggtcgctcgggctccgcaggccacgagaagctgccggtgcacgtagaagacgccctcacctatctggaccaggtgaagatccgctttggcagcgaccctgccacctacaacggcttcctggagatcatgaaggagttcaaaagccagagcatcgatactcctggagtcatcagacgtgtctcgcagctcttccacgagcaccctgacctcattgttggattcaacgcttttcttcccctcggatatagaatagacattcccaagaatggcaagttaaacatacagtcgcctctgacaagccaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctgttcacaggaaacgggccgtgcgagatgcacagcgtgcagaagaacgagcacgacaagaccccggagcacagcaggaagcgctcccggccctcgctcctccgccccgtgtctgcacccgccaagaaaaaaatgaaacttcgtggtaccaaagacctgtccatcgctgcagtggggaagtacgggactctgcaggaattttctttctttgacaaggtccgccgggtgctgaagagccaggaggtgtatgaaaacttcctccgctgcatcgcactcttcaaccaggagctggtgtctggctctgagctcctgcagctcgtcagcccatttctggggaaatttccagaactctttgcacagttcaagtccttcctgggggtaaaagagctgtccttcgcgccacccatgagcgacagatccggggacgggataagccgggaaattgattatgcatcctgcaagcgcataggatccagctaccgggcactccccaaaacctaccagcagcccaagtgcagtgggaggacagccatctgcaaggaggtactgaacgacacctgggtctccttcccttcctggtctgaggactccacgttcgtcagctccaagaagacaccgtacgaggagcagcttcaccgctgtgaggacgagcgcttcgagttagacgttgtcctggagacgaacctggccacaatccgtgtgttggaaagtgtgcagaagaagctgtctcggatggcgccggaagaccaggagaagttccggctggacgactccctgggaggcacgtcggaggtgatccagcgccgtgccatttatcgcatctatggcgacaaggccccggagatcatcgagagcctcaagaagaaccctgtcaccgctgtccccgttgtcctgaaaagactgaaggccaaggaagaggagtggcgggaggcccagcagggcttcaacaagatctggcgggagcagtatgagaaggcgtacctcaagtcccttgaccaccaggctgtgaacttcaagcagaacgacaccaaggccctgcgctccaagagcttgctcaacgagatcgagagcgtctacgacgagcaccaggagcagcactcggagggccgcagtgccccctctagcgagccgcacctcatctttgtgtacgaggaccggcagatcctggaggacgcagcagcgctcatcagctactacgtgaagcggcagccggccatccagaaggaggaccagggcaccatccaccagctgctgcaccagttcgtgcccagcctcttcttctctcagcagctggacctgggcgcctccgaggagtcagctgatgaggaccgggacagcccccaggggcagaccacagaccccagtgagcggaagaagccggcgccaggaccccacagtagccccccagaggagaagggggccttcggggatgccccggccactgagcagccacccctgccgcccccagccccgcacaagcccctggacgatgtctacagcctattttttgccaacaacaactggtacttcttcctgcgcctgcaccagaccctgtgctccaggctgctgaagatctaccgccaggcgcagaagcagcttctggagtatcggaccgagaaggagcgggagaagctgctgtgtgagggccgcagggagaagggcagcgaccccgccatggagctgcggctgaagcagcccagtgaagtggagctggaggagtactacccggccttcctggacatggtgcggagcctgctggagggcagcatcgaccccacgcagtacgaggacaccctacgcgagatgttcaccatccatgcctacgtgggcttcaccatggacaagctggtgcagaacattgcgcggcagctgcaccacctcgtgagcgatgacgtctgcctgaaggtggtggagctctacctgaacgagaagaagcggggtgccgctggtgggaacctgtcctcccgctgcgtccgcgctgctagggagaccagctaccagtggaaggctgagcgctgcatggccgacgagaactgcttcaaggtgatgttcctgcagcgcaaagggcaggtgatcatgaccatcgagctcctggacaccgaggaggcccagacggaggaccctgtggaggtccagcacctggctcggtacgtggagcagtatgtggggaccgagggcgcgtccagctcgcccactgagggcttcctcctgaaacctgtgttcctgcagaggaacctcaagaagttccgccgccggtggcagagcgagcaggcgcgggccctgcgcggtgaggccaggagctcctggaagcggctggtgggcgtggagagcgcctgcgacgtggactgccgcttcaagctcagcactcacaagatggtgttcatcgtgaactccgaggactacatgtaccgtcgcgggaccctctgccgggccaagcaggtgcagcccctggtcctgctccgccaccaccagcactttgaggagtggcacagccgctggctggaggacaatgtgacggtggaggcggctagcctggtgcaggactggctgatgggtgaggaggacgaggacatggtaccctgcaagacgctgtgtgagacagtgcacgtgcacggcctgcccgtgacccgctaccgcgtgcagtacagccgccgcccggcctcgccctgacccgccctcatgggcaccgggcaggcgcctcacagagcacagacgtgccctcggccttggtcgtgtcggggccgttttcttgaacgacgtgagaggcatctcccagcccctctgctgccggacagcgcactccagggcaggacgccgcccccgtggctcccggtctcctgtgggcctgctgtgtgccaaacctgagctacctgcacccgagccctggggctcagccccaccacaggggcgggtggacgtgctggccgaggaacaagcaatcatgtttgcgtccccgtccgtcacatgtgccaaatccctggcaggcagatggctcctgccccatattcttgccgtgtcttggaaaagtcacaggtgacagccctcctgaggcccacactttggagggggtccatgtccaagagaccctgacaaggaaggagttgagccctgggtaggcttgcttgaaaagtgagtccttccagaatattctcagagctgccagaaacatcatctgagggtttgggcatcagctctgcctggctggtgttcaggccctcagtcactttggaagtgagaagaacccttcagccaaacctttgggatcccattttgaagtccagagctggagcaggcgggcagtgccctgggagaccccgctctggataagacacccaacccctcctcccagtattcccatccccgcatgcttctagggagcgcctcttttccgttcttgaggaatttctgttctggggcttgtccttcctttgcagctgttttgaatgtagttttccttttctatttatttgcacattaaagttaataattgaatattga

SEQ ID NO: 22697 - DNA, 2322 bp, Homo sapiens
ggcgcagctccgacttcggacatggcgcacgctggcggtggcagcggtggcagcggtgccggcggccccgcgggccgggggctgagcggcgcccgctggggtcgctcgggctccgcaggccacgagaagctgccggtgcacgtagaagacgccctcacctatctggaccaggtgaagatccgctttggcagcgaccctgccacctacaacggcttcctggagatcatgaaggagttcaaaagccagagcatcgatactcctggagtcatcagacgtgtctcgcagctcttccacgagcaccctgacctcattgttggattcaacgcttttcttcccctcggatatagaatagacattcccaagaatggcaagttaaacatacagtcgcctctgacaagccaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctgttcacaggaaacgggccgtgcgagatgcacagcgtgcagaagaacgagcacgacaagaccccggagcacagcaggaagcgctcccggccctcgctcctccgccccgtgtctgcacccgccaagaaaaaaatgaaacttcgtggtaccaaagacctgtccatcgctgcagtggggaagtacgggactctgcaggaattttctttctttgacaaggtccgccgggtgctgaagagccaggaggtgtatgaaaacttcctccgctgcatcgcactcttcaaccaggagctggtgtctggctctgagctcctgcagctcgtcagcccatttctggggtgagcagctgacttcccagggctccctaggggggttctgttcctgtcaactccatctacttggtttttagttactgtttttgagcaatgattgtgcttttctaaaatcctgtttattaattgacgtgattgatataattattgattcccatgcatttgtaaggagcaatacaccacctgggtaccctccagctggttcctttaccagtaacatctgtagtcagtatcctcaccagaatacagtgggtcctcgagtaatgccttttcatttaacactgttttaacaccgatgagaaaagaagacattcatttctggtctgagtggagtttgcacgttctccccatgtctgcgtggattttctcccacatcccaaagatgtgcatgttaggttaagtctaggttaagcggtgagtctccgtggtcccagcctgagtgagtgtggcggggtgagcgccctgcagtggggtggcgtcctgtccagggtgggtgccccactggtgctctgagctgctgggatagggtccggccacccaagatcctgaactggaataattgggtaaattgttattttacttgtttttactcatctttcttatctgtatgtgtggcttgcatttatttcagtgtttaatattagaagtgttttggtctctctttagaaatttggtgattgttttgtgaccaaaaatacgccgtaggaacgtcattcttgtttatgtgtcaattagcttgtggcaaaattggttttgttacacatcttttcaacttaaagacacagctttctaacacctgttgatgatgttgagtgaggacttactgtactgactctcacacaacccccgttctttccagactctccgtgttcctcatacacgtctggtgtgtgtgtttttatacagctttctcactgtggagggttgtgcgtccgccacagtgaagatactgaacggctccaggctggtctcgaactcctgacctcaagcagtctgcctgcctcggtctcccaacgtgctgagattatgggcgtgagccaccatgcctggccatgattcttttttttaatggttcttgcacatggtgggtgcacatattaacatgatcagtccattcagtccttagcccttttcccatttaccccagggatagtagttgacagcacttgtggctgtagcgttcaccccaagataactttgccatgaagcatctcatttttattattatttttgcattgctgtcatatat

SEQ ID NO: 22698 - DNA, 1147 bp, Homo sapiens
ggcgcagctccgacttcggacatggcgcacgctggcggtggcagcggtggcagcggtgccggcggccccgcgggccgggggctgagcggcgcccgctggggtcgctcgggctccgcaggccacgagaagctgccggtgcacgtagaagacgccctcacctatctggaccaggtgaagatccgctttggcagcgaccctgccacctacaacggcttcctggagatcatgaaggagttcaaaagccagagcatcgatactcctggagtcatcagacgtgtctcgcagctcttccacgagcaccctgacctcattgttggattcaacgcttttcttcccctcggatatagaatagacattcccaagaatggcaagttaaacatacagtcgcctctgacaagccaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctgttcacaggaaacgggccgtgcgagatgcacagcgtgcagaagaacgagcacgacaagaccccgatgctgacccgtcctcctgggctccccacccccgctccccaagtgtcacacaggcactttgtacacatcctggttttctaagaagggaacttgccatcaagattcctgtaccaggcccacggccgtctcgggcagagccacctgggccccgggtgcagccggagaccccgccgagcccctcctcccagtattcccatccccgcatgcttctagggagcgcctcttttccgttcttgaggaatttctgttctggggcttgtccttcctttgcagctgttttgaatgtagttttccttttctatttatttgcacattaaagttaataattgaatattga

SEQ ID NO: 22699 - DNA, 323 bp, Homo sapiens
ggccagattaggcagcctcggagggtggcagtgaacaccagctactcgggtttcctggtgattcccacatttgccccaggggtggcaggtgagggctgttgggccccatgggggcatttgttggggctctgtcatgccagagtttggcctgcgtgactttgcgctctccaggaggcatatggatgaggcggtgtgtctccgcaggtgaagtggagctggaggagtactacccggccttcctggacatggtgcggagcctgctggagggcagcatcgaccccacgcagtacgaggacaccctacgcgagatgttcaccatccat

SEQ ID NO: 22700 - DNA, 5036 bp, Homo sapiens
ggcgcagctccgacttcggacatggcgcacgctggcggtggcagcggtggcagcggtgccggcggccccgcgggccgggggctgagcggcgcccgctggggtcgctcgggctccgcaggccacgagaagctgccggtgcacgtagaagacgccctcacctatctggaccaggtgaagatccgctttggcagcgaccctgccacctacaacggcttcctggagatcatgaaggagttcaaaagccagagcatcgatactcctggagtcatcagacgtgtctcgcagctcttccacgagcaccctgacctcattgttggattcaacgcttttcttcccctcggatatagaatagacattcccaagaatggcaagttaaacatacagtcgcctctgacaagccaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctgttcacaggaaacgggccgtgcgagatgcacagcgtgcagaagaacgagcacgacaagaccccggagcacagcaggaagcgctcccggccctcgctcctccgccccgtgtctgcacccgccaagaaaaaaatgaaacttcgtggtaccaaagacctgtccatcgctgcagtggggaagtacgggactctgcaggaattttctttctttgacaaggtccgccgggtgctgaagagccaggaggtgtatgaaaacttcctccgctgcatcgcactcttcaaccaggagctggtgtctggctctgagctcctgcagctcgtcagcccatttctggggaaatttccagaactctttgcacagttcaagtccttcctgggggtaaaagagctgtccttcgcgccacccatgagcgacagatccggggacgggataagccgggaaattgattatgcatcctgcaagcgcataggatccagctaccgggcactccccaaaacctaccagcagcccaagtgcagtgggaggacagccatctgcaaggaggtactgaacgacacctgggtctccttcccttcctggtctgaggactccacgttcgtcagctccaagaagacaccgtacgaggagcagcttcaccgctgtgaggacgagcgcttcgagttagacgttgtcctggagacgaacctggccacaatccgtgtgttggaaagtgtgcagaagaagctgtctcggatggcgccggaagaccaggagaagttccggctggacgactccctgggaggcacgtcggaggtgatccagcgccgtgccatttatcgcatctatggcgacaaggccccggagatcatcgagagcctcaagaagaaccctgtcaccgctgtccccgttgtcctgaaaagactgaaggccaaggaagaggagtggcgggaggcccagcagggcttcaacaagatctggcgggagcagtatgagaaggcgtacctcaagtcccttgaccaccaggctgtgaacttcaagcagaacgacaccaaggccctgcgctccaagagcttgctcaacgagatcgagagcgtctacgacgagcaccaggagcagcactcggagggccgcagtgccccctctagcgagccgcacctcatctttgtgtacgaggaccggcagatcctggaggacgcagcagcgctcatcagctactacgtgaagcggcagccggccatccagaaggaggaccagggcaccatccaccagctgctgcaccagttcgtgcccagcctcttcttctctcagcagctggacctgggcgcctccgaggagtcagctgatgaggaccgggacagcccccaggggcagaccacagaccccagtgagcggaagaagccggcgccaggaccccacagtagccccccagaggagaagggggccttcggggatgccccggccactgagcagccacccctgccgcccccagccccgcacaagcccctggacgatgtctacagcctattttttgccaacaacaactggtacttcttcctgcgcctgcaccagaccctgtgctccaggctgctgaagatctaccgccaggcgcagaagcagcttctggagtatcggaccgagaaggagcgggagaagctgctgtgtgagggccgcagggagaagggcagcgaccccgccatggagctgcggctgaagcagcccagtgaagtggagctggaggagtactacccggccttcctggacatggtgcggagcctgctggagggcagcatcgaccccacgcagtacgaggacaccctacgcgagatgttcaccatccatgcctacgtgggcttcaccatggacaagctggtgcagaacattgcgcggcagctgcaccacctcgtgagcgatgacgtctgcctgaaggtggtggagctctacctgaacgagaagaagcggggtgccgctggtgggaacctgtcctcccgctgcgtccgcgctgctagggagaccagctaccagtggaaggctgagcgctgcatggccgacgagaactgcttcaaggtgatgttcctgcagcgcaaagggcaggtgatcatgaccatcgagctcctggacaccgaggaggcccagacggaggaccctgtggaggtccagcacctggctcggtacgtggagcagtatgtggggaccgagggcgcgtccagctcgcccactgagggcttcctcctgaaacctgtgttcctgcagaggaacctcaagaagttccgccgccggtggcagagcgagcaggcgcgggccctgcgcggtgaggccaggagctcctggaagcggctggtgggcgtggagagcgcctgcgacgtggactgccgcttcaagctcagcactcacaagatggtgttcatcgtgaactccgaggactacatgtaccgtcgcgggaccctctgccgggccaagcaggtgcagcccctggtcctgctccgccaccaccagcactttgaggagtggcacagccgctggctggaggacaatgtgacggtggaggcggctagcctggtgcaggactggctgatgggtgaggaggacgaggacatggtaccctgcaagacgctgtgtgagacagtgcacgtgcacggcctgcccgtgacccgctaccgcgtgcagtacagccgccgcccggcctcgccctgacccgccctcatgggcaccgggcaggcgcctcacagagcacagacgtgccctcggccttggtcgtgtcggggccgttttcttgaacgacgtgagaggcatctcccagcccctctgctgccggacagcgcactccagggcaggacgccgcccccgtggctcccggtctcctgtgggcctgctgtgtgccaaacctgagctacctgcacccgagccctggggctcagccccaccacaggggcgggtggacgtgctggccgaggaacaagcaatcatgtttgcgtccccgtccgtcacatgtgccaaatccctggcaggcagatggctcctgccccatattcttgccgtgtcttggaaaagtcacaggtgacagccctcctgaggcccacactttggagggggtccatgtccaagagaccctgacaaggaaggagttgagccctgggtaggcttgcttgaaaagtgagtccttccagaatattctcagagctgccagaaacatcatctgagggtttgggcatcagctctgcctggctggtgttcaggccctcagtcactttggaagtgagaagaacccttcagccaaacctttgggatcccattttgaagtccagagctggagcaggcgggcagtgccctgggagaccccgctctggataagacacccaaccccaactccagcagctggactctgggcccacaaggggagggaccccagccagtattccctcagagccggcacgaccctgctgtggggcggcgggcccagtcgtgttcctgcagtgggcaccctaggcgtatgtgtatacacgcacagatatttattcctttcgcttttagtggttgttatttctgtagcagccaagtcctgcggctccctggggctgagatctccctttgtggaactccgagagccgccctgacagtcccagccgccacccaaggagccccatccgcccacccaccctgggacccacgcggccactccagggatcattgttgtccttttgtgaggggctgaggcgactgtcccatggaggcatccaaggctttctgtgccaagaatcccaagtgactggggctggggaccacttctccaggcctctctccccgaccatgagagcccctggccctggcccctgcacaccagtaggcccagaataaccgccacccttgccatcctgcaacagctggactcaagtttccaggaagtggagatgtgtttctagaagtttcctgtggaacctggaggctcctgacgcctttgactccaggctgggcgattccgatgctgacccgtcctcctgggctccccacccccgctccccaagtgtcacacaggcactttgtacacatcctggttttctaagaagggaacttgccatcaagattcctgtaccaggcccacggccgtctcgggcagagccacctgggccccgggtgcagccggagaccccgccgagcccctcctcccagtattcccatccccgcatgcttctagggagcgcctcttttccgttcttgaggaatttctgttctggggcttgtccttcctttgcagctgttttgaatgtagttttccttttctatttatttgcacattaaagttaataattgaatattga

SEQ ID NO: 22701 - DNA, 6949 bp, Homo sapiens
ggcgcagctccgacttcggacatggcgcacgctggcggtggcagcggtggcagcggtgccggcggccccgcgggccgggggctgagcggcgcccgctggggtcgctcgggctccgcaggccacgagaagctgccggtgcacgtagaagacgccctcacctatctggaccaggtgaagatccgctttggcagcgaccctgccacctacaacggcttcctggagatcatgaaggagttcaaaagccagagcatcgatactcctggagtcatcagacgtgtctcgcagctcttccacgagcaccctgacctcattgttggattcaacgcttttcttcccctcggatatagaatagacattcccaagaatggcaagttaaacatacagtcgcctctgacaagccaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctgttcacaggaaacgggccgtgcgagatgcacagcgtgcagaagaacgagcacgacaagaccccggagcacagcaggaagcgctcccggccctcgctcctccgccccgtgtctgcacccgccaagaaaaaaatgaaacttcgtggtaccaaagacctgtccatcgctgcacagttcgtgcccagcctcttcttctctcagcagctggacctgggcgcctccgaggagtcagctgatgaggaccgggacagcccccaggggcagaccacagaccccagtgagcggaagaagccggcgccaggaccccacagtagccccccagaggagaagggggccttcggggatgccccggccactgagcagccacccctgccgcccccagccccgcacaagcccctggacgatgtctacagcctattttttgccaacaacaactggtacttcttcctgcgcctgcaccagaccctgtgctccaggctgctgaagatctaccgccaggcgcagaagcagcttctggagtatcggaccgagaaggagcgggagaagctgctgtgtgagggccgcagggagaagggcagcgaccccgccatggagctgcggctgaagcagcccagtgaagtggagctggaggagtactacccggccttcctggacatggtgcggagcctgctggagggcagcatcgaccccacgcagtacgaggacaccctacgcgagatgttcaccatccatgcctacgtgggcttcaccatggacaagctggtgcagaacattgcgcggcagctgcaccacctcgtgagcgatgacgtctgcctgaaggtggtggagctctacctgaacgagaagaagcggggtgccgctggtgggaacctgtcctcccgctgcgtccgcgctgctagggagaccagctaccagtggaaggctgagcgctgcatggccgacgagaactgcttcaaggtgatgttcctgcagcgcaaagggcaggtgatcatgaccatcgagctcctggacaccgaggaggcccagacggaggaccctgtggaggtccagcacctggctcggtacgtggagcagtatgtggggaccgagggcgcgtccagctcgcccactgagggcttcctcctgaaacctgtgttcctgcagaggaacctcaagaagttccgccgccggtggcagagcgagcaggcgcgggccctgcgcggtgaggccaggagctcctggaagcggctggtgggcgtggagagcgcctgcgacgtggactgccgcttcaagctcagcactcacaagatggtgttcatcgtgaactccgaggactacatgtaccgtcgcgggaccctctgccgggccaagcaggtgcagcccctggtcctgctccgccaccaccagcactttgaggagtggcacagccgctggctggaggacaatgtgacggtggaggcggctagcctggtgcaggactggctgatgggtgaggaggacgaggacatggtaccctgcaagacgctgtgtgagacagtgcacgtgcacggcctgcccgtgacccgctaccgcgtgcagtacagccgccgcccggcctcgccctgacccgccctcatgggcaccgggcaggcgcctcacagagcacagacgtgccctcggccttggtcgtgtcggggccgttttcttgaacgacgtgagaggcatctcccagcccctctgctgccggacagcgcactccagggcaggacgccgcccccgtggctcccggtctcctgtgggcctgctgtgtgccaaacctgagctacctgcacccgagccctggggctcagccccaccacaggggcgggtggacgtgctggccgaggaacaagcaatcatgtttgcgtccccgtccgtcacatgtgccaaatccctggcaggcagatggctcctgccccatattcttgccgtgtcttggaaaagtcacaggtgacagccctcctgaggcccacactttggagggggtccatgtccaagagaccctgacaaggaaggagttgagccctgggtaggcttgcttgaaaagtgagtccttccagaatattctcagagctgccagaaacatcatctgagggtttgggcatcagctctgcctggctggtgttcaggccctcagtcactttggaagtgagaagaacccttcagccaaacctttgggatcccattttgaagtccagagctggagcaggcgggcagtgccctgggagaccccgctctggataagacacccaaccccaactccagcagctggactctgggcccacaaggggagggaccccagccagtattccctcagagccggcacgaccctgctgtggggcggcgggcccagtcgtgttcctgcagtgggcaccctaggcgtatgtgtatacacgcacagatatttattcctttcgcttttagtggttgttatttctgtagcagccaagtcctgcggctccctggggctgagatctccctttgtggaactccgagagccgccctgacagtcccagccgccacccaaggagccccatccgcccacccaccctgggacccacgcggccactccagggatcattgttgtccttttgtgaggggctgaggcgactgtcccatggaggcatccaaggctttctgtgccaagaatcccaagtgactggggctggggaccacttctccaggcctctctccccgaccatgagagcccctggccctggcccctgcacaccagtaggcccagaataaccgccacccttgccatcctgcaacagctggactcaagtttccaggaagtggagatgtgtttctagaagtttcctgtggaacctggaggctcctgacgcctttgactccaggctgggcgattccgatgctgacccgtcctcctgggctccccacccccgctccccaagtgtcacacaggcactttgtacacatcctggttttctaagaagggaacttgccatcaagattcctgtaccaggcccacggccgtctcgggcagagccacctgggccccgggtgcagccggagaccccgccgagcccctcctcccagtattcccatccccgcatgcttctagggagcgcctcttttccgttcttgaggaatttctgttctggggcttgtccttcctttgcagctgttttgaatgtagttttccttttctatttatttgcacattaaagttaataattgaatattgaaaaaaaaaaaaaaaaaactcgagactagttctccccccatccctcaaattggcagcaccccagagttacccggtgacctggccaggctctgggcgtgaggccttcaccaatccaagggctattagtacagacgtgtaaatccttccaccccgacccgcacacacacccacactgctgccctggcgggggccatgggggtgatgaatgaccctccaacagccccacatgggttgtttctgtttctttggcttttctcgctccgcagtggagggtttactaggatttaagcttttgagtgcattgagaaccaagacagggcctggctccaactctgtgggccagaggtgggggactgctaggtcgagtctgcagcttcgccagtttcttggttgggacactcctctggcagccccagcaccaccacaaccccttgcagtgtgccccagtcccctggattcgctggactgcaaaaaggagcaccagggaaagctcagcaaaggctcaggaggcctcccgggtcctcgggagatgaagcatccgtgcctaggaaaaggggacagagggcaaggagagaagtgagagctacaattccagcattggagaagcgaggggcggggcgtcaacggcactgcttcaggacgcgcttgctgaaacgactccaacagctagttcacagcccagctttgtacgttggttaccatagctactgctgtcactgtagctgctcccgtagggtcgttgattcctgaacgtatcacatctcacctgcccccttcctcgtgggacgtgtcaagttgactttaaagcctaaggtggcttgtggggactgcaccagaaagtgtctaaccttgtgttccccgaaatcctttctctgacttaggaaccagcgccccctgctggagaagttttttcattttgttagccgacttctggtagcttagcaaagagaccagctgactgtctctcggcccagcccaccacgccgagtagcttgtgtggatgcagtcctgtgagggtgtgcataaccgttcccaggtgtacgcacgcgcgcgcgcgcgcacagacacacacacacacacacacacacacacacacacagtaaccacgggtaggcaccaggggctttgtacattcaggagctgcagagaggaaaggtctcccatgtaccagagaaggaaaagtctgatcccgaaacagcttgaacgaaaggtggttaacacgtgaccaatccccatggcagacagcgggctggtgaacaggaagagcacagaatctctgtggggcgatgctgcagcggctgaaaccacgtcaagtcccccagagcccggcattctatgtaagcatccacctgtgacgccgtggagcaggatcttcattcatctcaccagagcaacagcccagtcctgaggatgggagggacgtgacttagccttgggattccacgctcgccgccctcccttggccgccctactccccagtttcctggcgatgagccatttattgtgtctcacaccagcctcatttccaactccgacttcctacttagaatgtggcagtggctttgtgagtgagaatcctgatgagttttccagtggcctctgcagaagctggcccccttctaagggcatagctaacccccttcccactcctgagtcactgaattcgaggagggtggggcagggaaagggctggcccccctgctgaaatcttgattctgcatttgaggaaggtcagggtgccgctgggggagcagggagcggggagggaggaagaggggaatgcacatcttttgcgccactattaaggcacctgtcaccttacatctcaatctggaatcaaagtgccctgggttgagaagcagacctgggctctggtcacactttggtcactcattagctctaggaccagtcactaatctctgagactccattttctccagggaaacgaggcttgcccagatagactaacaaccctttagtgctccaagaagtgagaatttccgaaaaagatctgccggcccagagcactccctcttgccctaatcctggcagggtctggatgtatttacccaactctgatcttgcgtgcagggatgcttgctgatggatgaaagaccacaataaaacaagattagcagcaaaacaattttaattgtcagtgaaaagcaaacatgtttgtcagactctcctgtggagtcatttcaaatggtaactcttctcttgtaccaggaagcagctgtaggtggggtaatgggatctgtctcctggtgcagaggggcagcttatggcggcagcagcttcaacaagcccgtcccacggccagccctaactgggccaagtgcaagctcctgatgagctgctgggcctggcagcgttccccacttcctagtgccttgctcccctggaattccacagccaatcaaccacagcagccgtgtcctccttgccagaaataacatcattcgtacgtcctgcctttgtaaaaatcaagacccagttaaccatcacccacttcttgcccctgattgatggggtccctgagtacaagcgtcctgtgcaatcccctccctcctaccgctttcctagctaagccctgctagccccacaaatcagaatctgggtttggggtgctggagagatggtgggccccagctcttccccacatagcccacgctgctcagggcacggtctccaaccaggctcgagattgcctgcctgcccgctgcagccgcagggccccaccctgtggaaaaggaagcttcccccactcaactgcactgtccttttctgctgtctagtctgtgctaagggacactacttgtacacttttcaaacggtgccctaaattggaagagaaggaggggccaggaacacagccctctccgccgtctttctccacctccacttcaccactcctgctctagacttcttgtcttgcatctttgataacttggagtcataaccgagtggatgtcggaataaatgagagatttgaagtag

SEQ ID NO: 22702 - DNA, 6968 bp, Homo sapiens
ggtggttctggaaccaatctcccaggataccaagggagtgtccacttgaccaaagtcatgtttttccttaaaaactttatgcaccttcccatttgtataaggcagttggtattatgtatcaggatggtattatgtatcttggtactttctacactggctaacagtaaatcttggctcctggggcatgcagcgtcattcacggcatttcctcttggtgcaggtactgaacgacacctgggtctccttcccttcctggtctgaggactccacgttcgtcagctccaagaagacaccgtacgaggagcagcttcaccgctgtgaggacgagcgcttcgagttagacgttgtcctggagacgaacctggccacaatccgtgtgttggaaagtgtgcagaagaagctgtctcggatggcgccggaagaccaggagaagttccggctggacgactccctgggaggcacgtcggaggtgatccagcgccgtgccatttatcgcatctatggcgacaaggccccggagatcatcgagagcctcaagaagaaccctgtcaccgctgtccccgttgtcctgaaaagactgaaggccaaggaagaggagtggcgggaggcccagcagggcttcaacaagatctggcgggagcagtatgagaaggcgtacctcaagtcccttgaccaccaggctgtgaacttcaagcagaacgacaccaaggccctgcgctccaagagcttgctcaacgagatcgagagcgtctacgacgagcaccaggagcagcactcggagggccgcagtgccccctctagcgagccgcacctcatctttgtgtacgaggaccggcagatcctggaggacgcagcagcgctcatcagctactacgtgaagcggcagccggccatccagaaggaggaccagggcaccatccaccagctgctgcaccagttcgtgcccagcctcttcttctctcagcagctggacctgggcgcctccgaggagtcagctgatgaggaccgggacagcccccaggggcagaccacagaccccagtgagcggaagaagccggcgccaggaccccacagtagccccccagaggagaagggggccttcggggatgccccggccactgagcagccacccctgccgcccccagccccgcacaagcccctggacgatgtctacagcctattttttgccaacaacaactggtacttcttcctgcgcctgcaccagaccctgtgctccaggctgctgaagatctaccgccaggcgcagaagcagcttctggagtatcggaccgagaaggagcgggagaagctgctgtgtgagggccgcagggagaagggcagcgaccccgccatggagctgcggctgaagcagcccagtgaagtggagctggaggagtactacccggccttcctggacatggtgcggagcctgctggagggcagcatcgaccccacgcagtacgaggacaccctacgcgagatgttcaccatccatgcctacgtgggcttcaccatggacaagctggtgcagaacattgcgcggcagctgcaccacctcgtgagcgatgacgtctgcctgaaggtggtggagctctacctgaacgagaagaagcggggtgccgctggtgggaacctgtcctcccgctgcgtccgcgctgctagggagaccagctaccagtggaaggctgagcgctgcatggccgacgagaactgcttcaaggtgatgttcctgcagcgcaaagggcaggtgatcatgaccatcgagctcctggacaccgaggaggcccagacggaggaccctgtggaggtccagcacctggctcggtacgtggagcagtatgtggggaccgagggcgcgtccagctcgcccactgagggcttcctcctgaaacctgtgttcctgcagaggaacctcaagaagttccgccgccggtggcagagcgagcaggcgcgggccctgcgcggtgaggccaggagctcctggaagcggctggtgggcgtggagagcgcctgcgacgtggactgccgcttcaagctcagcactcacaagatggtgttcatcgtgaactccgaggactacatgtaccgtcgcgggaccctctgccgggccaagcaggtgcagcccctggtcctgctccgccaccaccagcactttgaggagtggcacagccgctggctggaggacaatgtgacggtggaggcggctagcctggtgcaggactggctgatgggtgaggaggacgaggacatggtaccctgcaagacgctgtgtgagacagtgcacgtgcacggcctgcccgtgacccgctaccgcgtgcagtacagccgccgcccggcctcgccctgacccgccctcatgggcaccgggcaggcgcctcacagagcacagacgtgccctcggccttggtcgtgtcggggccgttttcttgaacgacgtgagaggcatctcccagcccctctgctgccggacagcgcactccagggcaggacgccgcccccgtggctcccggtctcctgtgggcctgctgtgtgccaaacctgagctacctgcacccgagccctggggctcagccccaccacaggggcgggtggacgtgctggccgaggaacaagcaatcatgtttgcgtccccgtccgtcacatgtgccaaatccctggcaggcagatggctcctgccccatattcttgccgtgtcttggaaaagtcacaggtgacagccctcctgaggcccacactttggagggggtccatgtccaagagaccctgacaaggaaggagttgagccctgggtaggcttgcttgaaaagtgagtccttccagaatattctcagagctgccagaaacatcatctgagggtttgggcatcagctctgcctggctggtgttcaggccctcagtcactttggaagtgagaagaacccttcagccaaacctttgggatcccattttgaagtccagagctggagcaggcgggcagtgccctgggagaccccgctctggataagacacccaaccccaactccagcagctggactctgggcccacaaggggagggaccccagccagtattccctcagagccggcacgaccctgctgtggggcggcgggcccagtcgtgttcctgcagtgggcaccctaggcgtatgtgtatacacgcacagatatttattcctttcgcttttagtggttgttatttctgtagcagccaagtcctgcggctccctggggctgagatctccctttgtggaactccgagagccgccctgacagtcccagccgccacccaaggagccccatccgcccacccaccctgggacccacgcggccactccagggatcattgttgtccttttgtgaggggctgaggcgactgtcccatggaggcatccaaggctttctgtgccaagaatcccaagtgactggggctggggaccacttctccaggcctctctccccgaccatgagagcccctggccctggcccctgcacaccagtaggcccagaataaccgccacccttgccatcctgcaacagctggactcaagtttccaggaagtggagatgtgtttctagaagtttcctgtggaacctggaggctcctgacgcctttgactccaggctgggcgattccgatgctgacccgtcctcctgggctccccacccccgctccccaagtgtcacacaggcactttgtacacatcctggttttctaagaagggaacttgccatcaagattcctgtaccaggcccacggccgtctcgggcagagccacctgggccccgggtgcagccggagaccccgccgagcccctcctcccagtattcccatccccgcatgcttctagggagcgcctcttttccgttcttgaggaatttctgttctggggcttgtccttcctttgcagctgttttgaatgtagttttccttttctatttatttgcacattaaagttaataattgaatattgaaaaaaaaaaaaaaaaaactcgagactagttctccccccatccctcaaattggcagcaccccagagttacccggtgacctggccaggctctgggcgtgaggccttcaccaatccaagggctattagtacagacgtgtaaatccttccaccccgacccgcacacacacccacactgctgccctggcgggggccatgggggtgatgaatgaccctccaacagccccacatgggttgtttctgtttctttggcttttctcgctccgcagtggagggtttactaggatttaagcttttgagtgcattgagaaccaagacagggcctggctccaactctgtgggccagaggtgggggactgctaggtcgagtctgcagcttcgccagtttcttggttgggacactcctctggcagccccagcaccaccacaaccccttgcagtgtgccccagtcccctggattcgctggactgcaaaaaggagcaccagggaaagctcagcaaaggctcaggaggcctcccgggtcctcgggagatgaagcatccgtgcctaggaaaaggggacagagggcaaggagagaagtgagagctacaattccagcattggagaagcgaggggcggggcgtcaacggcactgcttcaggacgcgcttgctgaaacgactccaacagctagttcacagcccagctttgtacgttggttaccatagctactgctgtcactgtagctgctcccgtagggtcgttgattcctgaacgtatcacatctcacctgcccccttcctcgtgggacgtgtcaagttgactttaaagcctaaggtggcttgtggggactgcaccagaaagtgtctaaccttgtgttccccgaaatcctttctctgacttaggaaccagcgccccctgctggagaagttttttcattttgttagccgacttctggtagcttagcaaagagaccagctgactgtctctcggcccagcccaccacgccgagtagcttgtgtggatgcagtcctgtgagggtgtgcataaccgttcccaggtgtacgcacgcgcgcgcgcgcgcacagacacacacacacacacacacacacacacacacacagtaaccacgggtaggcaccaggggctttgtacattcaggagctgcagagaggaaaggtctcccatgtaccagagaaggaaaagtctgatcccgaaacagcttgaacgaaaggtggttaacacgtgaccaatccccatggcagacagcgggctggtgaacaggaagagcacagaatctctgtggggcgatgctgcagcggctgaaaccacgtcaagtcccccagagcccggcattctatgtaagcatccacctgtgacgccgtggagcaggatcttcattcatctcaccagagcaacagcccagtcctgaggatgggagggacgtgacttagccttgggattccacgctcgccgccctcccttggccgccctactccccagtttcctggcgatgagccatttattgtgtctcacaccagcctcatttccaactccgacttcctacttagaatgtggcagtggctttgtgagtgagaatcctgatgagttttccagtggcctctgcagaagctggcccccttctaagggcatagctaacccccttcccactcctgagtcactgaattcgaggagggtggggcagggaaagggctggcccccctgctgaaatcttgattctgcatttgaggaaggtcagggtgccgctgggggagcagggagcggggagggaggaagaggggaatgcacatcttttgcgccactattaaggcacctgtcaccttacatctcaatctggaatcaaagtgccctgggttgagaagcagacctgggctctggtcacactttggtcactcattagctctaggaccagtcactaatctctgagactccattttctccagggaaacgaggcttgcccagatagactaacaaccctttagtgctccaagaagtgagaatttccgaaaaagatctgccggcccagagcactccctcttgccctaatcctggcagggtctggatgtatttacccaactctgatcttgcgtgcagggatgcttgctgatggatgaaagaccacaataaaacaagattagcagcaaaacaattttaattgtcagtgaaaagcaaacatgtttgtcagactctcctgtggagtcatttcaaatggtaactcttctcttgtaccaggaagcagctgtaggtggggtaatgggatctgtctcctggtgcagaggggcagcttatggcggcagcagcttcaacaagcccgtcccacggccagccctaactgggccaagtgcaagctcctgatgagctgctgggcctggcagcgttccccacttcctagtgccttgctcccctggaattccacagccaatcaaccacagcagccgtgtcctccttgccagaaataacatcattcgtacgtcctgcctttgtaaaaatcaagacccagttaaccatcacccacttcttgcccctgattgatggggtccctgagtacaagcgtcctgtgcaatcccctccctcctaccgctttcctagctaagccctgctagccccacaaatcagaatctgggtttggggtgctggagagatggtgggccccagctcttccccacatagcccacgctgctcagggcacggtctccaaccaggctcgagattgcctgcctgcccgctgcagccgcagggccccaccctgtggaaaaggaagcttcccccactcaactgcactgtccttttctgctgtctagtctgtgctaagggacactacttgtacacttttcaaacggtgccctaaattggaagagaaggaggggccaggaacacagccctctccgccgtctttctccacctccacttcaccactcctgctctagacttcttgtcttgcatctttgataacttggagtcataaccgagtggatgtcggaataaatgagagatttgaagtag

SEQ ID NO: 22703 - DNA, 5552 bp, Homo sapiens
gaggagccacctgggcccagctcccagtcacaatttttgcggggacagatgtttcctgctcacctcccgcatcctggtgacagtgaggcattgacccgtgtgtgtccccagggtggtcattggggcctgcagctcccggcacctgccaacaggtccagtgtgtgtgcacattactcagctaggccaaccccattcatttcctggggctaccaccacaatgaccacaaaccacgtggcttcaaacaacagaagtctattccctcaacgtcctggaggtcagcagtccacaaccacagtgtgggccgggcggtgctcctgccaaaggctctggggcggatccttcctgctcttccagcttccgggggcttctggcgctcctcagctgtggcctggttgtcacctggctcggtacgtggagcagtatgtggggaccgagggcgcgtccagctcgcccactgagggcttcctcctgaaacctgtgttcctgcagaggaacctcaagaagttccgccgccggtggcagagcgagcaggcgcgggccctgcgcggtgaggccaggagctcctggaagcggctggtgggcgtggagagcgcctgcgacgtggactgccgcttcaagctcagcactcacaagatggtgttcatcgtgaactccgaggactacatgtaccgtcgcgggaccctctgccgggccaagcaggtgcagcccctggtcctgctccgccaccaccagcactttgaggagtggcacagccgctggctggaggacaatgtgacggtggaggcggctagcctggtgcaggactggctgatgggtgaggaggacgaggacatggtaccctgcaagacgctgtgtgagacagtgcacgtgcacggcctgcccgtgacccgctaccgcgtgcagtacagccgccgcccggcctcgccctgacccgccctcatgggcaccgggcaggcgcctcacagagcacagacgtgccctcggccttggtcgtgtcggggccgttttcttgaacgacgtgagaggcatctcccagcccctctgctgccggacagcgcactccagggcaggacgccgcccccgtggctcccggtctcctgtgggcctgctgtgtgccaaacctgagctacctgcacccgagccctggggctcagccccaccacaggggcgggtggacgtgctggccgaggaacaagcaatcatgtttgcgtccccgtccgtcacatgtgccaaatccctggcaggcagatggctcctgccccatattcttgccgtgtcttggaaaagtcacaggtgacagccctcctgaggcccacactttggagggggtccatgtccaagagaccctgacaaggaaggagttgagccctgggtaggcttgcttgaaaagtgagtccttccagaatattctcagagctgccagaaacatcatctgagggtttgggcatcagctctgcctggctggtgttcaggccctcagtcactttggaagtgagaagaacccttcagccaaacctttgggatcccattttgaagtccagagctggagcaggcgggcagtgccctgggagaccccgctctggataagacacccaaccccaactccagcagctggactctgggcccacaaggggagggaccccagccagtattccctcagagccggcacgaccctgctgtggggcggcgggcccagtcgtgttcctgcagtgggcaccctaggcgtatgtgtatacacgcacagatatttattcctttcgcttttagtggttgttatttctgtagcagccaagtcctgcggctccctggggctgagatctccctttgtggaactccgagagccgccctgacagtcccagccgccacccaaggagccccatccgcccacccaccctgggacccacgcggccactccagggatcattgttgtccttttgtgaggggctgaggcgactgtcccatggaggcatccaaggctttctgtgccaagaatcccaagtgactggggctggggaccacttctccaggcctctctccccgaccatgagagcccctggccctggcccctgcacaccagtaggcccagaataaccgccacccttgccatcctgcaacagctggactcaagtttccaggaagtggagatgtgtttctagaagtttcctgtggaacctggaggctcctgacgcctttgactccaggctgggcgattccgatgctgacccgtcctcctgggctccccacccccgctccccaagtgtcacacaggcactttgtacacatcctggttttctaagaagggaacttgccatcaagattcctgtaccaggcccacggccgtctcgggcagagccacctgggccccgggtgcagccggagaccccgccgagcccctcctcccagtattcccatccccgcatgcttctagggagcgcctcttttccgttcttgaggaatttctgttctggggcttgtccttcctttgcagctgttttgaatgtagttttccttttctatttatttgcacattaaagttaataattgaatattgaaaaaaaaaaaaaaaaaactcgagactagttctccccccatccctcaaattggcagcaccccagagttacccggtgacctggccaggctctgggcgtgaggccttcaccaatccaagggctattagtacagacgtgtaaatccttccaccccgacccgcacacacacccacactgctgccctggcgggggccatgggggtgatgaatgaccctccaacagccccacatgggttgtttctgtttctttggcttttctcgctccgcagtggagggtttactaggatttaagcttttgagtgcattgagaaccaagacagggcctggctccaactctgtgggccagaggtgggggactgctaggtcgagtctgcagcttcgccagtttcttggttgggacactcctctggcagccccagcaccaccacaaccccttgcagtgtgccccagtcccctggattcgctggactgcaaaaaggagcaccagggaaagctcagcaaaggctcaggaggcctcccgggtcctcgggagatgaagcatccgtgcctaggaaaaggggacagagggcaaggagagaagtgagagctacaattccagcattggagaagcgaggggcggggcgtcaacggcactgcttcaggacgcgcttgctgaaacgactccaacagctagttcacagcccagctttgtacgttggttaccatagctactgctgtcactgtagctgctcccgtagggtcgttgattcctgaacgtatcacatctcacctgcccccttcctcgtgggacgtgtcaagttgactttaaagcctaaggtggcttgtggggactgcaccagaaagtgtctaaccttgtgttccccgaaatcctttctctgacttaggaaccagcgccccctgctggagaagttttttcattttgttagccgacttctggtagcttagcaaagagaccagctgactgtctctcggcccagcccaccacgccgagtagcttgtgtggatgcagtcctgtgagggtgtgcataaccgttcccaggtgtacgcacgcgcgcgcgcgcgcacagacacacacacacacacacacacacacacacacacagtaaccacgggtaggcaccaggggctttgtacattcaggagctgcagagaggaaaggtctcccatgtaccagagaaggaaaagtctgatcccgaaacagcttgaacgaaaggtggttaacacgtgaccaatccccatggcagacagcgggctggtgaacaggaagagcacagaatctctgtggggcgatgctgcagcggctgaaaccacgtcaagtcccccagagcccggcattctatgtaagcatccacctgtgacgccgtggagcaggatcttcattcatctcaccagagcaacagcccagtcctgaggatgggagggacgtgacttagccttgggattccacgctcgccgccctcccttggccgccctactccccagtttcctggcgatgagccatttattgtgtctcacaccagcctcatttccaactccgacttcctacttagaatgtggcagtggctttgtgagtgagaatcctgatgagttttccagtggcctctgcagaagctggcccccttctaagggcatagctaacccccttcccactcctgagtcactgaattcgaggagggtggggcagggaaagggctggcccccctgctgaaatcttgattctgcatttgaggaaggtcagggtgccgctgggggagcagggagcggggagggaggaagaggggaatgcacatcttttgcgccactattaaggcacctgtcaccttacatctcaatctggaatcaaagtgccctgggttgagaagcagacctgggctctggtcacactttggtcactcattagctctaggaccagtcactaatctctgagactccattttctccagggaaacgaggcttgcccagatagactaacaaccctttagtgctccaagaagtgagaatttccgaaaaagatctgccggcccagagcactccctcttgccctaatcctggcagggtctggatgtatttacccaactctgatcttgcgtgcagggatgcttgctgatggatgaaagaccacaataaaacaagattagcagcaaaacaattttaattgtcagtgaaaagcaaacatgtttgtcagactctcctgtggagtcatttcaaatggtaactcttctcttgtaccaggaagcagctgtaggtggggtaatgggatctgtctcctggtgcagaggggcagcttatggcggcagcagcttcaacaagcccgtcccacggccagccctaactgggccaagtgcaagctcctgatgagctgctgggcctggcagcgttccccacttcctagtgccttgctcccctggaattccacagccaatcaaccacagcagccgtgtcctccttgccagaaataacatcattcgtacgtcctgcctttgtaaaaatcaagacccagttaaccatcacccacttcttgcccctgattgatggggtccctgagtacaagcgtcctgtgcaatcccctccctcctaccgctttcctagctaagccctgctagccccacaaatcagaatctgggtttggggtgctggagagatggtgggccccagctcttccccacatagcccacgctgctcagggcacggtctccaaccaggctcgagattgcctgcctgcccgctgcagccgcagggccccaccctgtggaaaaggaagcttcccccactcaactgcactgtccttttctgctgtctagtctgtgctaagggacactacttgtacacttttcaaacggtgccctaaattggaagagaaggaggggccaggaacacagccctctccgccgtctttctccacctccacttcaccactcctgctctagacttcttgtcttgcatctttgataacttggagtcataaccgagtggatgtcggaataaatgagagatttgaagtag

SEQ ID NO: 22704 - DNA, 2351 bp, Homo sapiens
ggcgcagctccgacttcggacatggcgcacgctggcggtggcagcggtggcagcggtgccggcggccccgcgggccgggggctgagcggcgcccgctggggtcgctcgggctccgcaggccacgagaagctgccggtgcacgtagaagacgccctcacctatctggaccaggtgaagatccgctttggcagcgaccctgccacctacaacggcttcctggagatcatgaaggagttcaaaagccagagcatcgatactcctggagtcatcagacgtgtctcgcagctcttccacgagcaccctgacctcattgttggattcaacgcttttcttcccctcggatatagaatagacattcccaagaatggcaagttaaacatacagtcgcctctgacaagccaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctgttcacaggaaacgggccgtgcgagatgcacagcgtgcagaagaacgagcacgacaagaccccggagcacagcaggaagcgctcccggccctcgctcctccgccccgtgtctgcacccgccaagaaaaaaatgaaacttcgtggtaccaaagacctgtccatcgctgcagtggggaagtacgggactctgcaggaattttctttctttgacaaggtccgccgggtgctgaagagccaggaggtgtatgaaaacttcctccgctgcatcgcactcttcaaccaggagctggtgtctggctctgagctcctgcagctcgtcagcccatttctggggtgagcagctgacttcccagggctccctaggggggttctgttcctgtcaactccatctacttggtttttagttactgtttttgagcaatgattgtgcttttctaaaatcctgtttattaattgacgtgattgatataattattgattcccatgcatttgtaaggagcaatacaccacctgggtaccctccagctggttcctttaccagtaacatctgtagtcagtatcctcaccagaatacagtgggtcctcgagtaatgccttttcatttaacactgttttaacaccgatgagaaaagaagacattcatttctggtctgagtggagtttgcacgttctccccatgtctgcgtggattttctcccacatcccaaagatgtgcatgttaggttaagtctaggttaagcggtgagtctccgtggtcccagcctgagtgagtgtggcggggtgagcgccctgcagtggggtggcgtcctgtccagggtgggtgccccactggtgctctgagctgctgggatagggtccggccacccaagatcctgaactggaataattgggtaaattgttattttacttgtttttactcatctttcttatctgtatgtgtggcttgcatttatttcagtgtttaatattagaagtgttttggtctctctttagaaatttggtgattgttttgtgaccaaaaatacgccgtaggaacgtcattcttgtttatgtgtcaattagcttgtggcaaaattggttttgttacacatcttttcaacttaaagacacagctttctaacacctgttgatgatgttgagtgaggacttactgtactgactctcacacaacccccgttctttccagactctccgtgttcctcatacacgtctggtgtgtgtgtttttatacagctttctcactgtggagggttgtgcgtccgccacagtgaagatactgaacggctccaggactgtcaagttctggccttgaccttttatctccatcccaaaaccctgcctcaagcagtctgcctgcctcggtctcccaacgtgctgagattatgggcgtgagccaccatgcctggccatgattcttttttttaatggttcttgcacatggtgggtgcacatattaacatgatcagtccattcagtccttagcccttttcccatttaccccagggatagtagttgacagcacttgtggctgtagcgttcaccccaagataactttgccatgaagcatctcatttttattattatttttgcattgctgtcatatat

SEQ ID NO: 22705 - DNA, 1690 bp, Homo sapiens
ggcgcagctccgacttcggacatggcgcacgctggcggtggcagcggtggcagcggtgccggcggccccgcgggccgggggctgagcggcgcccgctggggtcgctcgggctccgcaggccacgagaagctgccggtgcacgtagaagacgccctcacctatctggaccaggtgaagatccgctttggcagcgaccctgccacctacaacggcttcctggagatcatgaaggagttcaaaagccagagcatcgatactcctggagtcatcagacgtgtctcgcagctcttccacgagcaccctgacctcattgttggattcaacgcttttcttcccctcggatatagaatagacattcccaagaatggcaagttaaacatacagtcgcctctgacaagccaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctgttcacaggaaacgggccgtgcgagatgcacagcgtgcagaagaacgagcacgacaagaccccggagcacagcaggaagcgctcccggccctcgctcctccgccccgtgtctgcacccgccaagaaaaaaatgaaacttcgtggtaccaaagacctgtccatcgctgcagtggggaagtacgggactctgcaggaattttctttctttgacaaggtccgccgggtgctgaagagccaggaggtgtatgaaaacttcctccgctgcatcgcactcttcaaccaggagctggtgtctggctctgagctcctgcagctcgtcagcccatttctggggaaatttccagaactctttgcacagttcaagtccttcctgggggtaaaagagctgtccttcgcgccacccatgagcgacagatccggggacgggataagccgggaaattgattatgcatcctgcaagcgcataggatccagctaccgggcactccccaaaacctaccagcagcccaagtgcagtgggaggacagccatctgcaaggagcttgaccattggacacttctccagggttcgtggacagacgattactgcatgtccaagttcaagaatacctgctggattccaggatatagtgcaggggtcagcaaactctggcccacgggccctggcccgctgcccgtgtttgtaaataaagttttactgtcacacagacacaaccattcctttacatattgcctgtggctgcttttctcaccacaaaggcagagttgagtattcatctgggatggcctgcaaaatctgagatggttgctgtctgaccctttgcagagagaatttaccaatgtctgaaatgaaatcggccctccggatctgcaagttcctcatctgtggtttcaactaaccatggattgaaaatacgtggggaaagagaaaccaaaaaatgaca

SEQ ID NO: 22706 - DNA, 1319 bp, Homo sapiens
ggcgcagctccgacttcggacatggcgcacgctggcggtggcagcggtggcagcggtgccggcggccccgcgggccgggggctgagcggcgcccgctggggtcgctcgggctccgcaggccacgagaagctgccggtgcacgtagaagacgccctcacctatctggaccaggtgaagatccgctttggcagcgaccctgccacctacaacggcttcctggagatcatgaaggagttcaaaagccagagcatcgatactcctggagtcatcagacgtgtctcgcagctcttccacgagcaccctgacctcattgttggattcaacgcttttcttcccctcggatatagaatagacattcccaagaatggcaagttaaacatacagtcgcctctgacaagccaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctgttcacaggaaacgggccgtgcgagatgcacagcgtgcagaagaacgagcacgacaagaccccggagcacagcaggaagcgctcccggccctcgctcctccgccccgtgtctgcacccgccaagaaaaaaatgaaacttcgtggtaccaaagacctgtccatcgctgcagtggggaagtacgggactctgcaggaattttctttctttgacaaggtccgccgggtgctgaagagccaggaggtgtatgaaaacttcctccgctgcatcgcactcttcaaccaggagctggtgtctggctctgagctcctgcagctcgtcagcccatttctggggaaatttccagaactctttgcacagttcaagtccttcctgggggtaaaagagctgtccttcgcgccacccatgagcgacagatccggggacgggataagccgggaaattgattatgcatcctgcaagcgcataggatccagctaccgggcactccccaaaacctaccagcagcccaagtgcagtgggaggacagccatctgcaaggaggtagcgctccctggggctcaaatgttcgttga

SEQ ID NO: 22707 - DNA, 1455 bp, Homo sapiens
agcatttatcctttgagttatagacatattttacatttgaataaaaaatatttgaactaaggccgggtgcggtggctcacacctgtaatcccagcactttgggaggccaaggcgggtggatcatgaggtcaggagtttgagaccagcctgaccaacatggtgaaaccccgtctctactaaaaatacaaaaattagctgggtgtggtggggctcgcctgtaaccccagctactcaggagactgaggcaggagaatcgcttgaacctgggaggtggaggttgcagtgagtcgaggtcacaccactgcactccagcctgggcgacagagcgagactccatctcaaaaaaaaaaaaaaaaaaaaaaaatatatatatgtatatatatatatatatatatgtatatatgaactaatttatttaggcttaatctctaaaatttcagcctgatcttaaccaatgaaatttcaaaaacaaaaactgtacttcagtctacaattgaatggaattcagtgtagaccagtacaatggaatgtactggctgagatgggagggtcccttgagcccaggagtttgaggctgtagtgagctgtgattgtgtctgtgaatagtgactgcactccagcctaggtgacatagcaagatgccatctcaaagaaatatagatatataacataaaataaataactttatacatttcctggaggaaaagtactctgtaaattcaagagatctgaatcaaattactcaaccttttggaatttgatcctctactgtaatactcatatgctagattactgaattttcagagtgaaaaaaaattgacagggtaatatataggccatattatagtgaagatcataagtataaatgtcctcgtttaatctttccatattgaggacagcctctgcatataaaaatgttcattgggagaaaaattatttttaaaactaaatttttatagtagtcctccattactggcaattaaggagcaacccacaaaatgtcattatgtggttctttgattaggcataaaaagtattgcaaacagcttttctattcctttggaatatgaatctttttaatgtctaaagttaacctgcaacattttctagtaggacaagtcaatgtaaattaggtaatttttgcctgttttataccttctgttgcattttgttcaaatgaaaacattttttaaaacatgattgaatttttacttctcagataattggtttgagtgtggaatttcttttttaacactttgatatgtaagttagtgtaaattaatacttttataacactactaggctttatatttttatggaatgttttaaaatttgaaatttttgaagtgttaatttagcagtactttatcattatgtgccaatactgacaagaaaaacaattttttatgtatttaatatactatggtattcaataaattctattttaaaataaaa

SEQ ID NO: 22708 - DNA, 1372 bp, Homo sapiens
aatttccagtaactcctttttgcagtagctgctattaactagttccctttgaaacctcttttaaaagtaaaaatcaggccaaagtgctgggattacaggtgtgagccactgtgcccggccttgatcattttaaattcataaataatacttagcccctgagtaattataataaatatataattaatgcatatatcacccatagttaattaggaatattttattggcttaatgagcaaaatatgatcataaaatataagccatcatagcccagatgtatagcaataaaagagcttagattataatatctcacaatacaagtctgcattagcaatgacactgttataaaatatttataacactttctgatttaattttaaagagattcattcagtatctttttggcatttgaaatgaaaccttattttccctccacacaatagctgattaaaaacagcttttgaagaggtcccaggcaacacacacagaggggaaatggttagatacgtggggcatctttgtattttcacattaaaattcaatgttattcagacccaagtagatagataataaaagtggcattcaagttgggaatggtagcacaagcctgtagtctcagctactcaggaggctgaaatgggaagatcacttgagcacaggagtttgaggttttagtgcactgtgattgcacctgtgaatagccactgcacttcagcctgagtaacatagcaagaccccatctctttttttaaaatgttacatttataatcagtgaggaaaatataaactatacaataaatgaaagggtcattggccaattgtttggagggaaaaaatacaccatgttctaaaataaatttctagtgatttattgtgactttcatgcatttggatgattttaaagattttatataaaaatgaaaccatagccttacgagaagaaaatataaagaaaaacttgtatagtcttgggaggggggattatattatgtgaaacattaagtaaaatatttattttttaaatattaaaaaactaaaaactgtgctttagaagtcaccaaaaaattaaagggcaggctgggcatggtggatcacacctgtaatcccagctttgggaggctgaaatgggagaatcacttgaggcggggaagttcgagaccagcctgtgcaatataacaagacccccatctctccaaaaaaaaaaaaaaaaaaaaaaaaaagccaggcataatggcgtgtgcctatagtcctagctactcaggaggctgagatgggatgattgcttgagcccaggagtttgaggccacagtaagctatgattgcactattgcactctagcctgggtaacagtgtgagaacgagaccctgtctcaga

SEQ ID NO: 22709 - DNA, 583 bp, Homo sapiens
gtaaaagtttgtggctggtatccgagttcttttataaactagttgggaagaactgtgggggagagctgatgttccaaacagtagacaagcaggaatggagctgcagaaatgcaaacctgttaccactaccatggcatgcgaaaagaggcttcatataaaatgaaaagcttggacctgaaggtctttagggcccctttccagttctaaaattcaaatggatctaccctatattttgtccccttaggtgaaatagctctgtcctcaaaactaaattgctaagaaccgccttcagagatgacctctctcttccccactaattcctggcagctccccaaaacaaaatgttcggaaaacagaagtcaaccttcctctgtcagtccaaattacctctatgcctcaagccaacaacatgaggttcaggcaccctgatacatactgctaagtgagatgggaagagagagaacttcagaataattggcaatgttgttctagggaatcagtgtagaggtagatcttcccctattatttacctactttccaacttataaaagaaaaaaattagaaaagatcattcaagttgtta

SEQ ID NO: 22710 - DNA, 287 bp, Homo sapiens
actccttgaaaataatctctctgaggagtaagtggttttttctttttgttacagtaacatgaagtggtttccaaatctcatgagaaagaattagagaaaatgatgaaagatccaacggttcattagatattaaaattgacttgatgagaactcaataagagacctttaaaatctctatgtgtgattaaattcttaataaaaagaatctcccaacattttttaaagttgctcaacttgtggcctagatgttggagtctaataaaaacaaatgtcttctaatcccatga

SEQ ID NO: 22711 - DNA, 348 bp, Homo sapiens
gggtctattgtgtgtggatcctgcattcttaacataattttcagaaaatgtatgggttataacaatataaagaaaaatttccaaatttaatttacttctatctagtttggcttattgcagttggggaaaaattaggggcctaaaattaaattgccattttcatcaatttataatgtggcttttaaaaaggaaatggtatatgataaccattacaagatatgttggtttttaaaattttagtgcatacacctgtgccctgggtaactattataaacaaatcttttaaaatattttttattcaagaaaagtatggagcatgattggaaatagtgccttatgaatttgatt

SEQ ID NO: 22712 - DNA, 190 bp, Homo sapiens
gatatttttgtcccatactaaagagatgatcaagggatcctaaaaatattttatttgggtgattttcaaatgtcttttcatagcttaaatttcaatcgtagcttaaggatttcctccctaagtgaaaatagtttcagtttttcaaaaatagaactggtaatgtatggaattcaggtagtaaaaaaaaaaa

SEQ ID NO: 22713 - DNA, 366 bp, Homo sapiens
atgaacttcactagaatcttctctgggagttctcagcagagcaccatctcccagaagactctgtctctaaggagggaagtgaaggagcataaaaggactgattttttaaaaatcagcatttaatctgggcacggtggctcatgtctataatcccagcagtttgggaagccaagacgagaagattgcttgagcccaggagttctagaccagcctgggcaacatagtgagaccccatctctacaatttcttttaatgagccaggcatggtggcgcatgcctgtggtcccagctacttgagaggctgaggtgggaggatggcttgagcccaggaagtcaaggctgcagtaagccgtgatttcgccactg

SEQ ID NO: 22714 - DNA, 1162 bp, Homo sapiens
tggaacaggagaaaattgttaagtgtcaatttgctgccccttttttctgtaagtctatcttctataaagtaatgtagtccctattatcatgatgctatttcactatataacattattttcaatgcctgcatagtaaacacattgtaggggtataggctgaatttacgtaaccagttactgatattagagatgcagagtttttctaattgttttactgacaacagcaacacagaaatctccaacctcacatgcctacatttccactattgacttggaataaattcttacaagtgaaatttagtcaacatatataacttttatgtgacagttggtaaatgttgctaaatcaattttcagaaagcatatgccaatattggttgtacatatttcctgaaatccttgtctgcactaagtagcaacataaaaaaagaaacttttctgagtaataggtgaaagttttatctcactgttttaacttgtacttctgtggttacctgtgaggtttaacgcttttcaaatgattgttggtgttttgcatttttttagtgaataatctgttcgtattcttctttgttttgcaatatgggctttaaaaaacctatttctaattttatgtgttaaaattggtaacacatatagggcagaaatatgtgttaccattctgtagtttggctttggcttgtgttgaaaaggttttagaaagtcaaacagttttttgctttatgtatcatcaggaactgtgaagagctgaggttccacctcctcccaagctgacaagtgaccctcggagaagaaccgtgaaaacctcacaacagtgaagttagtttaaacaagttacaacgacaaacacattgtgccatccttatgatttcacctgttacttagttcacactgatgggtggctggtgtttaaatgctttccaagttcatttcatttattatacaaatgcctgtgaaatacccaggcagcatcattgcttccttctctagcctccaaaccgaatatccttttgctcaagcatccaggtaaaaaaagggggaccttaggaattgtgaatttgaagccagaagccatggtttacctaggaatggatttacttgccaagaactgtgacacctttataaataaagttactcatgttggcttttttgctctttaaat

SEQ ID NO: 22715 - DNA, 1108 bp, Homo sapiens
tggaacaggagaaaattgttaagtgtcaatttgctgccccttttttctgtaagtctatcttctataaagtaatgtagtccctattatcatgatgctatttcactatataacattattttcaatgcctgcatagtaaacacattgtaggggtataggctgaatttacgtaaccagttactgatattagagatgcagagtttttctaattgttttactgacaacagcaacacagaaatctccaacctcacatgcctacatttccactattgacttggaataaattcttacaagtgaaatttagtcaacatatataacttttatgtgacagttggtaaatgttgctaaatcaattttcagaaagcatatgccaatattggttgtacatatttcctgaaatccttgtctgcactaagtagcaacataaatacttctgtggttacctgtgaggtttaacgcttttcaaatgattgttggtgttttgcatttttttagtgaataatctgttcgtattcttctttgttttgcaatatgggctttaaaaaacctatttctaattttatgtgttaaaattggtaacacatatagggcagaaatatgtgttaccattctgtagtttggctttggcttgtgttgaaaaggttttagaaagtcaaacagttttttgctttatgtatcatcaggaactgtgaagagctgaggttccacctcctcccaagctgacaagtgaccctcggagaagaaccgtgaaaacctcacaacagtgaagttagtttaaacaagttacaacgacaaacacattgtgccatccttatgatttcacctgttacttagttcacactgatgggtggctggtgtttaaatgctttccaagttcatttcatttattatacaaatgcctgtgaaatacccaggcagcatcattgcttccttctctagcctccaaaccgaatatccttttgctcaagcatccaggtaaaaaaagggggaccttaggaattgtgaatttgaagccagaagccatggtttacctaggaatggatttacttgccaagaactgtgacacctttataaataaagttactcatgttggcttttttgctctttaaat

SEQ ID NO: 22716 - DNA, 470 bp, Homo sapiens
ggctatgtggcccccagttctccaaagtctccaccactcctcattgtgtgacactcagcccacagcacccatttatgctactagcctggcccctgtcacaagctatgggaaagcaaaaatccaccctaggccaggcactaatcatattttttggattgatgaaggggtagatgaatggatggatgaactttcaagatgctgcattatctcagagcaatgacctatctcagtgcatcaagcctatgttctatggcaaggtgcttcttgaatcagccatagtgtctgaatggtttgtttggaatggaaagtgttgagaaatcagggtgttgtctgatgccagaggtccccacatagggtgcaatctctgtgtggaattgatagaggcgtctgacaggtgggtggggttctggcactaggacagggtgcggggcggggcagtgaggcttcaaggagatggtatcataggatgc

SEQ ID NO: 22717 - DNA, 278 bp, Homo sapiens
caaccccacacaatgcagcctaaacgttccctcaaggtagcacgcaaggtaatcatgcgactcacttcatttgttttctgttcctctgggatcactgtcctttgttcctgatatccgtggtcttgttttacgtattttgcctttgtattgggtggttcaggcaggagggtaaatctaatccctattactccatcttggccagaagttgaagttaacctatggattttgatttgtaatgcactcactcttcttcatttttaatagtctgtatttttagt

SEQ ID NO: 22718 - DNA, 386 bp, Homo sapiens
atccttggtcctagagaaatcattgcaactcatcagtagtggcatctctgagaatcacatccatattattagtatttatcaaaaaagtcattattggccaggtgtggtggctcatgcctgtaatcccagcactttgggaggccgagaccagcaaatcacttgaggtcaggagtttgtgaccagcctggctaacatggtgaaaccccgtttccacgaaaaatacaaaaattagccaggcatggtggcgggcacctgtaatcccagctacttgggagactgaggcagaataatctcttgaacccgagagggggaggctgtagtgaactgagactgcaccactgcagtccagcctgggcaagagagtgagaatctgtctccaaaaaaaa

SEQ ID NO: 22719 - DNA, 259 bp, Homo sapiens
ggtggggatgcatgcaggtttggggttagatgtgattgtgcagttggtcctagccctacttgagggtagctggtgggccttcccatcctgcttctcttaggccggtccatagagaagcaagccccccgtcccctatccagcctaactcagacaactgccctgaatccaagagataatgctctgaccctggccacatttgctcctacaagctgtcccctttctgggagtttctcttgccatgtttttggatccttgatga

SEQ ID NO: 22720 - DNA, 386 bp, Homo sapiens
ttgattgttacctttgctgggctgaaggtttttaatttgatgtaatatctattgcctgtttttgcttttattgccagtgcttttaagttcatatcctaaaaatattcgctgagactaatgtcaaggagcttttcaatcctgtgtgtgcttccagtagatttataatttcaggtcttatgtttaaatcttcaatccattctgagttgattttttgtatggtatgaactaaggatccaatctcattcttctatatgtgaatattcagttttctcaacactattaagaagagtcttctttccccattttgtgttcatggcaactttgttgaaacttaactgaccataatatcatggatttactttggggctctctattcagcttccttg

SEQ ID NO: 22721 - DNA, 478 bp, Homo sapiens
actcttctctgctcttgtagcatgaaagcagccataaatgaatgagcatgggctatgttccagcaaaactttatttacaaaaacaggctgcaggctggatttggcctgtagtttgctggtccttgtttcagacattcctgtcatgatcccctatttgtcacaagagactgtcatatgcttagctaaaatccagatgacttggccgggcgtggtggctcacacctgtaatcctagcactttgggaggccaagacgggcagattgtctgagctcaggagtttgagaccagcctgggcaacgtggtgaaaccccatctctaccaaaatgcaaaaaatcgtccagacgtggtgcgattgcctgtaatcccagctactcgggaggctgaggcacaagaattgcttgaacctgggaggcggaggttgcagtgagccgagtaccacttaactccagcctgggcaacaaagtgaaactatgtctca

SEQ ID NO: 22722 - DNA, 115 bp, Homo sapiens
tgggagaggaacaggttgggggaggaaaatgaagagttcttttctcttctggtttccctgccctcccattcaaaggccaggaaatttctacagctaggcaggatgattggctccg

SEQ ID NO: 22723 - DNA, 692 bp, Homo sapiens
aatctccgcagattcgcccgatatcgcagtgggttttcccgcatggtgccgtctttcgaccggttcgcgcgatttcgtcggttggcggcggattcacagaatgtccggtatcccgggtggtctcgcgttacccgaggacctgcgtaactccgagctaccggagtgattcttccccccggttagcccctcatgtatctctttttgaaaacactcctctctttctccactctaatgatgaccaccgccttgtcttttatggtaatcactgttctttgggttttattactgcatttattggctaatatatgcatccctagaaaatgtagttttgtctgcttttatataaatggaatattactgcatgcagtcttttgatttgtgattgttttgctctaaggcttgtaagggtcatccatgttttgcatatagtttgtttattgtcattgccatagagtaaatcattgtatgaatatactgcagtttatttactgttgacatatgtttcagttgtttttaactactaggaaatgctactctgtacattcttgtatatgtaccttggtgcacatatgtatgtttttctagagtatatacagtggcatgggattgctgaattaaaaggtttgtatatcttatactagaagataataaaaacttttcctgatggattctgccaattcaaaaaaaaaaaa

SEQ ID NO: 22724 - DNA, 432 bp, Homo sapiens
aggctgagcctccccctctggccccccagtaactcccggcgtcacgcccaggccctcgctcaggggatctgagtagaggggaggcctgagtcaggacagccctccaagagtgggcagccaacgagggaccccctgaataaaaaccgcagaggaggtctgcccacctggcgtgggggccagggaggaggtgggcagggggaggggccttgcccgagaccagaggtggctgggggccgagggtcggcaggaagccaggcgaccgatgggcgcagcacagactgcctccacgtggccctgcacagcctggcctcactaggggaagggtgaagacagcagctggcgcttcccctcaaaaaaaccctgggggctcaaggccacccctgaggtctccaggctcctaggaacagggcctgacagggaaaaggctgacag

SEQ ID NO: 22725 - DNA, 438 bp, Homo sapiens
tgaagctagagaattacatgagtctgggaggtggaggttgcagtgagccgagatcgcgccactgcactctagcctggggacagagcgagactccatctcaaaaaaaaaaagaaagaaggctgggcgcagtggctcacgcctgtatcccagcacttcgggaggccgaggtaggcggatcacctgagatcaggagttcaagaccagcctggccaacatggtgaaaccctgtctctactaaaaatacaaaaaaatttaaccaagtgtggtagtgggcgcctgtaatcccagctactggggaggctgaggcaggagaattgcttgaatccgggaggtggaggttgaaatgagccgagattgtgccattgcactccagcctgggcaacaagagcagagagcattagaatcctttaataaagagcacaaacttgcctttaaagc

SEQ ID NO: 22726 - DNA, 572 bp, Homo sapiens
ccagaaaacttaagtaactcacctaagagcacacagctagaaaagctgactgtttcaagtcagcttcaaatcaccctagtgttctcttcctagtcaaatgactcctcaggcccttcatctgtaaatgtaactggtgactgaggcagtcaacatgaccagataattggtaacatcactttctgctcagttagcttttttttttttgagacaagtctcactctgttgcccaggctggagtgcagtggcctgtgatctcagctcactgcaacctccgcctcccaggctcaagcaattcttgtgtctcagcctcccgagtagctgggattacaggcatgtgccaccacgcctggctaatttttttagaaacagggtttcaccatgttggccgggctagtctcaaactcctgacctcaggtgatccgcccacctcagcctcccaaagtgctgggattacaggtgtgagccaccacgcccagcctgctcagttagcttttttaagaagggctagccgggcgcggtggctcacgcctgtaatcccagcattttgggaggccgaggcaggtaaatctcga

SEQ ID NO: 22727 - DNA, 413 bp, Homo sapiens
ataatataataatatatatgggattatagtagggttgggagaaaccctaattagctacattagaggaactcaaaatacagaatgaaatgatggttttaaataaggctagatatcataattagtcccagatggttcctttgtagtcaggagagttttaccaaacagccacatttgttttttttgaatgtcaaaatagaaaacaaattaggctcctgcactgtttcttaatacagcttctctggggctttgctttgtaggccttgtgacatgcccattgagacaaaaagattgtgttctccatgatacactcttcacaaggcagcagatgttctcagaaacaatgtctatgtccttggaaccaagagtttctctttcctcctgactgtaataatattaaacttttttaaaaaacc

SEQ ID NO: 22728 - DNA, 151 bp, Homo sapiens
tccttctatagttcactgctttcaaatcagtaatttgataccaatataggaccatctccctggtttttatgaaatctcttatggagaaaaaggtatcttatatagtcggctttcaaaatttaattgttcccatcgtcaacattcttgccca

SEQ ID NO: 22729 - DNA, 433 bp, Homo sapiens
cagggtttgttgggggaataatgatatgttaattagatagtggtaataattgtagagctttgtgaatatactagaaaccactgaactgcatgctttaaaaatggtgaattttatatgtgaagcatatttcagtaatagtaataaaatacaaaacaatttccgtgcctattgggctgggcatgatggctcatgcctgtattcccagcactttgggaggctgaggcaggtggatcacttgaggttaggagtttgagaccagcctggccaacatggtaaaacaccgtctctactaaaaatagaaaaattagccaggtatggtggcatgcaccacagtgcaatctcagctactcgggaggctgaggcaggataatcacttgaacccagaggtggaggttgcagtgagccaagattgcaccactgcactccagcctgg

SEQ ID NO: 22730 - DNA, 139 bp, Homo sapiens
aacgaggtaatagatatacgtggctctattttattcccttatttctctgcaagtttttcagtttttcaatcttgaacaactttttacacttgttaattataaataaaattatgcattttcattactagtaagggaagaa

SEQ ID NO: 22731 - DNA, 126 bp, Homo sapiens
atcattacaaagacttacccaaagcttttagagtcctgctttatgaagtacgtgcagtagctagaaactgcctcgttaattgaccatgggttcagaagcaccacaatttcccttcccctggaatgc

SEQ ID NO: 22732 - DNA, 568 bp, Homo sapiens
tactctgtatgtagaaaggctgaaaatagtacaactgcagtaattctgtcagctataagggacgtgtggactgagagggtagtcttaatagattgtgatcaactatatgtgaaaacattttgtgtagtgagttgatgtgtagtttacatgtaaactaactcctttagttcgaaaggaattttattttacgttaaaagattattttaggctgggctttagtggctcacgcctataatcccagcattttgaggggctgaggcaggaggatcgcttgagcccaggagttcaagactggcttgggcaaatggtgagactttgtctctaaaaaaattaaaaaattagccaggcatggtggtgcgagcccatggtctcaggtgggatgattgcttgagcccaggtgatagaacaaaaccctatctcaaaaaaaaaaaattttttttttgtatgtatgtaactctttacttatctactacctaataatccacaaaaatacccacaaatccttaattacgtggaggaggaggagatgataatagagatcattttaactttgaaagataatggattc

SEQ ID NO: 22733 - DNA, 774 bp, Homo sapiens
aaatgtaggggatgttattgccaatggaagtggctcttagccggaaggaaagctgggaaagggatggagcagaaaggtatttgtcccctgaagtccagctgtttccagctggactcttttctaaagtcctgccaatcaagccgtccctctgaagtcaagctgcttctctccaacgttcagctgcttcttctcatctccctttctctgctctcagccagtggaacctagggtttttatgggtacaggatggggggcagggtgggtcagagttggttttgggaaaagcaacactcaagtgggaaaacggggatgaaaagttttcactgtgggccatggttccaggcttgaaggtggagccctcgccagggaccctgcccttttctgcctagagcttatctgtctcctatccctatcagtaggaactcaccatctttagtaattcattcagtgtgtgtgtgtatatatctatgtatatgtatagaatatgaacctgtttcttgaaaaatccttctcattactcattaaataccagagatctatataattgagtctggctgtggcagtttgctaatgttaatttgtacacttatgttcccgtgatttagtaattcactccatttgggtgtttttaaaaaaatgtgtacatcaggccaggtgcagtggttcatgcctgtaatcccagcactttgggaggccagggtgggtggatcgcatgagaccatgagttcaagaccagcctgggcaacatggtgaaaccccatctctaccaaaaaa

SEQ ID NO: 22734 - DNA, 784 bp, Homo sapiens
caccaaggaagaagcattttggagccgtgaggatgctctgttggagacactctggatggtgagctgcaggttggcctgggacgttttctagttgttctctgaaatgtctctttttatcctttgctttgataaacaactgattgcccagggaccagtgaagaatcttgatgataaaactcctacttgtagtgaaagaatcatgggatcttttgcattttcttacatcaaaaacgaccttgaactgaaagctctctttaaaaaacaaacaaacaaacaacaacaacaaaaaacccaccctaccctgcatactatcacctgctaaactacccagtgtcagaaggacaacttcagagatgctgtggtggcagctgatagtgcctgacatttagtgagtgctcagcacgtgccgggcgttgttctgaatgcttcatgtggattagttcatttccccttccagcagccctgtgagctcaatactgttattatttacatcccacaggtaaagggaaactggggcacagtaggttgaaaaataacggaaattgagtttgtttgaaaaattttaaggctaaaagccttcagtcttatctaatcacatctatcttttgatttcgggttggatttttcttttgggaatcagtcaaaacccactgtgggttattaagagtagaagatgacttataaagggataatgaggatagcctccttttgctgggaagacagaatttttcattccaaattctaatctccagtgtcaccttgcatgtccatttctggatttata

SEQ ID NO: 22735 - DNA, 772 bp, Homo sapiens
ttagcaccaaatatttattctgataaagtgagtttaaaaaaaaaaaaaactagatcgattattgtctggcttggtctccaaaaacaagtccctgcaattgacagtggttgcatgaacttaagaataatagatccttaggaaggaaggctgttcattcagtcattcaacagaaaattagggtacttctgtgtcactgaggtgcagccccagtgaaatgaactcagaagcctccagtgtttataccactgagactggggcagagtagtctggagtgctgcatgtaaagctaggcactccccagtgatggagcttccagctgcccctaccattcggtgcacaagtgtccctgaacttcggtgaagtatgagccaccaagctccgcccaagggtgaccacagaagtagacaacttacgaaccagaaacatcaaccagcaaccccagacagtttatgtaagattgcttcattccagagagcagaactgggatccatgggcagaagtttcaaggggacagattccagttcgggagagagaagaaccctgtaactcttagaggcgcctttgagcaacgcgctctcaaggtgttccagcagggtgaggatcaccccccagaagtgctgctgggccaagccctgccttgaacaagatcctgaggtctcgcccaacagcaaggttctctggttagcaccaaatgagtggctcaacagttcgtgttgtggagcttcagaggcaggacaagcagtcatgggctgtggttggcggccgcaggccc

SEQ ID NO: 22736 - DNA, 376 bp, Homo sapiens
catgttgtctcccagcacttggtgtgtgtgatatgcagtatgtatttgcagaatgaaaagtctgagggctgacatcatatttcccactgtgcccagaaagagcacagttagtccacatgagctaatgggggcaaagggaagtgaggagggagaatgtactgccttatcatgttttctattacttggctgaagtaaaacagtcccaagccgatagtaagatagtgggctggaaagtggcgacaggtaaaggtgcacctttcttcctggggatgtgatgtgcatatcactacagaaatgtctttcctgaggtgatttcatgactttgtgtgaatgtacacctgtgacctcacccctcaggacagttttgaactggttg

SEQ ID NO: 22737 - DNA, 431 bp, Homo sapiens
gtctcttagaagacaaggtatccaggtatgaaaaccaattttgcagacattgtttaggatactaatggggaaagtcttcagtaacttttgttgaaagaatggatttcctgagtccttacagcatttagttaaataagtgtagatttctagaatcagagctaatattcctagacacttggtttagctgttactaactcatgaaccacagaaagaagaaataccttagaccatgcaagtttgacgatctctgtgaactttaccaactttagtttcagaattccatctttctaccttcccaaaaggttgaaagtgatatggacagtgaagtctgattaattgacagaacttttccatgttaataaaaattccggtaaaatggtttccttgttactagagatatagtttgggattccccaggctgaaaaaaaaaa

SEQ ID NO: 22738 - DNA, 762 bp, Homo sapiens
gaacatttcaattgcttttaccacccacagacaaccattattggatgatttttctcaaatgtttctccattttatttatttatacagtggagatcaaatatgtaaaattttgtttcctacatgtttttttgatttttacctaacaagcatttttccactctatggcaaatcttcatatgcattattttaatagctgcataatattctgttttgcaggtaaattatcttttaggccattttccatgactggacaatatgtggatatactctaatagtaacacacattcgtggcctttctcataaaaaatcattacaaatttccaatttctacaattgctcatggaggacaactaaagccttggctaaaaacttagcgacttaagtgtgaaacacagacacctccccagtaaattgtttacttgtccagaacgcccacctccagccatgtcacagaaccatgtacaactcttccttagagaagcggctctccgccttcattttcttgtctctgttgtaggtaatatatttgacaccaggagagaaaacacggaggacacagaaccaggtttcattgcctagactttgattttagtgacattgttgagtggcatatgtaacttccgtttgaatttccacaaagatccacgtagcatttcaggttcctgcaaagtgtgggtgttctgtcaagcttacctgtcatgtttgaatagtttcatatactttctttgtaatgtgtgataaccaagcctccaatctggtata

SEQ ID NO: 22739 - DNA, 425 bp, Homo sapiens
gccagactcggactgcctggcttgtctcagcacctttggggacccacttcccctctctgggaactggggaagctaacagagatcttgctaggggggtggaatcctgtatccatgtgaggttgtacccccaggctcctgagtggtttgaaagtggggaaccctggccgggcgcggtggctcatgcctataatcccagcactttgggaggctgaggcgggcggatcacaaggtcaggagatcgaaaccatcctggctaacacgatgaaaccccgtctctatgtgcgtggtggctggcacctgtagtcccagctgctcgggagtctgaggcaggagaatggcgtgaacccgggaggcggagcttgcagtgagccgagatcgccccactgcactccagcctgggcgacagagcgagactccatctcaaa

SEQ ID NO: 22740 - DNA, 453 bp, Homo sapiens
gccagaacagagttttaaagactaaataaatttagactttttcatatatatgagccatttcttttgtgaattgcctgctcagtcttcttttttctttgcctattttttcttattgacatctaagagctctttgcttgctaaggttattaaccttttgctacaaatattatgagaattcctttcttggtggggtgcagtgggtaacacctgtaatctcagtgatttggaaggtccaggtgggaggatcacttgaggccaggagttcaagatcagtctgggcgacatagtaagaccttgactctacaaaaaataaaaataaaaaaattagcagagtatgtgacatgtgcttgtagtctagttgcttgggagggtgaggtgagagaatatcttgagcccagtagtttgagattgtggtccagcttggatgacagaatgagaccctccctgcctcta

SEQ ID NO: 22741 - DNA, 1115 bp, Homo sapiens
tcgagacagggtctcactctgttgcccaggctggaattcagtggcgcgatctcgactcactgcaacctcaacttcctgggtttaagcaattctcctgcctcagcctcccaagtagctgggattacaggcactcgccaccacacccggctaatttgtatatttttagtagagacggggtttcactgtgttggtcaggctggtcttaaactcctaactttgtgatctgcccacctcggcctcccaaagtgctgggattaaaggtgtgagccaccgtgcccagccgataactgaatatttttaactactgtctacaggatcatttccaactgatcaataggctagatttcttttatatcggagcttaaacttcctgactcctattactcatcatccttgactcatacccacgagtcatcatctctgggccaggccacagaccatcaatcatttttttcatttagactttgtctatttcatttatttattaatttactactttataataaaagaaatagacatgaatcagaaaaaaaataggacaagagctgtgataaccctgttgtctatctgtagagcagttccctacagaaattagacatgtttcttgaactgacctgattgtttcaaacatgcattactcaacaaaatgtttcatatcaaccccatgttcattttggggacacggttagtcttctttaattatattttctacttattaataatgcattgaccactcttaaatggcccaaaccaagacaagaactttgacgattactcacatttgtctgtaggttcccttaaaacaacccatagagcaagtggtcatggcagaatcagtgccagggagtgactgttctgaggattacaaggaagagcagaagacaaaatttgagattttctatccattaattttttcattctaccttccatttactctgtcagttggtatttattgatttgttaatatttgcttatttcccccttaataaaataaatattgaacttacaattgacccagttgacctgagaattgacctaaaaatcacatagcctttgataactaataatcagtgctattgctctatcagtggctctatgattcttagccagagagt

SEQ ID NO: 22742 - DNA, 429 bp, Homo sapiens
aatataaacactcagaaaaagtgtgatcgttgaagccagttaaggagagcatatcacaaaactagaatgcaagggaagtggagtttgttttgtattttgctgggtcagattaggtaaccaaagcagtgcaaattcaggggagaggaatggctcaggagaatccaaacttggcttctatttttcaatgtaccacttgttctctgtgggatcttagaaaatggcataacctttctgagcctcggtttcctcttctgtaaagaagagtttgttatgcacatttttttaatctacatacggcaccagggaaaaggtggcatacagagtaggcagctactcccagtaccagggcaaacaacagaggtcatggtgtgaagcaggtgagtctgagcatcgtggtcaggggaagcactgcagccaaggatcccggta

SEQ ID NO: 22743 - DNA, 423 bp, Homo sapiens
ctgtacttttttaggtcctttgagtagcattactctttattttaaatgaggcgtacatctaagttagaactataggtgtatttatctctctttgtaaaaatgtgatgaagaacagcatgtcaccacatttgcgcgcataagaaaccatttgggcaggggaacaacgtggaaaagttggattgtgaagttttactctatggttagattaagatcacgcaaattactaagacctcaggactctattttgtatatcgtcatttataacatctttatagaaatgtcatagaattaaatcaacttttggcaacgctcggtagctcacgcctgtaatcccagaatttggggaggctgagtggggatgattgattgctggaggccaggagtttgacaccagcctcgtcaacaacccatctttacaaaaaa

SEQ ID NO: 22744 - DNA, 458 bp, Homo sapiens
gaattgattaggtgctgtcatgtaggaaagtatgcttttgtatgaaagtaataatgtcatttgttcatttttaatattagtaccaaggagaaaaccaaaaagggttcattaacaaatatagcaatatagcatatgcaataataataaattcaaatggtacaaaaagggataaaacaagaagtgaatgccttctttcctctttctagaagtttctctctccaaaggttcttgtggttgtttctagaaaaaagtatttcatggccaggcgcaatggctcatgcttacaatcctagcacttggggaggcccaggtggatggatttcttgagcccaggagttgagaccagcctgggcaacatggcaaaaccccatctctataaaaataaaaataaaataaaaagtaaaaagattttatgcatagtcccacatatctatttatattttctttatttttaaatg

SEQ ID NO: 22745 - DNA, 386 bp, Homo sapiens
tcataaacttttaataattacttaagtgattacaatgtatagccaaaattgagaacactaatatgaaaagtaggaagcctggaaaaagctgaaaaatgtgatttcaggtggagaatggacaataaaaccacaatacataaggtgctacacttagactgaagatatccaagtaagatatttgctttcatttaatacagtgtttcttaaatgtaatacactttactctaaagaaaatgaattctgctagacctgagtattcccttgacacaaattatttttattacattgttacgtaagcatattcaaaataaatattgcaatagatcccttatattaaaaaaatttatgtaactatacaaagaaatttggatttaatacaaacaaaa

SEQ ID NO: 22746 - DNA, 1124 bp, Homo sapiens
ggaaggtctaaaaaactatcatagtcaagagaagcctaaggagacatggcaatcaaataaaatgtaatgtcctggatgagaacctggaacagaaaataactaatgtttttatctaatctgagtgaactattgacttcagttaataatgtaacatggttcattaattgtaacatgtgtaccatactaataagggaaactgggtggagtgagggggtgtgtaggaactctgtattattttctccattttttgtacatataaactgtcctaaaatctgttttttaatgaaaaatctacagaaattaacgaaataatagcaaaatattttaaacaactctatcccactaaattgaaaaaaacttatggaaaatggacaaacacctggagaaactgactcgagaagaaatagaaaatttgaatattgctgtattcattaaagaaataaaaggtatcattaaaacctttctgcagtgaaaaaacaagactaaatgactttgccgtcaaattttttcaaacatttaaggggaaaaagaagccaattctacacaaataggagaaggaaggaaaacttcccaactcttgcatccaacagaacaatggtacccaaaaactgacaaaaattttgagagaaaataactatagaccgatacaacatatgaaaatcaactccaatattcctaaaaattctatcttcaatccaacaaattatacaatggataatacatcatgaccatcatgaccaagtttatatcccagaaatgcaatgaaataatatgagaaacaaaagaaagaaagcaatatagtcatctcaatagatttagaagacaaaatttttttgtttttttattatgtttatcacttatcctcaagtttgcatttatgatataaattctaagctaactaggaatagaacatcctcaaacaaataaatgacatctacagaacaagtacagctaacattatactaagatgactgagcacaggcaaggatgctgacttttaccatttttatttaacattgtaatggaggtcctagtcagttaagtggtgcaggaactataaataaaaagcacacaaatttgaaagggagacctaaatgtccttatttgctgatgacatgattgtg

SEQ ID NO: 22747 - DNA, 1122 bp, Homo sapiens
tgagcacgaaaccaaaaacagttgcactgaaatgggcaagaagagtaatgtcagtttatacatgacaaccccttcccaaagttgttacagctcatgccaagagaggacaccctggcctatgacttttccctcacagggaaggaaagagtagagcattcagccacaccttggcctttggacacactgtgtgaggaactggtctctgtctcccctcactcagagcactgatggaactggcatatttggatgcctaaggtcactgaggacaaagtgagtacaaaagaaagctgtgactcacacagctcagtgcaatgaaaagaatatgcacaacttgagatttctccctcaggagggaaaggagctcagtatgtgtctgatatactgattttccagggagctgcccaagaaattagtttttttctagcccaaccattatgccagtaggaccccacacgcactctagatgcctcagaactactgagaacaaagacagctgggtgttaagctgctgcatcagaggactcatggtatggcagacagataccacagaaagcaagagattgccagttcctgaaaaacagaaaccaggaaatccctctaattaggaatctacatgcacaaatacagagaagatactttcacagagtagaattgaaggtccccagaatctctatctgggctgattgtaaaagccagtctgggaagacaggaagaggtggctatttcttcaaatgtatagataccaatgcaaagctacaaagaacacgaagaaacagagaaatatgacacaaaagggaacaaaataaatcttaagaaactgatcataaagaaatggagagatatagaccaggcacagtggctcatgcctgtaattccagcattttgagagcctgaggcaggcggatcacctgaggtcaggagttcaagaccagcctggccaaacatggtgaaacccatctctactaaaattacaaaaattagccgggcatcatggccctgtaatcccagctactcaggaggctgaagcaccagaattgcttcaacccacgaagtggaggttgcagtgagccaagattgcaccactgcactccagcctgggtgacagagcaaaaccccatttca

SEQ ID NO: 22748 - DNA, 625 bp, Homo sapiens
ctacaccccgtttctactggagcaggagtagaggtttcctagctagagaagaacgtggacaatagctagtcctaccccattatcgattaccagagagaaatgacaggcctcccccaccctctttccccattcctgctctctctaatagtaatgagtcactaatcggggaaaggattgattaaaaaactcaatgttcttactgcttgggcatcttctctcacaggattttgtggatggatgaatgtatgtgcttattatgttaaaacgtgggattggctgtatcttctggctggctttatagttgtgccatgttggttcctcatggccaacctgtataaaagaataggaaagatgggccaggcgtggtcgttcacgcctgtaatcccagcactttgggcagccaaggtgggtgaatcacttgaggtcaggagttagcaagaccagcccggccaatatggtgaaaccctatctctgctaaaaatacaaaaaaacagctgagcatggtggtgcaagcctgtaaacccagctacttgggaggctgaggcaggagaatcccttgaacccaggaggcaaaggttgcagtgagccaaggtggcaccactgcactccagcctgggcgacagag

SEQ ID NO: 22749 - DNA, 552 bp, Homo sapiens
cataaatccaatataactgctgtccttaagagggaaattcagacagacagacagacagacagatagacacacacacggaagacgtgtgattccaggtgaggctggaaggagaaattggaatactgtagcttcaggtgaaggcatgccaaggactgccaggattacctgaagctaggatggaggcatgcaataggttcatccctagaacctcggagggagcacagtcctgctgacgccttgattgcagagtttccttctccagaactatgagaggataaatttgttgtgtcaagccacctgttttgtggtacttggttatggcagccctagcaacctattacaggggccaacatgtcagttctcaaatttcccccttttgtttgcccacaggacattatagcttcagcttgcgaatcaggaaatgtaatttcactcacttccatagtgccatcaagagaatgataaaatactgtgtgtttgttcatgtggtatgcccataccaattcagtggtcactgttcttaactgaacttaggtgtctttgggagaccaa

SEQ ID NO: 22750 - DNA, 375 bp, Homo sapiens
aggttgtgtaactttacacaaagtggaagcaataatcagggcaagacttaagagaaagtggatccaatgcaagaggagtaaagaaaaaaatccctcaaatgtatggagcagattgttttaattatctacagaatcttgtgccccaagaaattaatagctcaagtttccagcaagagtggtggatgagatggagagcatttatgtgagagagaaccaaggatattactaaaaatggaagggaagctgggttcctcctgggaaaacagatctctgtggctctatttgttctaactactatgcctgccttcatgtactttggtcatttaggggcctgcagaggacagttataaaatctgtggtcattctgccgtcgag

SEQ ID NO: 22751 - DNA, 330 bp, Homo sapiens
acctaggcacctgggaaaaggcagttaatgaaaactgactttgagtgggcccagatttagcagatgaagaattaaaaacatctattataaatatgcccaaagaattaatggaaaatgtggtatcaataaattagaaacatctcaacagaagtatgttaactataacaaaaaaattagaaattataaagctgaaaaataaaataactgaaatacatttactagatgggctcaacacattggacttggcagaagaatcagtgggcttgattttacacacacacacacacacacacacacacacactccaatttgaataacacaaaaaagatt

SEQ ID NO: 22752 - DNA, 453 bp, Homo sapiens
aagaattgggcacattagatgtgcaaaagttaaatcatagttaacagagattatggcaaaattgtaattaaattactataaagaggatattaaaatctaaaaacatttaaaagtcaagatgaggttataactgggttgtagcagattaggaaaaaaagtctagacccaaagcatagataagaatttctaaaaatgaccccatttaagaattcagaatgatgctgggccagtgttgcatacctatattcccagctactcagaaggctggggcaggaggatctcttgagcccaggagttagaggctgtagtatgctatgatcttgtctgtgaacagtcaccacactccagtctgggcaacatagcaagacccccatctcttaaaaagaattcaacatgaaattatagaattgaatatacttaatattggaggtgacttgtagatgatgtggacta

SEQ ID NO: 22753 - DNA, 276 bp, Homo sapiens
cttggcaggcagtaaaagcttcatttcagagagcttgagaaaaaactcaaaataattcacttcgacccaggccatttgacaaccgttagacttaactttacaaaataaaatgaaatcctaccacctgctgcttaaaatctccaattaatgctgtaaacagtgccttcatttaaaaaaccaatgagtaaatttctgcaagctgggtgcagacatttctacaaatttgctgtaaccttttgctcttgtctgcagtaagaagagccttccagattccaa

SEQ ID NO: 22754 - DNA, 508 bp, Homo sapiens
agtttgcagagagtcaaaagtaatattaacaaatggatttttgactgcacaggggctggcacccctattcctagagttgtctaagagtcaactataaaatttatgtatcatctaaatatgtgacttaacatattttgttataaataggtattatgtacaaatagactaagcataaaaattataaagtatacaaaaatagcctttttaaagatgaagtaccttatgactttatactgacttctaactgaagtctaagacctcatagttttttactcaacctcttttatatcttcaccttctttccccaacactgagaatcctagtcccttctaaagaaccacaatcttggatttctccattccccatcctccttacagttctcttccacaaaattctataaacgctcagcttcattattttccataatttaaaggaccagaatttttgtagctaaattatttatttgtgtgctttgagacatactaacttaaaatcatagaagttttaa

SEQ ID NO: 22755 - DNA, 446 bp, Homo sapiens
cctctggttttgtataggccttggctagaaagagtcaatgtttctgagctctcaaaccagttgctctcagaagataggaataccccaaggttcctggcatttttcctatttcatttttgttcagactgatattttgccaagagcacaatgactgaggaatgtagccatcatttgcagggtagtgattggttcccagcctggcttccacacaggacaggaagggaaagcatccctgagctctcctcagtatttccggatgtaatgaaagaggacatctttctacacaaagtcagccccaacttttggcttggtcacaggagttctgatagtactgtttggtgcactcatgggaaattgaaccagtcgtagccacagtctttcagagcctgggctctggggagtggaagtgaaaaataaagatgtggcttgttggattgtgatcccca

SEQ ID NO: 22756 - DNA, 282 bp, Homo sapiens
gaaaccaaggatcgaatgaagctgctgcaaaacaatcttgagttaaaactcaaagatcggcgtggcgcgctggctcacacctgtaatcccagcactttgggagtccaaggcaggtggatcaggaggtcaggagatcgagaccatcctcgctaacacggtgaaaccctatctctactaaaaatacaaaaaattacccgggcatggtggcgggtgcctgtagtcccagctactcgggatgctgaggcaggagaatggcgtgaacctgggaggcggagcttgcag

SEQ ID NO: 22757 - DNA, 2854 bp, Homo sapiens
cggcccggaagtgtagcgttgccatggcgagggccgggcgcggggcccgcccccgcagcgcctcagggagcgcggggcccactgacccgcggaagccagcggacccacttgtgcggcggtcggcgcggggcgcgaggtactggcacacggatgaggagtcgtagaagaggggcctgcagattgtgctctcagcaagcctgtcgtctagtggaagacactggccgggacacagagcccacgtgtggacaccgctgtgggttggtggcaggggtcgagcaggtgccatcaggcacatgaacggtggagtcttcaaaggtgtgagcagctgctggaagaggaggtgctcctgaagacactgcggccggcccgcctgtgcccttggtgccctggctgcctagagagcctcacccctgggccctggggccaggactccaggactctgactacctgccctcccccagcctcagcggctgcacctcctcgttagtactgatgcactgacctcggcacacagctgggaggggttgggggctgggtcatggctgctcccaggccccacccaggctcctgagcctagaaggtgaaaagaggactctcaggggctcacaggggctctcactgctggttggccctgccctcccttccccctcagcagggtgcccggaagctggaaccttgttatctgggtaattagtttcagaccctgcactgaggccggccaggtctcggggctgcctcccataggttgtgcaccctgaccccgagagggaggcgaggcgctgcttgtcgacagctagaggctggcctggggagcaggtttggggtgccctcccacactgccctccctgccccggcccatgccccccagggctgcctgggcctggttattgtgtggggcctcctgacccagccaagggcacgaagctctgggaaggggatgcccccgagggtgccagtccagctagctgccccacccctcaggcccagcctggcccccaagctccccactctggtgccccgagcagccctgtgggcaagcagccgccgccatggccgagcacctggagctgctggcagagatgcccatggtgggcaggatgagcacacaggagcggctgaagcatgcccagaagcggcgcgcccagcaggtgaagatgtgggcccaggctgagaaggaggcccagggcaagaagggtcctggggagcgtccccggaaggaggcagccagccaagggctcctgaagcaggtcctcttccctcccagtgttgtccttctggaggccgctgcccgaaatgacctggaagaagtccgccagttccttgggagtggggtcagccctgacttggccaacgaggacggcctgacggccctgcaccagtgctgcattgatgatttccgagagatggtgcagcagctcctggaggctggggccaacatcaatgcctgtgacagtgagtgctggacgcctctgcatgctgcggccacctgcggccacctgcacctggtggagctgctcatcgccagtggcgccaatctcctggcggtcaacaccgacgggaacatgccctatgacctgtgtgatgatgagcagacgctggactgcctggagactgccatggccgaccgtggcatcacccaggacagcatcgaggccgcccgggccgtgccagaactgcgcatgctggacgacatccggagccggctgcaggccggggcagacctccatgcccccctggaccacggggccacgctgctgcacgtcgcagccgccaacgggttcagcgaggcggctgccctgctgctggaacaccgagccagcctgagcgctaaggaccaagacggctgggagccgctgcacgccgcggcctactggggccaggtgcccctggtggagctgctcgtggcgcacggggccgacctgaacgcaaagtccctgatggacgagacgccccttgatgtgtgcggggacgaggaggtgcgggccaagctgctggagctgaagcacaagcacgacgccctcctgcgcgcccagagccgccagcgctccttgctgcgccgccgcacctccagcgccggcagccgcgggaaggtggtgaggcgggtgagcctaacccagcgcaccgacctgtaccgcaagcagcacgcccaggaggccatcgtgtggcaacagccgccgcccaccagcccggagccgcccgaggacaacgatgaccgccagacaggcgcagagctcaggccgccgcccccggaggaggacaaccccgaagtggtcaggccgcacaatggccgagtagggggctccccagtgcggcatctatactccaagcgactagaccggagtgtctcctaccagctgagccccctggacagcaccaccccccacaccctggtccacgacaaggcccaccacaccctggctgacctgaagcgccagcgagctgctgccaagctgcagcgacccccacctgaggggcccgagagccctgagacagctgagcctggcctgcctggtgacacggtgaccccccagcctgactgtggcttcagggcaggcggggacccacccctgctcaagctcacagccccggcggtggaggctcccgtggagaggaggccgtgctgcctgctcatgtgaggctgttgctcagcatgcaggggccctgtcgcgggcacagcccaaggctgcctccccacggtgcgtgccctggtgctgcgggtgcagcacggaaaccccggcttctactgtacaggacactggcccctctcaggtcagaagacatgcctggagggatgtctggctgcaaagactatttttatcctgcaactcttgataaagggctgttttgccatgga

SEQ ID NO: 22758 - DNA, 2949 bp, Homo sapiens
cggcccggaagtgtagcgttgccatggcgagggccgggcgcggggcccgcccccgcagcgcctcagggagcgcggggcccactgacccgcggaagccagcggacccacttgtgcggcggtcggcgcggggcgcgaggtactggcacacggatgaggagtcgtagaagaggggcctgcagattgtgctctcagcaagcctgtcgtctagtggaagacactggccgggacacagagcccacgtgtggacaccgctgtgggttggtggcaggggtcgagcaggtgccatcaggcacatgaacggtggagtcttcaaaggtgtgagcagctgctggaagaggaggtgctcctgaagacactgcggccggcccgcctgtgcccttggtgccctggctgcctagagagcctcacccctgggccctggggccaggactccaggactctgactacctgccctcccccagcctcagcggctgcacctcctcgttagtactgatgcactgacctcggcacacagctgggaggggttgggggctgggtcatggctgctcccaggccccacccaggctcctgagcctagaaggtgaaaagaggactctcaggggctcacaggggctctcactgctggttggccctgccctcccttccccctcagcagggtgcccggaagctggaaccttgttatctgggtaattagtttcagaccctgcactgaggccggccaggtctcggggctgcctcccataggttgtgcaccctgaccccgagagggaggcgaggcgctgcttgtcgacagctagaggctggcctggggagcaggtttggggtgccctcccacactgccctccctgccccggcccatgccccccagggctgcctgggcctggttattgtgtggggcctcctgacccagccaagggcacgaagctctgggaaggggatgcccccgagggtgccagtccagctagctgccccacccctcaggcccagcctggcccccaagctccccactctggtgccccgagcagccctgtgggcaagcagccgccgccatggccgagcacctggagctgctggcagagatgcccatggtgggcaggatgagcacacaggagcggctgaagcatgcccagaagcggcgcgcccagcaggtgaagatgtgggcccaggctgagaaggaggcccagggcaagaagggtcctggggagcgtccccggaaggaggcagccagccaagggctcctgaagcaggtcctcttccctcccagtgttgtccttctggaggccgctgcccgaaatgacctggaagaagtccgccagttccttgggagtggggtcagccctgacttggccaacgaggacggcctgacggccctgcaccagtgctgcattgatgatttccgagagatggtgcagcagctcctggaggctggggccaacatcaatgcctgtgacagtgagtgctggacgcctctgcatgctgcggccacctgcggccacctgcacctggtggagctgctcatcgccagtggcgccaatctcctggcggtcaacaccgacgggaacatgccctatgacctgtgtgatgatgagcagacgctggactgcctggagactgccatggccgaccgtggcatcacccaggacagcatcgaggccgcccgggccgtgccagaactgcgcatgctggacgacatccggagccggctgcaggccggggcagacctccatgcccccctggaccacggggccacgctggtgagggctggggggtgaggggcacacggggctgggggcctcgctacttggaggtgggggatggggccgaattcaggccgggcgcttgcctgcagctgcacgtcgcagccgccaacgggttcagcgaggcggctgccctgctgctggaacaccgagccagcctgagcgctaaggaccaagacggctgggagccgctgcacgccgcggcctactggggccaggtgcccctggtggagctgctcgtggcgcacggggccgacctgaacgcaaagtccctgatggacgagacgccccttgatgtgtgcggggacgaggaggtgcgggccaagctgctggagctgaagcacaagcacgacgccctcctgcgcgcccagagccgccagcgctccttgctgcgccgccgcacctccagcgccggcagccgcgggaaggtggtgaggcgggtgagcctaacccagcgcaccgacctgtaccgcaagcagcacgcccaggaggccatcgtgtggcaacagccgccgcccaccagcccggagccgcccgaggacaacgatgaccgccagacaggcgcagagctcaggccgccgcccccggaggaggacaaccccgaagtggtcaggccgcacaatggccgagtagggggctccccagtgcggcatctatactccaagcgactagaccggagtgtctcctaccagctgagccccctggacagcaccaccccccacaccctggtccacgacaaggcccaccacaccctggctgacctgaagcgccagcgagctgctgccaagctgcagcgacccccacctgaggggcccgagagccctgagacagctgagcctggcctgcctggtgacacggtgaccccccagcctgactgtggcttcagggcaggcggggacccacccctgctcaagctcacagccccggcggtggaggctcccgtggagaggaggccgtgctgcctgctcatgtgaggctgttgctcagcatgcaggggccctgtcgcgggcacagcccaaggctgcctccccacggtgcgtgccctggtgctgcgggtgcagcacggaaaccccggcttctactgtacaggacactggcccctctcaggtcagaagacatgcctggagggatgtctggctgcaaagactatttttatcctgcaactcttgataaagggctgttttgccatgga

SEQ ID NO: 22759 - DNA, 2942 bp, Homo sapiens
cggcccggaagtgtagcgttgccatggcgagggccgggcgcggggcccgcccccgcagcgcctcagggagcgcggggcccactgacccgcggaagccagcggacccacttgtgcggcggtcggcgcggggcgcgaggtactggcacacggatgaggagtcgtagaagaggggcctgcagattgtgctctcagcaagcctgtcgtctagtggaagacactggccgggacacagagcccacgtgtggacaccgctgtgggttggtggcaggggtcgagcaggtgccatcaggcacatgaacggtggagtcttcaaaggtgtgagcagctgctggaagaggaggtgctcctgaagacactgcggccggcccgcctgtgcccttggtgccctggctgcctagagagcctcacccctgggccctggggccaggactccaggactctgactacctgccctcccccagcctcagcggctgcacctcctcgttagtactgatgcactgacctcggcacacagctgggaggggttgggggctgggtcatggctgctcccaggccccacccaggctcctgagcctagaaggtgaaaagaggactctcaggggctcacaggggctctcactgctggttggccctgccctcccttccccctcagcagggtgcccggaagctggaaccttgttatctgggtaattagtttcagaccctgcactgaggccggccaggtctcggggctgcctcccataggttgtgcaccctgaccccgagagggaggcgaggcgctgcttgtcgacagctagaggctggcctggggagcaggtttggggtgccctcccacactgccctccctgccccggcccatgccccccagggctgcctgggcctggttattgtgtggggcctcctgacccagccaagggcacgaagctctgggaaggggatgcccccgagggtgccagtccagctagctgccccacccctcaggcccagcctggcccccaagctccccactctggtgccccgagcagccctgtgggcaagcagccgccgccatggccgagcacctggagctgctggcagagatgcccatggtgggcaggatgagcacacaggagcggctgaagcatgcccagaagcggcgcgcccagcaggtgaagatgtgggcccaggctgagaaggaggcccagggcaagaagggtcctggggagcgtccccggaaggaggcagccagccaagggctcctgaagcaggtcctcttccctcccagtgttgtccttctggaggccgctgcccgaaatgacctggaagaagtccgccagttccttgggagtggggtcagccctgacttggccaacgaggacggcctgacggccctgcaccagtgctgcattgatgatttccgagagatggtgcagcagctcctggaggctggggccaacatcaatgcctgtgacagtgagtgctggacgcctctgcatgctgcggccacctgcggccacctgcacctggtggagctgctcatcgccagtggcgccaatctcctggcggtcaacaccgacgggaacatgccctatgacctgtgtgatgatgagcagacgctggactgcctggagactgccatggccgaccgtggcatcacccaggacagcatcgaggccgcccgggccgtgccagaactgcgcatgctggacgacatccggagccggctgcaggccggggcagacctccatgcccccctggaccacggggccacgctgctgcacgtcgcagccgccaacgggttcagcgaggcggctgccctgctgctggaacaccgagccagcctgagcgctaaggaccaagacggctgggagccgctgcacgccgcggcctactggggccaggtgcccctggtggagctgctcgtggcgcacggggccgacctgaacgcaaagtccctgatggacgagacgccccttgatgtgtgcggggacgaggaggtgcgggccaagctgctggagctgaagcacaagcacgacgccctcctgcgcgcccagagccgccagcgctccttgctgcgccgccgcacctccagcgccggcagccgcgggaaggtggtgaggcgggtgagcctaacccagcgcaccgacctgtaccgcaagcagcacgcccaggaggccatcgtgtggcaacagccgccgcccaccagcccggagccgcccgaggacaacgatgaccgccagacaggcgcagagctcaggccgccgcccccggaggaggacaaccccgaagtggtcaggccgcacaatggccgagtagggggctccccagtgcggcatctatactccaagcgactagaccggagtgtctcctaccagctgagccccctggacagcaccaccccccacaccctggtccacgacaaggcccaccacaccctggctgacctgaagcgccagcgagctgctgccaagctgcagcgacccccacctgaggggcccgagagccctgagacagctgagcctggcctgcctggtgacacggtgaccccccagcctgactgtggcttcagggcaggcggggacccacccctgctcaagctcacagccccggcggtggaggctcccgtggagaggaggccgtgctgcctgctcatgtgaggctgttgctcagcatgcaggggccctgtcgcgggcacagcccaaggctgcctccccacggtgcgtgccctggtgctgcgggtgcagcacggaaaccccggcttctactgtacaggacactggcccctctcaggtcagaagacatgcctggagggatgtctggctgcaaagactatttttatcctgcaactcttgataaagggctgttttgccatggaaaaaaccccacacacacaccacagacacaaataaaaaaagggggggcacgccaaagaatcccccgagggggccccattaaggcatcca

SEQ ID NO: 22760 - DNA, 2792 bp, Homo sapiens
cggcccggaagtgtagcgttgccatggcgagggccgggcgcggggcccgcccccgcagcgcctcagggagcgcggggcccactgacccgcggaagccagcggacccacttgtgcggcggtcggcgcggggcgcgaggtactggcacacggatgaggagtcgtagaagaggggcctgcagattgtgctctcagcaagcctgtcgtctagtggaagacactggccgggacacagagcccacgtgtggacaccgctgtgggttggtggcaggggtcgagcaggtgccatcaggcacatgaacggtggagtcttcaaaggtgtgagcagctgctggaagaggaggtgctcctgaagacactgcggccggcccgcctgtgcccttggtgccctggctgcctagagagcctcacccctgggccctggggccaggactccaggactctgactacctgccctcccccagcctcagcggctgcacctcctcgttagtactgatgcactgacctcggcacacagctgggaggggttgggggctgggtcatggctgctcccaggccccacccaggctcctgagcctagaaggtgaaaagaggactctcaggggctcacaggggctctcactgctggttggccctgccctcccttccccctcagcagggtgcccggaagctggaaccttgttatctgggtaattagtttcagaccctgcactgaggccggccaggtctcggggctgcctcccataggttgtgcaccctgaccccgagagggaggcgaggcgctgcttgtcgacagctagaggctggcctggggagcaggtttggggtgccctcccacactgccctccctgccccggcccatgccccccagggctgcctgggcctggttattgtgtggggcctcctgacccagccaagggcacgaagctctgggaaggggatgcccccgagggtgccagtccagctagctgccccacccctcaggcccagcctggcccccaagctccccactctggtgccccgagcagccctgtgggcaagcagccgccgccatggccgagcacctggagctgctggcagagatgcccatggtgggcaggatgagcacacaggagcggctgaagcatgcccagaagcggcgcgcccagcaggtgaagatgtgggcccaggctgagaaggaggcccagggcaagaagggtcctggggagcgtccccggaaggaggcagccagccaagggctcctgaagcaggtcctcttccctcccagtgttgtccttctggaggccgctgcccgaaatgacctggaagaagtccgccagttccttgggagtggggtcagccctgacttggccaacgaggacggcctgacggccctgcaccagtgctgcattgatgatttccgagagatggtgcagcagctcctggaggctggggccaacatcaatgcctgtgacagtgagtgctggacgcctctgcatgctgcggccacctgcggccacctgcacctggtggagctgctcatcgccagtggcgccaatctcctggcggtcaacaccgacgggaacatgccctatgacctgtgtgatgatgagcagacgctggactgcctggagactgccatggccgaccgtggcatcacccaggacagcatcgaggccgcccgggccgtgccagaactgcgcatgctggacgacatccggagccggctgcaggccggggcagacctccatgcccccctggaccacggggccacgctgctgcacgtcgcagccgccaacgggttcagcgaggcggctgccctgctgctggaacaccgagccagcctgagcgctaaggaccaagacggctgggagccgctgcacgccgcggcctactggggccaggtgcccctggtggagctgctcgtggcgcacggggccgacctgaacgcaaagtccctgatggacgagacgccccttgatgtgtgcggggacgaggaggtgcgggccaagctgctggagctgaagcacaagcacgacgccctcctgcgcgcccagagccgccagcgctccttgctgcgccgccgcacctccagcgccggcagccgcgggaaggtggtgaggcgggtgagcctaacccagcgcaccgacctgtaccgcaagcagcacgcccaggaggccatcgtgtggcaacagccgccgcccaccagcccggagccgcccgaggacaacgatgaccgccagacaggcgcagagctcaggccgccgcccccggaggaggacaaccccgaagtggtcaggccgcacaatggccgagtagggggctccccagtgcggcatctatactccaagcgactagaccggagtgtctcctaccagctgagccccctggacagcaccaccccccacaccctggtccacgacaaggcccaccacaccctggctgacctgaagcgccagcgagctgctgccaagctgcagcgacccccacctgaggggcccgagagccctgagacagctgagcctggcctgcctggtgacacggtgaccggcggtggaggctcccgtggagaggaggccgtgctgcctgctcatgtgaggctgttgctcagcatgcaggggccctgtcgcgggcacagcccaaggctgcctccccacggtgcgtgccctggtgctgcgggtgcagcacggaaaccccggcttctactgtacaggacactggcccctctcaggtcagaagacatgcctggagggatgtctggctgcaaagactatttttatcctgcaactcttgataaagggctgttttgccatgga

SEQ ID NO: 22761 - DNA, 608 bp, Homo sapiens
agagttcaaacttggaattggacaaggcccttccgggtccaatgtagggggcgtccctggcaggtcatggtcccttcagaagttaacgccggaatccattaacccagatgacttttcttgtaaagcaccaccccccacaccctggtccacgacaaggcccaccacaccctggctgacctgaagcgccagcgagctgctgccaagctgcagcgacccccacctgaggggcccgagagccctgagacagctgagcctggcctgcctggtgacacggtgaccccccagcctgactgtggcttcagggcaggcggggacccacccctgctcaagctcacagccccggcggtggaggctcccgtggagaggaggccgtgctgcctgctcatgtgaggctgttgctcagcatgcaggggccctgtcgcgggcacagcccaaggctgcctccccacggtgcgtgccctggtgctgcgggtgcagcacggaaaccccggcttctactgtacaggacactggcccctctcaggtcagaagacatgcctggagggatgtctggctgcaaagactatttttatcctgcaactcttgataaagggctgttttgccatgga

SEQ ID NO: 22762 - DNA, 398 bp, Homo sapiens
cggcccggaagtgtagcgttgccatggcgagggccgggcgcggggcccgcccccgcagcgcctcagggagcgcggggcccactgacccgcggaagccagcggacccacttgtgcggcggtcggcgcggggcgcgaggtactggcacacggatgaggagtcgtagaagaggggcctgcagattgtgctctcagcaagcctgtcgtctagtggaagacactggccgggacacagagcccacggtgcgtgccctggtgctgcgggtgcagcacggaaaccccggcttctactgtacaggacactggcccctctcaggtcagaagacatgcctggagggatgtctggctgcaaagactatttttatcctgcaactcttgataaagggctgttttgccatgga

SEQ ID NO: 22763 - DNA, 149 bp, Homo sapiens
actccctctcctctctcctccccaggaaggtggtgaggcgggtgagcctaacccagcgcaccgacctgtaccgcaagcagcacgcccaggaggccatcgtgtggcaacagccgccgcccaccagcccggagccgcccgaggacaacgat

SEQ ID NO: 22764 - DNA, 2931 bp, Homo sapiens
cggcccggaagtgtagcgttgccatggcgagggccgggcgcggggcccgcccccgcagcgcctcagggagcgcggggcccactgacccgcggaagccagcggacccacttgtgcggcggtcggcgcggggcgcgagaagctactcaggaggctgaggcaggagaatcatttgaacccaggagctggaggttgcagtatttcatgcctacgcaggtactggcacacggatgaggagtcgtagaagaggggcctgcagattgtgctctcagcaagcctgtcgtctagtggaagacactggccgggacacagagcccacgtgtggacaccgctgtgggttggtggcaggggtcgagcaggtgccatcaggcacatgaacggtggagtcttcaaaggtgtgagcagctgctggaagaggaggtgctcctgaagacactgcggccggcccgcctgtgcccttggtgccctggctgcctagagagcctcacccctgggccctggggccaggactccaggactctgactacctgccctcccccagcctcagcggctgcacctcctcgttagtactgatgcactgacctcggcacacagctgggaggggttgggggctgggtcatggctgctcccaggccccacccaggctcctgagcctagaaggtgaaaagaggactctcaggggctcacaggggctctcactgctggttggccctgccctcccttccccctcagcagggtgcccggaagctggaaccttgttatctgggtaattagtttcagaccctgcactgaggccggccaggtctcggggctgcctcccataggttgtgcaccctgaccccgagagggaggcgaggcgctgcttgtcgacagctagaggctggcctggggagcaggtttggggtgccctcccacactgccctccctgccccggcccatgccccccagggctgcctgggcctggttattgtgtggggcctcctgacccagccaagggcacgaagctctgggaaggggatgcccccgagggtgccagtccagctagctgccccacccctcaggcccagcctggcccccaagctccccactctggtgccccgagcagccctgtgggcaagcagccgccgccatggccgagcacctggagctgctggcagagatgcccatggtgggcaggatgagcacacaggagcggctgaagcatgcccagaagcggcgcgcccagcaggtgaagatgtgggcccaggctgagaaggaggcccagggcaagaagggtcctggggagcgtccccggaaggaggcagccagccaagggctcctgaagcaggtcctcttccctcccagtgttgtccttctggaggccgctgcccgaaatgacctggaagaagtccgccagttccttgggagtggggtcagccctgacttggccaacgaggacggcctgacggccctgcaccagtgctgcattgatgatttccgagagatggtgcagcagctcctggaggctggggccaacatcaatgcctgtgacagtgagtgctggacgcctctgcatgctgcggccacctgcggccacctgcacctggtggagctgctcatcgccagtggcgccaatctcctggcggtcaacaccgacgggaacatgccctatgacctgtgtgatgatgagcagacgctggactgcctggagactgccatggccgaccgtggcatcacccaggacagcatcgaggccgcccgggccgtgccagaactgcgcatgctggacgacatccggagccggctgcaggccggggcagacctccatgcccccctggaccacggggccacgctgctgcacgtcgcagccgccaacgggttcagcgaggcggctgccctgctgctggaacaccgagccagcctgagcgctaaggaccaagacggctgggagccgctgcacgccgcggcctactggggccaggtgcccctggtggagctgctcgtggcgcacggggccgacctgaacgcaaagtccctgatggacgagacgccccttgatgtgtgcggggacgaggaggtgcgggccaagctgctggagctgaagcacaagcacgacgccctcctgcgcgcccagagccgccagcgctccttgctgcgccgccgcacctccagcgccggcagccgcgggaaggtggtgaggcgggtgagcctaacccagcgcaccgacctgtaccgcaagcagcacgcccaggaggccatcgtgtggcaacagccgccgcccaccagcccggagccgcccgaggacaacgatgaccgccagacaggcgcagagctcaggccgccgcccccggaggaggacaaccccgaagtggtcaggccgcacaatggccgagtagggggctccccagtgcggcatctatactccaagcgactagaccggagtgtctcctaccagctgagccccctggacagcaccaccccccacaccctggtccacgacaaggcccaccacaccctggctgacctgaagcgccagcgagctgctgccaagctgcagcgacccccacctgaggggcccgagagccctgagacagctgagcctggcctgcctggtgacacggtgaccccccagcctgactgtggcttcagggcaggcggggacccacccctgctcaagctcacagccccggcggtggaggctcccgtggagaggaggccgtgctgcctgctcatgtgaggctgttgctcagcatgcaggggccctgtcgcgggcacagcccaaggctgcctccccacggtgcgtgccctggtgctgcgggtgcagcacggaaaccccggcttctactgtacaggacactggcccctctcaggtcagaagacatgcctggagggatgtctggctgcaaagactatttttatcctgcaactcttgataaagggctgttttgccatgga

SEQ ID NO: 22765 - DNA, 2651 bp, Homo sapiens
gcagggagccgaaggctgccggtgggcgcttcgcgttttgttccaaggcaaaggtgtgtggattctccgcagcccgtcggtcaggtactggcacacggatgaggagtcgtagaagaggggcctgcagattgtgctctcagcaagcctgtcgtctagtggaagacactggccgggacacagagcccacgtgtggacaccgctgtgggttggtggcaggggtcgagcaggtgccatcaggcacatgaacggtggagtcttcaaaggtgtgagcagctgctggaagaggaggtgctcctgaagacactgcggccggcccgcctgtgcccttggtgccctggctgcctagagagccccacccaggctcctgagcctagaaggtgaaaagaggactctcaggggctcacaggggctctcactgctggttggccctgccctcccttccccctcagcagggtgcccggaagctggaaccttgttatctgggtaattagtttcagaccctgcactgaggccggccaggtctcggggctgcctcccataggttgtgcaccctgaccccgagagggaggcgaggcgctgcttgtcgacagctagaggctggcctggggagcaggtttggggtgccctcccacactgccctccctgccccggcccatgccccccagggctgcctgggcctggttattgtgtggggcctcctgacccagccaagggcacgaagctctgggaaggggatgcccccgagggtgccagtccagctagctgccccacccctcaggcccagcctggcccccaagctccccactctggtgccccgagcagccctgtgggcaagcagccgccgccatggccgagcacctggagctgctggcagagatgcccatggtgggcaggatgagcacacaggagcggctgaagcatgcccagaagcggcgcgcccagcaggtgaagatgtgggcccaggctgagaaggaggcccagggcaagaagggtcctggggagcgtccccggaaggaggcagccagccaagggctcctgaagcaggtcctcttccctcccagtgttgtccttctggaggccgctgcccgaaatgacctggaagaagtccgccagttccttgggagtggggtcagccctgacttggccaacgaggacggcctgacggccctgcaccagtgctgcattgatgatttccgagagatggtgcagcagctcctggaggctggggccaacatcaatgcctgtgacagtgagtgctggacgcctctgcatgctgcggccacctgcggccacctgcacctggtggagctgctcatcgccagtggcgccaatctcctggcggtcaacaccgacgggaacatgccctatgacctgtgtgatgatgagcagacgctggactgcctggagactgccatggccgaccgtggcatcacccaggacagcatcgaggccgcccgggccgtgccagaactgcgcatgctggacgacatccggagccggctgcaggccggggcagacctccatgcccccctggaccacggggccacgctgctgcacgtcgcagccgccaacgggttcagcgaggcggctgccctgctgctggaacaccgagccagcctgagcgctaaggaccaagacggctgggagccgctgcacgccgcggcctactggggccaggtgcccctggtggagctgctcgtggcgcacggggccgacctgaacgcaaagtccctgatggacgagacgccccttgatgtgtgcggggacgaggaggtgcgggccaagctgctggagctgaagcacaagcacgacgccctcctgcgcgcccagagccgccagcgctccttgctgcgccgccgcacctccagcgccggcagccgcgggaaggtggtgaggcgggtgagcctaacccagcgcaccgacctgtaccgcaagcagcacgcccaggaggccatcgtgtggcaacagccgccgcccaccagcccggagccgcccgaggacaacgatgaccgccagacaggcgcagagctcaggccgccgcccccggaggaggacaaccccgaagtggtcaggccgcacaatggccgagtagggggctccccagtgcggcatctatactccaagcgactagaccggagtgtctcctaccagctgagccccctggacagcaccaccccccacaccctggtccacgacaaggcccaccacaccctggctgacctgaagcgccagcgagctgctgccaagctgcagcgacccccacctgaggggcccgagagccctgagacagctgagcctggcctgcctggtgacacggtgaccccccagcctgactgtggcttcagggcaggcggggacccacccctgctcaagctcacagccccggcggtggaggctcccgtggagaggaggccgtgctgcctgctcatgtgaggctgttgctcagcatgcaggggccctgtcgcgggcacagcccaaggctgcctccccacggtgcgtgccctggtgctgcgggtgcagcacggaaaccccggcttctactgtacaggacactggcccctctcaggtcagaagacatgcctggagggatgtctggctgcaaagactatttttatcctgcaactcttgataaagggctgttttgccatgga

SEQ ID NO: 22766 - DNA, 2921 bp, Homo sapiens
cggcccggaagtgtagcgttgccatggcgagggccgggcgcggggcccgcccccgcagcgcctcagggagcgcggggcccactgacccgcggaagccagcggacccacttgtgcggcggtcggcgcggggcgcgaggtactggcacacggatgaggagtcgtagaagaggggcctgcagattgtgctctcagcaagcctgtcgtctagtggaagacactggccgggacacagagcccacgtgtggacaccgctgtgggttggtggcaggggtcgagcaggtgccatcaggcacatgaacggtggagtcttcaaaggtgtgagcagctgctggaagaggaggtgctcctgaagacactgcggccggcccgcctgtgcccttggtgccctggctgcctagagagcctcacccctgggccctggggccaggactccaggactctgactacctgccctcccccagcctcagcggctgcacctcctcgttagtactgatgcactgacctcggcacacagctgggaggggttgggggctgggtcatggctgctcccaggccccacccaggctcctgagcctagaaggtgaaaagaggactctcaggggctcacaggggctctcactgctggttggccctgccctcccttccccctcagcagggtgcccggaagctggaaccttgttatctgggtaattagtttcagaccctgcactgaggccggccaggtctcggggctgcctcccataggttgtgcaccctgaccccgagagggaggcgaggcgctgcttgtcgacagctagaggctggcctggggagcaggtttggggtgccctcccacactgccctccctgccccggcccatgccccccagggctgcctgggcctggttattgtgtggggcctcctgacccagccaagggcacgaagctctgggaaggggatgcccccgagggtgccagtccagctagctgccccacccctcaggcccagcctggcccccaagctccccactctggtgccccgagcagccctgtgggcaagcagccgccgccatggccgagcacctggagctgctggcagagatgcccatggtgggcaggatgagcacacaggagcggctgaagcatgcccagaagcggcgcgcccagcaggtgaagatgtgggcccaggctgagaaggaggcccagggcaagaagggtcctggggagcgtccccggaaggaggcagccagccaagggctcctgaagcaggtcctcttccctcccagtgttgtccttctggaggccgctgcccgaaatgacctggaagaagtccgccagttccttgggagtggggtcagccctgacttggccaacgaggacggcctgacggccctgcaccagtgctgcattgatgatttccgagagatggtgcagcagctcctggaggctggggccaacatcaatgcctgtgacagtgagtgctggacgcctctgcatgctgcggccacctgcggccacctgcacctggtggagctgctcatcgccagtggcgccaatctcctggcggtcaacaccgacgggaacatgccctatgacctgtgtgatgatgagcagacgctggactgcctggagactgccatggccgaccgtggtaggtgcggcggtgcggctgtgggagggctgccggtcgcgctccctctgagcctgccgcctcgcaggcatcacccaggacagcatcgaggccgcccgggccgtgccagaactgcgcatgctggacgacatccggagccggctgcaggccggggcagacctccatgcccccctggaccacggggccacgctgctgcacgtcgcagccgccaacgggttcagcgaggcggctgccctgctgctggaacaccgagccagcctgagcgctaaggaccaagacggctgggagccgctgcacgccgcggcctactggggccaggtgcccctggtggagctgctcgtggcgcacggggccgacctgaacgcaaagtccctgatggacgagacgccccttgatgtgtgcggggacgaggaggtgcgggccaagctgctggagctgaagcacaagcacgacgccctcctgcgcgcccagagccgccagcgctccttgctgcgccgccgcacctccagcgccggcagccgcgggaaggtggtgaggcgggtgagcctaacccagcgcaccgacctgtaccgcaagcagcacgcccaggaggccatcgtgtggcaacagccgccgcccaccagcccggagccgcccgaggacaacgatgaccgccagacaggcgcagagctcaggccgccgcccccggaggaggacaaccccgaagtggtcaggccgcacaatggccgagtagggggctccccagtgcggcatctatactccaagcgactagaccggagtgtctcctaccagctgagccccctggacagcaccaccccccacaccctggtccacgacaaggcccaccacaccctggctgacctgaagcgccagcgagctgctgccaagctgcagcgacccccacctgaggggcccgagagccctgagacagctgagcctggcctgcctggtgacacggtgaccccccagcctgactgtggcttcagggcaggcggggacccacccctgctcaagctcacagccccggcggtggaggctcccgtggagaggaggccgtgctgcctgctcatgtgaggctgttgctcagcatgcaggggccctgtcgcgggcacagcccaaggctgcctccccacggtgcgtgccctggtgctgcgggtgcagcacggaaaccccggcttctactgtacaggacactggcccctctcaggtcagaagacatgcctggagggatgtctggctgcaaagactatttttatcctgcaactcttgataaagggctgttttgccatgga

SEQ ID NO: 22767 - DNA, 2409 bp, Homo sapiens
cggcccggaagtgtagcgttgccatggcgagggccgggcgcggggcccgcccccgcagcgcctcagggagcgcggggcccactgacccgcggaagccagcggacccacttgtgcggcggtcggcgcggggcgcgaggtactggcacacggatgaggagtcgtagaagaggggcctgcagattgtgctctcagcaagcctgtcgtctagtggaagacactggccgggacacagagcccacgtgtggacaccgctgtgggttggtggcaggggtcgagcaggtgccatcaggcacatgaacggtggagtcttcaaaggtgtgagcagctgctggaagaggaggtgctcctgaagacactgcggccggcccgcctgtgcccttggtgccctggctgcctagagagcctcacccctgggccctggggccaggactccaggactctgactacctgccctcccccagcctcagcggctgcacctcctcgttagtactgatgcactgacctcggcacacagctgggaggggttgggggctgggtcatggctgctcccaggccccacccaggctcctgagcctagaagccctgtgggcaagcagccgccgccatggccgagcacctggagctgctggcagagatgcccatggtgggcaggatgagcacacaggagcggctgaagcatgcccagaagcggcgcgcccagcaggtgaagatgtgggcccaggctgagaaggaggcccagggcaagaagggtcctggggagcgtccccggaaggaggcagccagccaagggctcctgaagcaggtcctcttccctcccagtgttgtccttctggaggccgctgcccgaaatgacctggaagaagtccgccagttccttgggagtggggtcagccctgacttggccaacgaggacggcctgacggccctgcaccagtgctgcattgatgatttccgagagatggtgcagcagctcctggaggctggggccaacatcaatgcctgtgacagtgagtgctggacgcctctgcatgctgcggccacctgcggccacctgcacctggtggagctgctcatcgccagtggcgccaatctcctggcggtcaacaccgacgggaacatgccctatgacctgtgtgatgatgagcagacgctggactgcctggagactgccatggccgaccgtggcatcacccaggacagcatcgaggccgcccgggccgtgccagaactgcgcatgctggacgacatccggagccggctgcaggccggggcagacctccatgcccccctggaccacggggccacgctgctgcacgtcgcagccgccaacgggttcagcgaggcggctgccctgctgctggaacaccgagccagcctgagcgctaaggaccaagacggctgggagccgctgcacgccgcggcctactggggccaggtgcccctggtggagctgctcgtggcgcacggggccgacctgaacgcaaagtccctgatggacgagacgccccttgatgtgtgcggggacgaggaggtgcgggccaagctgctggagctgaagcacaagcacgacgccctcctgcgcgcccagagccgccagcgctccttgctgcgccgccgcacctccagcgccggcagccgcgggaaggtggtgaggcgggtgagcctaacccagcgcaccgacctgtaccgcaagcagcacgcccaggaggccatcgtgtggcaacagccgccgcccaccagcccggagccgcccgaggacaacgatgaccgccagacaggcgcagagctcaggccgccgcccccggaggaggacaaccccgaagtggtcaggccgcacaatggccgagtagggggctccccagtgcggcatctatactccaagcgactagaccggagtgtctcctaccagctgagccccctggacagcaccaccccccacaccctggtccacgacaaggcccaccacaccctggctgacctgaagcgccagcgagctgctgccaagctgcagcgacccccacctgaggggcccgagagccctgagacagctgagcctggcctgcctggtgacacggtgaccccccagcctgactgtggcttcagggcaggcggggacccacccctgctcaagctcacagccccggcggtggaggctcccgtggagaggaggccgtgctgcctgctcatgtgaggctgttgctcagcatgcaggggccctgtcgcgggcacagcccaaggctgcctccccacggtgcgtgccctggtgctgcgggtgcagcacggaaaccccggcttctactgtacaggacactggcccctctcaggtcagaagacatgcctggagggatgtctggctgcaaagactatttttatcctgcaactcttgataaagggctgttttgccatgga

SEQ ID NO: 22768 - DNA, 2834 bp, Homo sapiens
cggcccggaagtgtagcgttgccatggcgagggccgggcgcggggcccgcccccgcagcgcctcagggagcgcggggcccactgacccgcggaagccagcggacccacttgtgcggcggtcggcgcggggcgcgaggtactggcacacggatgaggagtcgtagaagaggggcctgcagattgtgctctcagcaagcctgtcgtctagtggaagacactggccgggacacagagcccacgtgtggacaccgctgtgggttggtggcaggggtcgagcaggtgccatcaggcacatgaacggtggagtcttcaaaggtgtgagcagctgctggaagaggaggtgctcctgaagacactgcggccggcccgcctgtgcccttggtgccctggctgcctagagagcctcacccctgggccctggggccaggactccaggactctgactacctgccctcccccagcctcagcggctgcacctcctcgttagtactgatgcactgacctcggcacacagctgggaggggttgggggctgggtcatggctgctcccaggccccacccaggctcctgagcctagaaggtgaaaagaggactctcaggggctcacaggggctctcactgctggttggccctgccctcccttccccctcagcagggtgcccggaagctggaaccttgttatctgggtaattagtttcagaccctgcactgaggccggccaggtctcggggctgcctcccataggttgtgcaccctgaccccgagagggaggcgaggcgctgcttgtcgacagctagaggctggcctggggagcaggtttggggtgccctcccacactgccctccctgccccggcccatgccccccagggctgcctgggcctggttattgtgtggggcctcctgacccagccaagggcacgaagctctgggaaggggatgcccccgagggtgccagtccagctagctgccccacccctcaggcccagcctggcccccaagctccccactctggtgccccgagcagccctgtgggcaagcagccgccgccatggccgagcacctggagctgctggcagagatgcccatggtgggcaggatgagcacacaggagcggctgaagcatgcccagaagcggcgcgcccagcaggtgaagatgtgggcccaggctgagaaggaggcccagggcaagaagggtcctggggagcgtccccggaaggaggcagccagccaagggctcctgaagcaggtcctcttccctcccagtgttgtccttctggaggccgctgcccgaaatgacctggaagaagtccgccagttccttgggagtggggtcagccctgacttggccaacgaggacggcctgacggccctgcaccagtgctgcattgatgatttccgagagatggtgcagcagctcctggaggctggggccaacatcaatgcctgtgacagtgagtgctggacgcctctgcatgctgcggccacctgcggccacctgcacctggtggagctgctcatcgccagtggcgccaatctcctggcggtcaacaccgacgggaacatgccctatgacctgtgtgatgatgagcagacgctggactgcctggagactgccatggccgaccgtggcatcacccaggacagcatcgaggccgcccgggccgtgccagaactgcgcatgctggacgacatccggagccggctgcaggccggggcagacctccatgcccccctggaccacggggccacgctgctgcacgtcgcagccgccaacgggttcagcgaggcggctgccctgctgctggaacaccgagccagcctgagcgctaaggaccaagacggctgggagccgctgcacgccgcggcctactggggccaggtgcccctggtggagctgctcgtggcgcacggggccgacctgaacgcaaagtccctgatggacgagacgccccttgatgtgtgcggggacgaggaggtgcgggccaagctgctggagctgaagcacaagcacgacgccctcctgcgcgcccagagccgccagcgctccttgctgcgccgccgcacctccagcgccggcagccgcgggaaggtggtgaggcgggtgagcctaacccagcgcaccgacctgtaccgcaagcagcacgcccaggaggccatcgtgtggcaacagccgccgcccaccagcccggagccgcccgaggacaacgatgaccgccagacaggcgcagagctcaggccgccgcccccggaggaggacaaccccgaagtggtcaggccgcacaatggccgagtagggggctccccagtgcggcatctatactccaagcgactagaccggagtgtctcctaccagctgagccccctggacagcaccaccccccacaccctggtccacgacaaggcccaccacaccctggctgacctgaagcgccagcgagctgctgccaagctgcagcgacccccacctgaggggcccgagagccctgagacagctgagcctggcctgcctggtgacacggtgaccccccagcctgactgtggcttcagggcaggcggggacccacccctgctcaagctcacagccccggtgcgtgccctggtgctgcgggtgcagcacggaaaccccggcttctactgtacaggacactggcccctctcaggtcagaagacatgcctggagggatgtctggctgcaaagactatttttatcctgcaactcttgataaagggctgttttgccatggaaaaaaccccacacacacaccacagacacaaataaaaaaagggggggcacgccaaagaatcccccgagggggccccattaaggcatcca

SEQ ID NO: 22769 - DNA, 1956 bp, Homo sapiens
cggcccggaagtgtagcgttgccatggcgagggccgggcgcggggcccgcccccgcagcgcctcagggagcgcggggcccactgacccgcggaagccagcggacccacttgtgcggcggtcggcgcggggcgcgaggtactggcacacggatgaggagtcgtagaagaggggcctgcagattgtgctctcagcaagcctgtcgtctagtggaagacactggccgggacacagagcccacgtgtggacaccgctgtgggttggtggcaggggtcgagcaggtgccatcaggcacatgaacggtggagtcttcaaaggtgtgagcagctgctggaagaggaggtgctcctgaagacactgcggccggcccgcctgtgcccttggtgccctggctgcctagagagcctcacccctgggccctggggccaggactccaggactctgactacctgccctcccccagcctcagcggctgcacctcctcgttagtactgatgcactgacctcggcacacagctgggaggggttgggggctgggtcatggctgctcccaggccccacccaggctcctgagcctagaaggtgaaaagaggactctcaggggctcacaggggctctcactgctggttggccctgccctcccttccccctcagcagggtgcccggaagctggaaccttgttatctgggtaattagtttcagaccctgcactgaggccggccaggtctcggggctgcctcccataggttgtgcaccctgaccccgagagggaggcgaggcgctgcttgtcgacagctagaggctggcctggggagcaggtttggggtgccctcccacactgccctccctgccccggcccatgccccccagggctgcctgggcctggttattgtgtggggcctcctgacccagccaagggcacgaagctctgggaaggggatgcccccgagggtgccagtccagctagctgccccacccctcaggcccagcctggcccccaagctccccactctggtgccccgagcagccctgtgggcaagcagccgccgccatggccgagcacctggagctgctggcagagatgcccatggtgggcaggatgagcacacaggagcggctgaagcatgcccagaagcggcgcgcccagcaggtgaagatgtgggcccaggctgagaaggaggcccagggcaagaagggtcctggggagcgtccccggaaggaggcagccagccaagggctcctgaagcaggtcctcttccctcccagtgttgtccttctggaggccgctgcccgaaatgacctggaagaagtccgccagttccttgggagtggggtcagccctgacttggccaacgaggacggcctgacggccctgcaccagtgctgcattgatgatttccgagagatggtgcagcagctcctggaggctggggccaacatcaatgcctgtgacagtgagtgctggacgcctctgcatgctgcggccacctgcggccacctgcacctggtggagctgctcatcgccagtggcgccaatctcctggcggtcaacaccgacgggaacatgccctatgacctgtgtgatgatgagcagacgctggactgcctggagactgccatggccgaccgtggtaggtgcggcggtgcggctgtgggagggctgccggtcgcgctccctctgagcctgccgcctcgcaggcatcacccaggacagcatcgaggccctgcctgctcatgtgaggctgttgctcagcatgcaggggccctgtcgcgggcacagcccaaggctgcctccccacggtgcgtgccctggtgctgcgggtgcagcacggaaaccccggcttctactgtacaggacactggcccctctcaggtcagaagacatgcctggagggatgtctggctgcaaagactatttttatcctgcaactcttgataaagggctgttttgccatgga

SEQ ID NO: 22770 - DNA, 2930 bp, Homo sapiens
  misc_feature (2820)..(2822): n is a, c, g, or t
atcgcatttaatcctagcaatatgtaagtttaaaggactgcattcccctctactttaaagcttatatcctagatactcagtttgtgaccttggttgacctttggcatttcacgcaagttgaacagcaaaatcaaagcagccatttttaattcgtcattcccaagccctatctgagtggttccaaagtcacctgagaggaaggtttaaattagtccctctcaccccaccattgctataaaacagcaacgttttcattccaattcagccataaagaggtttctcttcttactgggttttgaaatcatttccttttttctttcgtttgcccttcttccttcctgtgttgtactatctctccaaccacgtctataagcagactcaatcttcttgcagaggaagatgagctggcactctgcaaacttctttaataaggacccaaagtttacttgacattaacctctagtaggtgagaaattccaaaaaagctttggggtacattagaatttccaaagctctgaaagatatttcaggagatttaacagcagagttgcacttacacgtgaattctggtctatagtggtcatgtgagttaaattcgaatcctctacttgtatgaccctaggaatagattggaatactgcagaggaccaaagctgaggcatgctaaacagctgcttggaggtggaagcaagttcagtcacctactcagcttcctctctccaccacccagttcctccctcagtatcacattatttttttcttctgcttttcattaacctaactcatctcatcagtacaaccattttcttattctctaactacccccaattcctttagcctctccccacctgtccaaactcagctcagccgtgggccaatgcagcttacagacggttgcagagctaggaagaaaacccagctctcccaaccctgatcgtggaggtctctggccccccaacactgccttctgggggctgcattttttttttttttttgagaagaggtcttttgggatgcatggtgctccacatacagcttcacaaaatatttcattataagagaaaccccttgatttttatttctttttcttttgttttctggattacctgccttcagtaagcagatgcagacccacttgtaaggagtctggttagtgatgagaaaaggatgaaatctagatacaaaagtcaccttgaaggtgatgatggatctttaatccacttgactaagtgtctggaagagctacttgctcttccacccctcatctcaaatgagaggagcagaagtttaacttcctcaaatagcccagctctggctaaaacccaaagaagaaaggtcaaaggaagggaaagcatgtcaggggctggtttgtgacttggcaggaccaggaaacagcagccactgacagcccagagaaggtgactaagggctggcagaagattagaatgttaatttggctgctgtccggactaggaggccatgttcaatggcagtcagaatttgtgttctgcgcattgctgggtctataaatatgataagcaagtggtgacagaattatagtataaggtgatgtactacatgcagatcataaaggctttggttttaagacttaagtagaaaatccctctcctagcttattacccaacaatattcagataatgagcttttggagaatatctttttcctatcactagaaagatttacctgggaactgtctaaagtctacacacatatttccaaagcctttaaataccaactgcagcatggagagagaggggtggcagaagctgaaatgcctcaaaagccatttaagtgttacgttgcaggattttcagtccttctcgttatgtaaaagtagataaatatagacgttattctcaacactaccctatagtatcacagtggtccaaatgccagagcttacagataatgtcatcacagtgcctagaaactcgaactgtaatatatcgtagcattttcttggtgtttcttaaagtttctttccacaatacaaggtcctctctgcctcttgtttcttggagagttcaccccactgatgagtcttccttccctgttggactcagtcatttggggaacagtcttagaagcacatatcaaccaaggaagaaacttcctggatatctattgcccacttgcccaggtctaataaacactaaaggggggaaattgaaaggagctgccaactggtcaacgtggaagggcggttccaccctagattggtgtctttctttttcttcctttttttaaaaaaaatctatttcttaaataataataaatgcacatgatgtgttaaatatgtacatatatatttcaaaagaaaaaatggggcacaagattgtcttacaagtcgtgctggctaatttttagtttgtattcataagtggtttttaaaagccttttttaaagtgtaatttgcatgttctactttgattgtatgtaaacatattttagaacaaaaaatgtatttgtattttattgaatatagaggcaagaaaattgtacattgtttgaaatgttctttttgtaacagtttttattcataaagcatttttgtacatttaaaatgaacatggacttgctgttatttgaggcgtagatacatctagcatgcttactgtcatgctcctccatggtcttagatgttgggttttaaacatttttttctaaaagaaagctcagtcttttccgctaccagatcaggttagcacagtatagagcacttaactattaaaaaaaaaaagttaatcctattcatatgttattcattgtgtgaaattaaagacattcaattcagtcttnnnccgggaaaggcacaggacacggatttaaaaaaaaaaacccttggggggggggcccggggcccaattcccccttttggagaggggttacaataaagggccgggttttac

SEQ ID NO: 22771 - DNA, 2764 bp, Homo sapiens
  misc_feature (2654)..(2656): n is a, c, g, or t
atcgcatttaatcctagcaatatgtaagtttaaaggactgcattcccctctactttaaagcttatatcctagatactcagtttgtgaccttggttgacctttggcatttcacgcaagttgaacagcaaaatcaaagcagccatttttaattcgtcattcccaagccctatctgagtggttccaaagtcacctgagaggaaggtttaaattagtccctctcaccccaccattgctataaaacagcaacgttttcattccaattcagccataaagaggtttctcttcttactgggttttgaaatcatttccttttttctttcgtttgcccttcttccttcctgtgttgtactatctctccaaccacgtctataagcagactcaatcttcttgcagaggaagatgagctggcactctgcaaacttctttaataaggacccaaagtttacttgacattaacctctagtaggtgagaaattccaaaaaagctttggggtacattagaatttccaaagctctgaaagatatttcaggagatttaacagcagagttgcacttacacgtgaattctggtctatagtggtcatgtgagttaaattcgaatcctctacttgtatgaccctaggaatagattggaatactgcagaggaccaaagctgaggcatgctaaacagctgcttggaggtggaagcaagttcagtcacctactcagcttcctctctccaccacccagttcctccctcagtatcacattatttttttcttctgcttttcattaacctaactcatctcatcagtacaaccattttcttattctctaactacccccaattcctttagcctctccccacctgtccaaactcagctcagccgtgggccaatgcagcttacagacggttgcagagctaggaagaaaacccagctctcccaaccctgatcgtggaggtctctggccccccaacactgccttctgggggctgcattttttttttttttttgagaagaggtcttttgggatgcatggtgctccacatacagcttcacaaaatatttcattataagagaaaccccttgatttttatttctttttcttttgttttctggaagagctacttgctcttccacccctcatctcaaatagcccagctctggctaaaacccaaagaagaaaggtcaaaggaagggaaagcatgtcaggggctggtttgtgacttggcaggaccaggaaacagcagccactgacagcccagagaaggtgactaagggctggcagaagattagaatgttaatttggctgctgtccggactaggaggccatgttcaatggcagtcagaatttgtgttctgcgcattgctgggtctataaatatgataagcaagtggtgacagaattatagtataaggtgatgtactacatgcagatcataaaggctttggttttaagacttaagtagaaaatccctctcctagcttattacccaacaatattcagataatgagcttttggagaatatctttttcctatcactagaaagatttacctgggaactgtctaaagtctacacacatatttccaaagcctttaaataccaactgcagcatggagagagaggggtggcagaagctgaaatgcctcaaaagccatttaagtgttacgttgcaggattttcagtccttctcgttatgtaaaagtagataaatatagacgttattctcaacactaccctatagtatcacagtggtccaaatgccagagcttacagataatgtcatcacagtgcctagaaactcgaactgtaatatatcgtagcattttcttggtgtttcttaaagtttctttccacaatacaaggtcctctctgcctcttgtttcttggagagttcaccccactgatgagtcttccttccctgttggactcagtcatttggggaacagtcttagaagcacatatcaaccaaggaagaaacttcctggatatctattgcccacttgcccaggtctaataaacactaaaggggggaaattgaaaggagctgccaactggtcaacgtggaagggcggttccaccctagattggtgtctttctttttcttcctttttttaaaaaaaatctatttcttaaataataataaatgcacatgatgtgttaaatatgtacatatatatttcaaaagaaaaaatggggcacaagattgtcttacaagtcgtgctggctaatttttagtttgtattcataagtggtttttaaaagccttttttaaagtgtaatttgcatgttctactttgattgtatgtaaacatattttagaacaaaaaatgtatttgtattttattgaatatagaggcaagaaaattgtacattgtttgaaatgttctttttgtaacagtttttattcataaagcatttttgtacatttaaaatgaacatggacttgctgttatttgaggcgtagatacatctagcatgcttactgtcatgctcctccatggtcttagatgttgggttttaaacatttttttctaaaagaaagctcagtcttttccgctaccagatcaggttagcacagtatagagcacttaactattaaaaaaaaaaagttaatcctattcatatgttattcattgtgtgaaattaaagacattcaattcagtcttnnnccgggaaaggcacaggacacggatttaaaaaaaaaaacccttggggggggggcccggggcccaattcccccttttggagaggggttacaataaagggccgggttttac

SEQ ID NO: 22772 - DNA, 153 bp, Homo sapiens
taaaagaaagctcagtcttttccgctaccagatcaggttagcacagtatagagcacttaactattaaaaaaaaaaagttaatcctattcatatgttattcattgtgtgaaattaaagacattcaattcagtctaacatgagttgtgaattctt

SEQ ID NO: 22773 - DNA, 873 bp, Homo sapiens
ctcaagcttacttaattctcctgcctcagcctcctgagtagctgggactacagccacacactaccatccctggcttatttttatactttttgtagagatgggattttgtcatgttccctaggctggtctcaaactcctgggctcaagtgatttgcccaccctggcctcccagagtctggaattacaagtgtgagccaccatgcacagccctcatatttttaaaagataaaattattctcaggaggtctgagttaccactttaagatagcagaaaaacatttttaaaatggttaattttatctaaagaaagcaagctgtgaaaaataccatagttttaccaaataatgtttctaaaatccaaatgtattgatatacagtaacacactcaatatgtgacagttatgtacaagctactatgctgtatgctacagagaatatagcatagagaaccaaagatacagccctcaacctcgaggagtccagtaaaagaggtaagtgtcaaggaggaaatggtatcggtgaagataaaattacttcttgttgagtggatcaggagagacccttagagggcaatggcctgtgagttggatcttacaggtgtaatttgaacatagaaatagacacgcacacagaactttccttggaatggaaataatgagcaaaagtagaaagtaggaaattatggagcttgaagagaattactgaatagttcatggtattaacatgaaaaggggcaaggtaggaaataagtttggaaaggtaaaattccagtttttaacttaatgggtgaaaacagttctgcttttttttgtcttaaaaattaatatgagaaacaaatatgaactccatctttaatgaaactaggaaaaatat

SEQ ID NO: 22774 - DNA, 1406 bp, Homo sapiens
cgcggggtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagcagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcacccc

SEQ ID NO: 22775 - DNA, 8593 bp, Homo sapiens
cgcggggtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagcagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggttaaaaggaaatgcttaccactaagatgtcagtattctcctcatggatattttcagtctcaatgttgccagtctaatagtatagtatgtggttgctttactgctgttctccccacccccgtggagttgtgtcattattttaatgaatgtgagctcttgacttactctagaattctaatacagatactttctgcactagtatcacttttattattgcagttccatttaaaagcataactggctaagtcaccgccccacccgccgcattacatttcctaaaacatactgctgccaaagaccaactgtagaatccttaagtcctgttcaagtgtcacttcattttttattaggggtttcttagttggagggcatgagaaacttggccctttccaatgttgtcttcacattggagtataagaattctctataggactcttttaatttttttttttttttggtagagatggggtcttgctgtgttgcccaggctggtctcaaactcctaggcttaagcagtcctccagcctcagccttctcaaagtgctaggatgattggcatgagccacctcgtctggcctgcaggtctttttaagcatttgctgttcaataataagcatcttctttatgcctagtatttgtgataagagcacaaaacaattttctaatctcaaagagcttatattctagtggggtagagataagtgatttatcttggtgtagttttggcttttttgtttgtttttttgagacagcatctcacactgtcgcccaggctggagtgcagtggtgcaatctcagcttactgtaacctccgcctgccaggttcaagcgattctcctgcctcatcctcccgaggagctgggatcacaggcgcctgccaccacgcccggctaatttttttgtatttttagtagagacggggtttcaccatattggccaggctggtctcaaactcctgacctcgtgatccgcctgcctcggcctccctaagtgctgggattatgggcgtgaaccaccgcacctggcctatcttggtgtttttacatccttcagtatttttcaaggttttacagcttttttatctatagacttataccatcttcaaaagcaatacaattttatttgtagacgtgatttcccccaccaaatgcacattttatggagctctaggacaaaagtcaggatgaaaagtaatctatcgctggtgctactttaataccttcctgactggtgccactggctaaattctagcagtacgatgagagggccattaaggcctatcttagcaagcaagacattatagcaaagacctaaacactcaaaggttcaacgtcttctagccagggaactattctctaattcttccaccttgatatgatttcagcaaattctgataacccggtattactcttaatgcatttttgtaacatttgacaaacatctcccaatatgtagactcccactctcctgatgctaatcagtatcagacaatggaagtaaattttcctgcttttctcaacttttcctcaaattcatgttagtgaagtactttcatttggccatcattatttatcaaccttaagaaacatgcctattgacgaagtaaatatactaggaattcaacgtatctacgggaatgtggacaaagacatataccaagacaaggcactagagtgaaaagccattaaaataaaatgctcagcagcaaaggatttgtaatggttaacttgcaatatatccatatggtgtaatattacagtcattagaaatgacatttgcgtaaggatctgagtggaaactgatacagcctgtcggagagctactgagtagtattttatcacagctgcatacataccctttcacccaacagttccactcctgggagtctagtcaacaaatggacaagttgcacaaccaagctatggtcaaatatgtgtgttgtaggatttatgaaactggtaccaatttaatattcaaatgtgattaagtcatggcaatctatttactggatactttgtggttaccaaagagctatgtgctgccacagggagtcctttcaatagtgattgaaaaaggcagaacactactagacagaactacctgttttatgcatgtattggcatacactgaaaaagcttagtcacttaaaatgaggttgtacagattgtagattttgtttttaaacgcctgtatggtttaaaaaatgttttgggaaatagacatgagcagggcagagaactacaacctacaggccaaaccccaccccactgcctgtttgtacggccaacaagtttaaaatttttttaatgttttaggtttttttttttttaaaaaaaatactatgcccatttgtttacaaatcgtctgtgggtgctttctcactacaatggcagaattcagtagttgagacagacctatggtccacaaaggccgaaatatttactgttttaggagaaaaaaacaacatgaattgtaataacttggacttacttggttgctcagtcctgatgtgtcctgttaaaacctaagagaaacagcaccaagttcaatctagtgcaatcagcctatcacatctaagctgcttttgccagatctgatatctactcccgaccttaagccaggagactttgtaaacttactaggttataataaaacttaagaactatcgatatttactaatctacatcatggaactatttcaaaagcagtcatatggtaagatggatcaggagtctttaaaaataaaactgagaaagaaaaatcatgtgatcaattcagtagtagagacagaggttggtatcaagtctatgttcatacacttaccagtgccacccagcagggccatacaagacacatgaaatgagatcagctcaagggtgacaagatgaaactgggagagggccggggagacccgaactcttaatattggattccacacaagaggaaaaattttagtccagctcccagcatggcagctaatggcaagttagtaccataaagccaactcttggaatatacctgacttccacgataaaatggagatgagtgcaggggtgagtgtatagttaagaaaacaaacaatatattactagtccaggtggtagatgacagatttttattatttacacttctctcaaattattacattcagcatgttttgctttttatgttatttaaagtataaaccctcatataattccctaagatgggtggcatgccaagtagctaaatgaaatatcatcccagcccaaaagtacttattcgaatgaaatattacatttttcttaaataaagcaataaattaggtaccctattatcatggtattttcttttttggccagcttttccagataaggttgtattgctactgcaactaacaaaaaagatgtggcagggctgggcagtcgattttcaggaagccacttaatgttcagattcttttcttctctcccaggactttgcagatgctgctgttccctctgcctggagatgttcatctggcctgaatccaaaagtctgtccaagttacttctcttttccatgacagagttacaactatttgtctgtcccccttgccccattagagtatatggtccccaaaggaaagccccatgccattcactcaccacctaatcatccccaacaactagtgggcaaacatgaaacacttttgttgaataatgtgtttcctttagcccagggattacaaagtcaaaggcttacaagggggaaggactagcaggtgtgctcggaggggactctagccaactggagagtaactggtgagaagacaatgacatgctcttagggtgtctgctactcagatcctctcagttaagtcccgtgcacaaaggtgggtcaggtctactgttgccagatcttcagatcattcaaaagttacccgaattctggattttcatgcaaatctcccaatttttaaaaatgttggcatcaaattcagaatgttttaaccagccacactgtgtgggccagggaaaacaggcccaaaggccaggtgaagctgcagttttcaactgctgccttggcctctcccagagccccttaagtcctaagaaggctcagtcaacacactggcactcgtttcatcccactggttgagaaagcaagtcttagcaaagtaatgggggagtcttaccaaaactgcaaaggaaaaaaatatgataccatgaaattagaaattcactgcatttgaaatgaaaatgacttatttctgtacttctataactcacaaatttagcagacatcatttagacatttttgtagtgcaacagatttaaatctggaatttcatggtttgtaaatcactatgtgatactagctataaccatgagcaatattacgggcagtaaatgttgatttctatttcgtttcttgaagttttgtgtggttcatttttaaagtgagattcaa

SEQ ID NO: 22776 - DNA, 7830 bp, Homo sapiens
  misc_feature (7716)..(7716): n is a, c, g, or t
cgcggggtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcgggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagcagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggttaaaaggaaatgcttaccactaagatgtcagtattctcctcatggatattttcagtctcaatgttgccagtctaatagtatagtatgtggttgctttactgctgttctccccacccccgtggagttgtgtcattattttaatgaatgtgagctcttgacttactctagaattctaatacagatactttctgcactagtatcacttttattattgcagttccatttaaaagcataactggctaagtcaccgccccacccgccgcattacatttcctaaaacatactgctgccaaagaccaactgtagaatccttaagtcctgttcaagtgtcacttcattttttattaggggtttcttagttggagggcatgagaaacttggccctttccaatgttgtcttcacattggagtataagaattctctataggactcttttaatttttttttttttttggtagagatggggtcttgctgtgttgcccaggctggtctcaaactcctaggcttaagcagtcctccagcctcagccttctcaaagtgctaggatgattggcatgagccacctcgtctggcctgcaggtctttttaagcatttgctgttcaataataagcatcttctttatgcctagtatttgtgataagagcacaaaacaattttctaatctcaaagagcttatattctagtggggtagagataagtgatttatcttggtgtagttttggcttttttgtttgtttttttgagacagcatctcacactgtcgcccaggctggagtgcagtggtgcaatctcagcttactgtaacctccgcctgccaggttcaagcgattctcctgcctcatcctcccgaggagctgggatcacaggcgcctgccaccacgcccggctaatttttttgtatttttagtagagacggggtttcaccatattggccaggctggtctcaaactcctgacctcgtgatccgcctgcctcggcctccctaagtgctgggattatgggcgtgaaccaccgcacctggcctatcttggtgtttttacatccttcagtatttttcaaggttttacagcttttttatctatagacttataccatcttcaaaagcaatacaattttatttgtagacgtgatttcccccaccaaatgcacattttatggagctctaggacaaaagtcaggatgaaaagtaatctatcgctggtgctactttaataccttcctgactggtgccactggctaaattctagcagtacgatgagagggccattaaggcctatcttagcaagcaagacattatagcaaagacctaaacactcaaaggttcaacgtcttctagccagggaactattctctaattcttccaccttgatatgatttcagcaaattctgataacccggtattactcttaatgcatttttgtaacatttgacaaacatctcccaatatgtagactcccactctcctgatgctaatcagtatcagacaatggaagtaaattttcctgcttttctcaacttttcctcaaattcatgttagtgaagtactttcatttggccatcattatttatcaaccttaagaaacatgcctattgacgaagtaaatatactaggaattcaacgtatctacgggaatgtggacaaagacatataccaagacaaggcactagagtgaaaagccattaaaataaaatgctcagcagcaaaggatttgtaatggttaacttgcaatatatccatatggtgtaatattacagtcattagaaatgacatttgcgtaaggatctgagtggaaactgatacagcctgtcggagagctactgagtagtattttatcacagctgcatacataccctttcacccaacagttccactcctgggagtctagtcaacaaatggacaagttgcacaaccaagctatggtcaaatatgtgtgttgtaggatttatgaaactggtaccaatttaatattcaaatgtgattaagtcatggcaatctatttactggatactttgtggttaccaaagagctatgtgctgccacagggagtcctttcaatagtgattgaaaaaggcagaacactactagacagaactacctgttttatgcatgtattggcatacactgaaaaagcttagtcacttaaaatgaggttgtacagattgtagattttgtttttaaacgcctgtatggtttaaaaaatgttttgggaaatagacatgagcagggcagagaactacaacctacaggccaaaccccaccccactgcctgtttgtacggccaacaagtttaaaatttttttaatgttttaggtttttttttttttaaaaaaaatactatgcccatttgtttacaaatcgtctgtgggtgctttctcactacaatggcagaattcagtagttgagacagacctatggtccacaaaggccgaaatatttactgttttaggagaaaaaaacaacatgaattgtaataacttggacttacttggttgctcagtcctgatgtgtcctgttaaaacctaagagaaacagcaccaagttcaatctagtgcaatcagcctatcacatctaagctgcttttgccagatctgatatctactcccgaccttaagccaggagactttgtaaacttactaggttataataaaacttaagaactatcgatatttactaatctacatcatggaactatttcaaaagcagtcatatggtaagatggatcaggagtctttaaaaataaaactgagaaagaaaaatcatgtgatcaattcagtagtagagacagaggttggtatcaagtctatgttcatacacttaccagtgccacccagcagggccatacaagacacatgaaatgagatcagctcaagggtgacaagatgaaactgggagagggccggggagacccgaactcttaatattggattccacacaagaggaaaaattttagtccagctcccagcatggcagctaatggcaagttagtaccataaagccaactcttggaatatacctgacttccacgataaaatggagatgagtgcaggggtgagtgtatagttaagaaaacaaacaatatattactagtccaggtggtagatgacagatttttattatttacacttctctcaaattattacattcagcatgttttgctttttatgttatttaaagtataaaccctcatataattccctaagatgggtggcatgccaagtagctaaatgaaatatcatcccagcccaaaagtacttattcgaatgaaatattacatttttcttaaataaagcaataaattaggtaccctattatcatggtattttcttttttggccagcttttccagataaggttgtattgctactgcaactaacaaaaaagatgtggcagggctgggcacggtggctcacgcctgtaatcccagcactttgggaggccgaggcgggcagatcacgaggtcaggagatggagaccatcctggcccaacatggtgaaaccccgtctctactaaaaatacaaaaaattagccaggtgtggtggcaggtgtctgtagtcccagctcctcnggaggctgaggcaggagaatcgcttgaacgcgggaggcagaacctgcagtgagccaagatcatgccacagcactccagcctaaactacagagctagaaagtggctagagcagcc

SEQ ID NO: 22777 - DNA, 7761 bp, Homo sapiens
  misc_feature (7647)..(7647): n is a, c, g, or t
cgcggggtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcgcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagcagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggttaaaaggaaatgcttaccactaagatgtcagtattctcctcatggatattttcagtctcaatgttgccagtctaatagtatagtatgtggttgctttactgctgttctccccacccccgtggagttgtgtcattattttaatgaatgtgagctcttgacttactctagaattctaatacagatactttctgcactagtatcacttttattattgcagttccatttaaaagcataactggctaagtcaccgccccacccgccgcattacatttcctaaaacatactgctgccaaagaccaactgtagaatccttaagtcctgttcaagtgtcacttcattttttattaggggtttcttagttggagggcatgagaaacttggccctttccaatgttgtcttcacattggagtataagaattctctataggactcttttaatttttttttttttttggtagagatggggtcttgctgtgttgcccaggctggtctcaaactcctaggcttaagcagtcctccagcctcagccttctcaaagtgctaggatgattggcatgagccacctcgtctggcctgcaggtctttttaagcatttgctgttcaataataagcatcttctttatgcctagtatttgtgataagagcacaaaacaattttctaatctcaaagagcttatattctagtggggtagagataagtgatttatcttggtgtagttttggcttttttgtttgtttttttgagacagcatctcacactgtcgcccaggctggagtgcagtggtgcaatctcagcttactgtaacctccgcctgccaggttcaagcgattctcctgcctcatcctcccgaggagctgggatcacaggcgcctgccaccacgcccggctaatttttttgtatttttagtagagacggggtttcaccatattggccaggctggtctcaaactcctgacctcgtgatccgcctgcctcggcctccctaagtgctgggattatgggcgtgaaccaccgcacctggcctatcttggtgtttttacatccttcagtatttttcaaggttttacagcttttttatctatagacttataccatcttcaaaagcaatacaattttatttgtagacgtgatttcccccaccaaatgcacattttatggagctctaggacaaaagtcaggatgaaaagtaatctatcgctggtgctactttaataccttcctgactggtgccactggctaaattctagcagtacgatgagagggccattaaggcctatcttagcaagcaagacattatagcaaagacctaaacactcaaaggttcaacgtcttctagccagggaactattctctaattcttccaccttgatatgatttcagcaaattctgataacccggtattactcttaatgcatttttgtaacatttgacaaacatctcccaatatgtagactcccactctcctgatgctaatcagtatcagacaatggaagtaaattttcctgcttttctcaacttttcctcaaattcatgttagtgaagtactttcatttggccatcattatttatcaaccttaagaaacatgcctattgacgaagtaaatatactaggaattcaacgtatctacgggaatgtggacaaagacatataccaagacaaggcactagagtgaaaagccattaaaataaaatgctcagcagcaaaggatttgtaatggttaacttgcaatatatccatatggtgtaatattacagtcattagaaatgacatttgcgtaaggatctgagtggaaactgatacagcctgtcggagagctactgagtagtattttatcacagctgcatacataccctttcacccaacagttccactcctgggagtctagtcaacaaatggacaagttgcacaaccaagctatggtcaaatatgtgtgttgtaggatttatgaaactggtaccaatttaatattcaaatgtgattaagtcatggcaatctatttactggatactttgtggttaccaaagagctatgtgctgccacagggagtcctttcaatagtgattgaaaaaggcagaacactactagacagaactacctgttttatgcatgtattggcatacactgaaaaagcttagtcacttaaaatgaggttgtacagattgtagattttgtttttaaacgcctgtatggtttaaaaaatgttttgggaaatagacatgagcagggcagagaactacaacctacaggccaaaccccaccccactgcctgtttgtacggccaacaagtttaaaatttttttaatgttttaggtttttttttttttaaaaaaaatactatgcccatttgtttacaaatcgtctgtgggtgctttctcactacaatggcagaattcagtagttgagacagacctatggtccacaaaggccgaaatatttactgttttaggagaaaaaaacaacatgaattgtaataacttggacttacttggttgctcagtcctgatgtgtcctgttaaaacctaagagaaacagcaccaagttcaatctagtgcaatcagcctatcacatctaagctgcttttgccagatctgatatctactcccgaccttaagccaggagactttgtaaacttactaggttataataaaacttaagaactatcgatatttactaatctacatcatggaactatttcaaaagcagtcatatggtaagatggatcaggagtctttaaaaataaaactgagaaagaaaaatcatgtgatcaattcagtagtagagacagaggttggtatcaagtctatgttcatacacttaccagtgccacccagcagggccatacaagacacatgaaatgagatcagctcaagggtgacaagatgaaactgggagagggccggggagacccgaactcttaatattggattccacacaagaggaaaaattttagtccagctcccagcatggcagctaatggcaagttagtaccataaagccaactcttggaatatacctgacttccacgataaaatggagatgagtgcaggggtgagtgtatagttaagaaaacaaacaatatattactagtccaggtggtagatgacagatttttattatttacacttctctcaaattattacattcagcatgttttgctttttatgttatttaaagtataaaccctcatataattccctaagatgggtggcatgccaagtagctaaatgaaatatcatcccagcccaaaagtacttattcgaatgaaatattacatttttcttaaataaagcaataaattaggtaccctattatcatggtattttcttttttggccagcttttccagataaggttgtattgctactgcaactaacaaaaaagatgtggcagggctgggcacggtggctcacgcctgtaatcccagcactttgggaggccgaggcgggcagatcacgaggtcaggagatggagaccatcctggcccaacatggtgaaaccccgtctctactaaaaatacaaaaaattagccaggtgtggtggcaggtgtctgtagtcccagctcctcnggaggctgaggcaggagaatcgcttgaacgcgggaggcagaacctgcagtgagccaagatcatgccacagcactccagcctaaactacagagctagaaagtggctagagcagcc

SEQ ID NO: 22778 - DNA, 4360 bp, Homo sapiens
cgcggggtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagcagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggttaaaaggaaatgcttaccactaagatgtcagtattctcctcatggatattttcagtctcaatgttgccagtctaatagtatagtatgtggttgctttactgctgttctccccacccccgtggagttgtgtcattattttaatgaatgtgagctcttgacttactctagaattctaatacagatactttctgcacta

SEQ ID NO: 22779 - DNA, 8539 bp, Homo sapiens
cgcggggtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagcagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggtttctcaatgttgccagtctaatagtatagtatgtggttgctttactgctgttctccccacccccgtggagttgtgtcattattttaatgaatgtgagctcttgacttactctagaattctaatacagatactttctgcactagtatcacttttattattgcagttccatttaaaagcataactggctaagtcaccgccccacccgccgcattacatttcctaaaacatactgctgccaaagaccaactgtagaatccttaagtcctgttcaagtgtcacttcattttttattaggggtttcttagttggagggcatgagaaacttggccctttccaatgttgtcttcacattggagtataagaattctctataggactcttttaatttttttttttttttggtagagatggggtcttgctgtgttgcccaggctggtctcaaactcctaggcttaagcagtcctccagcctcagccttctcaaagtgctaggatgattggcatgagccacctcgtctggcctgcaggtctttttaagcatttgctgttcaataataagcatcttctttatgcctagtatttgtgataagagcacaaaacaattttctaatctcaaagagcttatattctagtggggtagagataagtgatttatcttggtgtagttttggcttttttgtttgtttttttgagacagcatctcacactgtcgcccaggctggagtgcagtggtgcaatctcagcttactgtaacctccgcctgccaggttcaagcgattctcctgcctcatcctcccgaggagctgggatcacaggcgcctgccaccacgcccggctaatttttttgtatttttagtagagacggggtttcaccatattggccaggctggtctcaaactcctgacctcgtgatccgcctgcctcggcctccctaagtgctgggattatgggcgtgaaccaccgcacctggcctatcttggtgtttttacatccttcagtatttttcaaggttttacagcttttttatctatagacttataccatcttcaaaagcaatacaattttatttgtagacgtgatttcccccaccaaatgcacattttatggagctctaggacaaaagtcaggatgaaaagtaatctatcgctggtgctactttaataccttcctgactggtgccactggctaaattctagcagtacgatgagagggccattaaggcctatcttagcaagcaagacattatagcaaagacctaaacactcaaaggttcaacgtcttctagccagggaactattctctaattcttccaccttgatatgatttcagcaaattctgataacccggtattactcttaatgcatttttgtaacatttgacaaacatctcccaatatgtagactcccactctcctgatgctaatcagtatcagacaatggaagtaaattttcctgcttttctcaacttttcctcaaattcatgttagtgaagtactttcatttggccatcattatttatcaaccttaagaaacatgcctattgacgaagtaaatatactaggaattcaacgtatctacgggaatgtggacaaagacatataccaagacaaggcactagagtgaaaagccattaaaataaaatgctcagcagcaaaggatttgtaatggttaacttgcaatatatccatatggtgtaatattacagtcattagaaatgacatttgcgtaaggatctgagtggaaactgatacagcctgtcggagagctactgagtagtattttatcacagctgcatacataccctttcacccaacagttccactcctgggagtctagtcaacaaatggacaagttgcacaaccaagctatggtcaaatatgtgtgttgtaggatttatgaaactggtaccaatttaatattcaaatgtgattaagtcatggcaatctatttactggatactttgtggttaccaaagagctatgtgctgccacagggagtcctttcaatagtgattgaaaaaggcagaacactactagacagaactacctgttttatgcatgtattggcatacactgaaaaagcttagtcacttaaaatgaggttgtacagattgtagattttgtttttaaacgcctgtatggtttaaaaaatgttttgggaaatagacatgagcagggcagagaactacaacctacaggccaaaccccaccccactgcctgtttgtacggccaacaagtttaaaatttttttaatgttttaggtttttttttttttaaaaaaaatactatgcccatttgtttacaaatcgtctgtgggtgctttctcactacaatggcagaattcagtagttgagacagacctatggtccacaaaggccgaaatatttactgttttaggagaaaaaaacaacatgaattgtaataacttggacttacttggttgctcagtcctgatgtgtcctgttaaaacctaagagaaacagcaccaagttcaatctagtgcaatcagcctatcacatctaagctgcttttgccagatctgatatctactcccgaccttaagccaggagactttgtaaacttactaggttataataaaacttaagaactatcgatatttactaatctacatcatggaactatttcaaaagcagtcatatggtaagatggatcaggagtctttaaaaataaaactgagaaagaaaaatcatgtgatcaattcagtagtagagacagaggttggtatcaagtctatgttcatacacttaccagtgccacccagcagggccatacaagacacatgaaatgagatcagctcaagggtgacaagatgaaactgggagagggccggggagacccgaactcttaatattggattccacacaagaggaaaaattttagtccagctcccagcatggcagctaatggcaagttagtaccataaagccaactcttggaatatacctgacttccacgataaaatggagatgagtgcaggggtgagtgtatagttaagaaaacaaacaatatattactagtccaggtggtagatgacagatttttattatttacacttctctcaaattattacattcagcatgttttgctttttatgttatttaaagtataaaccctcatataattccctaagatgggtggcatgccaagtagctaaatgaaatatcatcccagcccaaaagtacttattcgaatgaaatattacatttttcttaaataaagcaataaattaggtaccctattatcatggtattttcttttttggccagcttttccagataaggttgtattgctactgcaactaacaaaaaagatgtggcagggctgggcagtcgattttcaggaagccacttaatgttcagattcttttcttctctcccaggactttgcagatgctgctgttccctctgcctggagatgttcatctggcctgaatccaaaagtctgtccaagttacttctcttttccatgacagagttacaactatttgtctgtcccccttgccccattagagtatatggtccccaaaggaaagccccatgccattcactcaccacctaatcatccccaacaactagtgggcaaacatgaaacacttttgttgaataatgtgtttcctttagcccagggattacaaagtcaaaggcttacaagggggaaggactagcaggtgtgctcggaggggactctagccaactggagagtaactggtgagaagacaatgacatgctcttagggtgtctgctactcagatcctctcagttaagtcccgtgcacaaaggtgggtcaggtctactgttgccagatcttcagatcattcaaaagttacccgaattctggattttcatgcaaatctcccaatttttaaaaatgttggcatcaaattcagaatgttttaaccagccacactgtgtgggccagggaaaacaggcccaaaggccaggtgaagctgcagttttcaactgctgccttggcctctcccagagccccttaagtcctaagaaggctcagtcaacacactggcactcgtttcatcccactggttgagaaagcaagtcttagcaaagtaatgggggagtcttaccaaaactgcaaaggaaaaaaatatgataccatgaaattagaaattcactgcatttgaaatgaaaatgacttatttctgtacttctataactcacaaatttagcagacatcatttagacatttttgtagtgcaacagatttaaatctggaatttcatggtttgtaaatcactatgtgatactagctataaccatgagcaatattacgggcagtaaatgttgatttctatttcgtttcttgaagttttgtgtggttcatttttaaagtgagattcaa

SEQ ID NO: 22780 - DNA, 4533 bp, Homo sapiens
cgcggggtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagcagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgaaaaaaaaaaaaaaaagagaagagctaaaatttaaactttttagaaagaaaaattaactttttggaacctggagtttaagcgagtaaatcttggggaacttggaagttaagggcagaaatttccttggatgccaaccattcaagaagccacaaattaattaaagggagaaaaaaggttgtgattacagttgtgaaccttaattcaaatgtgaacaactttcgttggtgcctccagggacacccacacaggttgacaggaaacagccccacagaaatctcagagagcctttttggccaaatttatcctactcgtgtaaggggacctagaatttttacaagaaaccacaagttgcatataagaaagttggacacatgtgcatcctaagtctggcggacaagggggccaaggggatttacaagaatactttctccaaggagagcacaaccatttttgtgcacaatttaagggcacctgtggacaagggcttgactataggcgaaacaatttctttctatgttccagaacaggcacaaatgtgatgatgtttctcgaagctgtgttacacccccaaactgtggaaaatggcgcctattaaacctacatctatttgggggccagaaaacaatctaaactaatgtgggtcgggaaacgggagtgttgggagaaatcttgggaaaggcctcaatc

SEQ ID NO: 22781 - DNA, 7428 bp, Homo sapiens
  misc_feature (7314)..(7314): n is a, c, g, or t
agcgggagtcaccatcttaacgtgcgaattgagttgaaagccggataaacctcgagtgctcagcgagaggagggtggaaatggcgtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagcagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggttaaaaggaaatgcttaccactaagatgtcagtattctcctcatggatattttcagtctcaatgttgccagtctaatagtatagtatgtggttgctttactgctgttctccccacccccgtggagttgtgtcattattttaatgaatgtgagctcttgacttactctagaattctaatacagatactttctgcactagtatcacttttattattgcagttccatttaaaagcataactggctaagtcaccgccccacccgccgcattacatttcctaaaacatactgctgccaaagaccaactgtagaatccttaagtcctgttcaagtgtcacttcattttttattaggggtttcttagttggagggcatgagaaacttggccctttccaatgttgtcttcacattggagtataagaattctctataggactcttttaatttttttttttttttggtagagatggggtcttgctgtgttgcccaggctggtctcaaactcctaggcttaagcagtcctccagcctcagccttctcaaagtgctaggatgattggcatgagccacctcgtctggcctgcaggtctttttaagcatttgctgttcaataataagcatcttctttatgcctagtatttgtgataagagcacaaaacaattttctaatctcaaagagcttatattctagtggggtagagataagtgatttatcttggtgtagttttggcttttttgtttgtttttttgagacagcatctcacactgtcgcccaggctggagtgcagtggtgcaatctcagcttactgtaacctccgcctgccaggttcaagcgattctcctgcctcatcctcccgaggagctgggatcacaggcgcctgccaccacgcccggctaatttttttgtatttttagtagagacggggtttcaccatattggccaggctggtctcaaactcctgacctcgtgatccgcctgcctcggcctccctaagtgctgggattatgggcgtgaaccaccgcacctggcctatcttggtgtttttacatccttcagtatttttcaaggttttacagcttttttatctatagacttataccatcttcaaaagcaatacaattttatttgtagacgtgatttcccccaccaaatgcacattttatggagctctaggacaaaagtcaggatgaaaagtaatctatcgctggtgctactttaataccttcctgactggtgccactggctaaattctagcagtacgatgagagggccattaaggcctatcttagcaagcaagacattatagcaaagacctaaacactcaaaggttcaacgtcttctagccagggaactattctctaattcttccaccttgatatgatttcagcaaattctgataacccggtattactcttaatgcatttttgtaacatttgacaaacatctcccaatatgtagactcccactctcctgatgctaatcagtatcagacaatggaagtaaattttcctgcttttctcaacttttcctcaaattcatgttagtgaagtactttcatttggccatcattatttatcaaccttaagaaacatgcctattgacgaagtaaatatactaggaattcaacgtatctacgggaatgtggacaaagacatataccaagacaaggcactagagtgaaaagccattaaaataaaatgctcagcagcaaaggatttgtaatggttaacttgcaatatatccatatggtgtaatattacagtcattagaaatgacatttgcgtaaggatctgagtggaaactgatacagcctgtcggagagctactgagtagtattttatcacagctgcatacataccctttcacccaacagttccactcctgggagtctagtcaacaaatggacaagttgcacaaccaagctatggtcaaatatgtgtgttgtaggatttatgaaactggtaccaatttaatattcaaatgtgattaagtcatggcaatctatttactggatactttgtggttaccaaagagctatgtgctgccacagggagtcctttcaatagtgattgaaaaaggcagaacactactagacagaactacctgttttatgcatgtattggcatacactgaaaaagcttagtcacttaaaatgaggttgtacagattgtagattttgtttttaaacgcctgtatggtttaaaaaatgttttgggaaatagacatgagcagggcagagaactacaacctacaggccaaaccccaccccactgcctgtttgtacggccaacaagtttaaaatttttttaatgttttaggtttttttttttttaaaaaaaatactatgcccatttgtttacaaatcgtctgtgggtgctttctcactacaatggcagaattcagtagttgagacagacctatggtccacaaaggccgaaatatttactgttttaggagaaaaaaacaacatgaattgtaataacttggacttacttggttgctcagtcctgatgtgtcctgttaaaacctaagagaaacagcaccaagttcaatctagtgcaatcagcctatcacatctaagctgcttttgccagatctgatatctactcccgaccttaagccaggagactttgtaaacttactaggttataataaaacttaagaactatcgatatttactaatctacatcatggaactatttcaaaagcagtcatatggtaagatggatcaggagtctttaaaaataaaactgagaaagaaaaatcatgtgatcaattcagtagtagagacagaggttggtatcaagtctatgttcatacacttaccagtgccacccagcagggccatacaagacacatgaaatgagatcagctcaagggtgacaagatgaaactgggagagggccggggagacccgaactcttaatattggattccacacaagaggaaaaattttagtccagctcccagcatggcagctaatggcaagttagtaccataaagccaactcttggaatatacctgacttccacgataaaatggagatgagtgcaggggtgagtgtatagttaagaaaacaaacaatatattactagtccaggtggtagatgacagatttttattatttacacttctctcaaattattacattcagcatgttttgctttttatgttatttaaagtataaaccctcatataattccctaagatgggtggcatgccaagtagctaaatgaaatatcatcccagcccaaaagtacttattcgaatgaaatattacatttttcttaaataaagcaataaattaggtaccctattatcatggtattttcttttttggccagcttttccagataaggttgtattgctactgcaactaacaaaaaagatgtggcagggctgggcacggtggctcacgcctgtaatcccagcactttgggaggccgaggcgggcagatcacgaggtcaggagatggagaccatcctggcccaacatggtgaaaccccgtctctactaaaaatacaaaaaattagccaggtgtggtggcaggtgtctgtagtcccagctcctcnggaggctgaggcaggagaatcgcttgaacgcgggaggcagaacctgcagtgagccaagatcatgccacagcactccagcctaaactacagagctagaaagtggctagagcagcc

SEQ ID NO: 22782 - DNA, 4256 bp, Homo sapiens
cgcggggtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagcagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggttaaaaggaaatgcttaccactaagatgtcagtattctcctcatggatattttcagtctcaatgttgccagtctaatagtatagtatgtggttgctttactgctgttctccccacccccgtggagttgtgtcattattttaatgaatgtgagctcttgacttactctagaattctaatacagatactttctgcacta

SEQ ID NO: 22783 - DNA, 7475 bp, Homo sapiens
  misc_feature (7361)..(7361): n is a, c, g, or t
taacagacagtcctcgtgcttggaattgagtctagtcttggcaattcttgtgggtccatgaacccgcaagctgttggcataattatgcctcatttttaaaacggccttcccttcttaaagttttctgactgcagaaaaatgctacgtggcgctcccatctggctgttcctgtactgaagttctcagtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagcagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggttaaaaggaaatgcttaccactaagatgtcagtattctcctcatggatattttcagtctcaatgttgccagtctaatagtatagtatgtggttgctttactgctgttctccccacccccgtggagttgtgtcattattttaatgaatgtgagctcttgacttactctagaattctaatacagatactttctgcactagtatcacttttattattgcagttccatttaaaagcataactggctaagtcaccgccccacccgccgcattacatttcctaaaacatactgctgccaaagaccaactgtagaatccttaagtcctgttcaagtgtcacttcattttttattaggggtttcttagttggagggcatgagaaacttggccctttccaatgttgtcttcacattggagtataagaattctctataggactcttttaatttttttttttttttggtagagatggggtcttgctgtgttgcccaggctggtctcaaactcctaggcttaagcagtcctccagcctcagccttctcaaagtgctaggatgattggcatgagccacctcgtctggcctgcaggtctttttaagcatttgctgttcaataataagcatcttctttatgcctagtatttgtgataagagcacaaaacaattttctaatctcaaagagcttatattctagtggggtagagataagtgatttatcttggtgtagttttggcttttttgtttgtttttttgagacagcatctcacactgtcgcccaggctggagtgcagtggtgcaatctcagcttactgtaacctccgcctgccaggttcaagcgattctcctgcctcatcctcccgaggagctgggatcacaggcgcctgccaccacgcccggctaatttttttgtatttttagtagagacggggtttcaccatattggccaggctggtctcaaactcctgacctcgtgatccgcctgcctcggcctccctaagtgctgggattatgggcgtgaaccaccgcacctggcctatcttggtgtttttacatccttcagtatttttcaaggttttacagcttttttatctatagacttataccatcttcaaaagcaatacaattttatttgtagacgtgatttcccccaccaaatgcacattttatggagctctaggacaaaagtcaggatgaaaagtaatctatcgctggtgctactttaataccttcctgactggtgccactggctaaattctagcagtacgatgagagggccattaaggcctatcttagcaagcaagacattatagcaaagacctaaacactcaaaggttcaacgtcttctagccagggaactattctctaattcttccaccttgatatgatttcagcaaattctgataacccggtattactcttaatgcatttttgtaacatttgacaaacatctcccaatatgtagactcccactctcctgatgctaatcagtatcagacaatggaagtaaattttcctgcttttctcaacttttcctcaaattcatgttagtgaagtactttcatttggccatcattatttatcaaccttaagaaacatgcctattgacgaagtaaatatactaggaattcaacgtatctacgggaatgtggacaaagacatataccaagacaaggcactagagtgaaaagccattaaaataaaatgctcagcagcaaaggatttgtaatggttaacttgcaatatatccatatggtgtaatattacagtcattagaaatgacatttgcgtaaggatctgagtggaaactgatacagcctgtcggagagctactgagtagtattttatcacagctgcatacataccctttcacccaacagttccactcctgggagtctagtcaacaaatggacaagttgcacaaccaagctatggtcaaatatgtgtgttgtaggatttatgaaactggtaccaatttaatattcaaatgtgattaagtcatggcaatctatttactggatactttgtggttaccaaagagctatgtgctgccacagggagtcctttcaatagtgattgaaaaaggcagaacactactagacagaactacctgttttatgcatgtattggcatacactgaaaaagcttagtcacttaaaatgaggttgtacagattgtagattttgtttttaaacgcctgtatggtttaaaaaatgttttgggaaatagacatgagcagggcagagaactacaacctacaggccaaaccccaccccactgcctgtttgtacggccaacaagtttaaaatttttttaatgttttaggtttttttttttttaaaaaaaatactatgcccatttgtttacaaatcgtctgtgggtgctttctcactacaatggcagaattcagtagttgagacagacctatggtccacaaaggccgaaatatttactgttttaggagaaaaaaacaacatgaattgtaataacttggacttacttggttgctcagtcctgatgtgtcctgttaaaacctaagagaaacagcaccaagttcaatctagtgcaatcagcctatcacatctaagctgcttttgccagatctgatatctactcccgaccttaagccaggagactttgtaaacttactaggttataataaaacttaagaactatcgatatttactaatctacatcatggaactatttcaaaagcagtcatatggtaagatggatcaggagtctttaaaaataaaactgagaaagaaaaatcatgtgatcaattcagtagtagagacagaggttggtatcaagtctatgttcatacacttaccagtgccacccagcagggccatacaagacacatgaaatgagatcagctcaagggtgacaagatgaaactgggagagggccggggagacccgaactcttaatattggattccacacaagaggaaaaattttagtccagctcccagcatggcagctaatggcaagttagtaccataaagccaactcttggaatatacctgacttccacgataaaatggagatgagtgcaggggtgagtgtatagttaagaaaacaaacaatatattactagtccaggtggtagatgacagatttttattatttacacttctctcaaattattacattcagcatgttttgctttttatgttatttaaagtataaaccctcatataattccctaagatgggtggcatgccaagtagctaaatgaaatatcatcccagcccaaaagtacttattcgaatgaaatattacatttttcttaaataaagcaataaattaggtaccctattatcatggtattttcttttttggccagcttttccagataaggttgtattgctactgcaactaacaaaaaagatgtggcagggctgggcacggtggctcacgcctgtaatcccagcactttgggaggccgaggcgggcagatcacgaggtcaggagatggagaccatcctggcccaacatggtgaaaccccgtctctactaaaaatacaaaaaattagccaggtgtggtggcaggtgtctgtagtcccagctcctcnggaggctgaggcaggagaatcgcttgaacgcgggaggcagaacctgcagtgagccaagatcatgccacagcactccagcctaaactacagagctagaaagtggctagagcagcc

SEQ ID NO: 22784 - DNA, 4307 bp, Homo sapiens
cgcggggtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagcagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaaaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggttaaaaggaaatgcttaccactaagatgtcagtattctcctcatggatattttcagtctcaatgttgccagtctaatagtatagtatgtggttgctttactgctgttctccccacccccgtggagttgtgtcattattttaatgaatgtgagctcttgacttactctagaattctaatacagatactttctgcacta

SEQ ID NO: 22785 - DNA, 3078 bp, Homo sapiens
cgcggggtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagcagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaagtcgaccagttccgaacataaaaccgcgcacaccgactatagaggaacaaccaccgggcggagtgggcggaggaacccagacaagaacatcaaaataggagaagtaataaaggtaatg

SEQ ID NO: 22786 - DNA, 1698 bp, Homo sapiens
cgcggggtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagcagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgt

SEQ ID NO: 22787 - DNA, 2735 bp, Homo sapiens
ccggccccaggttgactaacccagtagactaactagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggttaaaaggaaatgcttaccactaagatgtcagtattctcctcatggatattttcagtctcaatgttgccagtctaatagtatagtatgtggttgctttactgctgttctccccacccccgtggagttgtgtcattattttaatgaatgtgagctcttgacttactctagaattctaatacagatactttctgcacta

SEQ ID NO: 22788 - DNA, 2245 bp, Homo sapiens
cgcggggtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagcagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactccagcctgggcaacaagagcgaaactctgtctaaaa

SEQ ID NO: 22789 - DNA, 5805 bp, Homo sapiens
ggggggagcgagcaggaggacgagacttcccaggacagtctagaaaaccagcttgagcccacctctctagttaatagctacgtggcgctcccatctggctgttcctgtactgaagttctcagtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagcagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggttaaaaggaaatgcttaccactaagatgtcagtattctcctcatggatattttcagtctcaatgttgccagtctaatagtatagtatgtggttgctttactgctgttctccccacccccgtggagttgtgtcattattttaatgaatgtgagctcttgacttactctagaattctaatacagatactttctgcactagtatcacttttattattgcagttccatttaaaagcataactggctaagtcaccgccccacccgccgcattacatttcctaaaacatactgctgccaaagaccaactgtagaatccttaagtcctgttcaagtgtcacttcattttttattaggggtttcttagttggagggcatgagaaacttggccctttccaatgttgtcttcacattggagtataagaattctctataggactcttttaatttttttttttttttggtagagatggggtcttgctgtgttgcccaggctggtctcaaactcctaggcttaagcagtcctccagcctcagccttctcaaagtgctaggatgattggcatgagccacctcgtctggcctgcaggtctttttaagcatttgctgttcaataataagcatcttctttatgcctagtatttgtgataagagcacaaaacaattttctaatctcaaagagcttatattctagtggggtagagataagtgatttatcttggtgtagttttggcttttttgtttgtttttttgagacagcatctcacactgtcgcccaggctggagtgcagtggtgcaatctcagcttactgtaacctccgcctgccaggttcaagcgattctcctgcctcatcctcccgaggagctgggatcacaggcgcctgccaccacgcccggctaatttttttgtatttttagtagagacggggtttcaccatattggccaggctggtctcaaactcctgacctcgtgatccgcctgcctcggcctccctaagtgctgggattatgggcgtgaaccaccgcacctggcctatcttggtgtttttacatccttcagtatttttcaaggttttacagcttttttatctatagacttataccatcttcaaaagcaatacaattttatttgtagacgtgatttcccccaccaaatgcacattttatggagctctaggacaaaagtcaggatgaaaagtaatctatcgctggtgctactttaataccttcctgactggtgccactggctaaattctagcagtacgatgagagggccattaaggcctatcttagcaagcaagacattatagcaaagacctaaacactcaaaggttcaacgtcttctagccagggaactattctctaattcttccaccttgatatgatttcagcaaattctgataacccggtattactcttaatgcatttttgtaacatttgacaaacatctcccaatatgtagactcccactctcctgatgctaatcagtatcagacaatggaagtaaattttcctgcttttctcaacttttcctcaaattcatgttagtgaagtactttcatttggccatcattatttatcaaccttaagaaacatgcctattgacgaagtaaatatactaggaattcaacgtatctacgggaatgtggacaaagacatataccaagacaaggcactagagtgaaaagccattaaaataaaatgctcagcagcaaaggatttgtaatggttaacttgcaatatatccatatggtgtaatattacagtcattagaaatgacatttgcgtaaggatctgagtggaaactgatacagcctgtcggagagctactgagtagtattttatcacagctgcatacataccctttcacccaacagttccactcctgggagtctagtcaacaaatggacaagttgcacaaccaagctatggtcaaatatgtgtgttgtaggatttatgaaactggtaccaatttaatattcaaatgtgattaagtcatggcaatctatttactggatactttgtggttaccaaagagctatgtgctgccacagggagtcctttcaatagtgattgaaaaaggcagaacactactagacagaactacctgttttatgcatgtattggcatacactgaaaaagcttagtcacttaaaatgaggttgtacagattgtagattttgtttttaaacgcctgtatggtttaaaaaatgttttgggaaatagacatgagcagggcagagaactacaacctacaggccaaaccccaccccactgcctgtttgtacggccaacaagtttaaaatttttttaatgttttaggtttttttttttttaaaaaaaatactatgcccatttgtttacaaatcgtctgtgggtgctttctcactacaatggcagaattcagtagttgagacagacctatggtccacaaaggccgaaatatttactgttttaggagaaaaaaacaacatgaattgtaataacttggacttacttggttgctcagtcctgatgtgtcctgttaaaacctaagagaaacagcaccaagttcaatctagtgcaatcagcctatcacatctaagctgcttttgccagatctgatatctactcccgaccttaagccaggagactttgtaaacttactaggttataataaaacttaagaactatcgatatttactaatctacatcatggaactatttcaaaagcagtcatatggtaagatggatcaggagtctttaaaaataaaactgagaaagaaaaatcatgtgatcaattcagtagtagagacagaggttggtatcaagtctatgttcatacacttaccagtgccacccagcagggccatacaagacacatgaaatgagatcagctcaagggtgacaagatgaaactgggagagggccggggagacccgaactcttaatattggattccacacaagaggaaaaattttagtccagctcccagcatggcagctaatggcaagttagtaccataaagccaactcttggaatatacctgacttccacgataaaatggagatgagtgcaggggtgagtgtatagttaagaaaacaaacaatatattactagtccaggtggtagatgacagatttttattatttacacttctctcaaattattacattcagcatgttttgctttttatgttatttaaagtataaaccctcatataattccctaagatgggtggcatgccaagtagctaaatgaaatatcatcccagcccaaaagtacttattcgaatgaaatattacatttttcttaaataaagcaataaattaggtaccctattatcatggtattttcttttttggccagcttttccagataaggttgtattgctactgcaactaacaaaaaagatgtggcagggctgggcagtcgattttcaggaagccacttaatgttcagattcttttcttctctcccaggactttgcagatgctgctgttccctctgcctggagatgttcatctggcctgaatccaaaagtctgtccaagttacttctcttttccatgacagagttacaactatttgtctgtcccccttgccccattagagtatatggtccccaaaggaaagccccatgccattcactcaccacctaatcatccccaacaactagtgggcaaacatgaaacacttttgttgaataatgtgtttcctttagcccagggattacaaagtcaaaggcttacaagggggaaggactagcaggtgtgctcggaggggactctagccaactggagagtaactggtgagaagacaatgacatgctcttagggtgtctgctactcagatcctctcagttaagtcccgtgcacaaaggtgggtcaggtctactgttgccagatcttcagatcattcaaaagttacccgaattctggattttcatgcaaatctcccaatttttaaaaatgttggcatcaaattcagaatgttttaaccagccacactgtgtgggccagggaaaacaggcccaaaggccaggtgaagctgcagttttcaactgctgccttggcctctcccagagccccttaagtcctaagaaggctcagtcaacacactggcactcgtttcatcccactggttgagaaagcaagtcttagcaaagtaatgggggagtcttaccaaaactgcaaaggaaaaaaatatgataccatgaaattagaaattcactgcatttgaaatgaaaatgacttatttctgtacttctataactcacaaatttagcagacatcatttagacatttttgtagtgcaacagatttaaatctggaatttcatggtttgtaaatcactatgtgatactagctataaccatgagcaatattacgggcagtaaatgttgatttctatttcgtttcttgaagttttgtgtggttcatttttaaagtgagattcaa

SEQ ID NO: 22790 - DNA, 335 bp, Homo sapiens
aatagagttataaccttgcagaggtttgagaatgttgtttatatacgaagtgcttctcaggctggaagtatacagttatggttcaccttacaggtgctgctggtgagtagcagccggtacccagaccagtggattgtcccaggaggaggaatggaacccgaggaggaacctggcggtgctgccgtgagggaagtttatgaggaggtgagatgttctttcacacaaattctgtttcggagttttaaaaacaaggccctttgctacataacactaagacagcgagacgggtccaggagtgctttttgcctgatgcaactttatttttaattttaatt

SEQ ID NO: 22791 - DNA, 381 bp, Homo sapiens
tctcgcctagcgggagtcaccatcttaacgtgcgaattgagttgaaagccggataaacctcgagtgctcagcgagaggagggtggaaatggcgtgagtgttgcagcagagcccttgtgcctcttttacatattttccttccatgttacagccgtttgcggtctcggattcgatctaagcatgtttgtggagtaacagacagtcctcgtgcttggaattgagtctagtcttggcaattcttgtgggtccatgaacccgcaagctgttggcataattatgcctcatttttaaaacggccttcccttcttaaagttttctgactgcagaaaaatggttagtgaaaaatgtggaataatgccaaaagggagacgatggactagag

SEQ ID NO: 22792 - DNA, 7846 bp, Homo sapiens
  misc_feature (7732)..(7732): n is a, c, g, or t
cgcggggtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtgctgctggtgagtagcagccggtacccagaccagtggattgtcccaggaggaggaatggaacccgaggaggaacctggcggtgctgccgtgagggaagtttatgaggaggctggagtcaaaggaaaactaggcagacttctgggcatatttgagcagaaccaagaccgaaagcacagaacatatgtttatgttctaacagtcactgaaatattagaagattgggaagattctgttaatattggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggttaaaaggaaatgcttaccactaagatgtcagtattctcctcatggatattttcagtctcaatgttgccagtctaatagtatagtatgtggttgctttactgctgttctccccacccccgtggagttgtgtcattattttaatgaatgtgagctcttgacttactctagaattctaatacagatactttctgcactagtatcacttttattattgcagttccatttaaaagcataactggctaagtcaccgccccacccgccgcattacatttcctaaaacatactgctgccaaagaccaactgtagaatccttaagtcctgttcaagtgtcacttcattttttattaggggtttcttagttggagggcatgagaaacttggccctttccaatgttgtcttcacattggagtataagaattctctataggactcttttaatttttttttttttttggtagagatggggtcttgctgtgttgcccaggctggtctcaaactcctaggcttaagcagtcctccagcctcagccttctcaaagtgctaggatgattggcatgagccacctcgtctggcctgcaggtctttttaagcatttgctgttcaataataagcatcttctttatgcctagtatttgtgataagagcacaaaacaattttctaatctcaaagagcttatattctagtggggtagagataagtgatttatcttggtgtagttttggcttttttgtttgtttttttgagacagcatctcacactgtcgcccaggctggagtgcagtggtgcaatctcagcttactgtaacctccgcctgccaggttcaagcgattctcctgcctcatcctcccgaggagctgggatcacaggcgcctgccaccacgcccggctaatttttttgtatttttagtagagacggggtttcaccatattggccaggctggtctcaaactcctgacctcgtgatccgcctgcctcggcctccctaagtgctgggattatgggcgtgaaccaccgcacctggcctatcttggtgtttttacatccttcagtatttttcaaggttttacagcttttttatctatagacttataccatcttcaaaagcaatacaattttatttgtagacgtgatttcccccaccaaatgcacattttatggagctctaggacaaaagtcaggatgaaaagtaatctatcgctggtgctactttaataccttcctgactggtgccactggctaaattctagcagtacgatgagagggccattaaggcctatcttagcaagcaagacattatagcaaagacctaaacactcaaaggttcaacgtcttctagccagggaactattctctaattcttccaccttgatatgatttcagcaaattctgataacccggtattactcttaatgcatttttgtaacatttgacaaacatctcccaatatgtagactcccactctcctgatgctaatcagtatcagacaatggaagtaaattttcctgcttttctcaacttttcctcaaattcatgttagtgaagtactttcatttggccatcattatttatcaaccttaagaaacatgcctattgacgaagtaaatatactaggaattcaacgtatctacgggaatgtggacaaagacatataccaagacaaggcactagagtgaaaagccattaaaataaaatgctcagcagcaaaggatttgtaatggttaacttgcaatatatccatatggtgtaatattacagtcattagaaatgacatttgcgtaaggatctgagtggaaactgatacagcctgtcggagagctactgagtagtattttatcacagctgcatacataccctttcacccaacagttccactcctgggagtctagtcaacaaatggacaagttgcacaaccaagctatggtcaaatatgtgtgttgtaggatttatgaaactggtaccaatttaatattcaaatgtgattaagtcatggcaatctatttactggatactttgtggttaccaaagagctatgtgctgccacagggagtcctttcaatagtgattgaaaaaggcagaacactactagacagaactacctgttttatgcatgtattggcatacactgaaaaagcttagtcacttaaaatgaggttgtacagattgtagattttgtttttaaacgcctgtatggtttaaaaaatgttttgggaaatagacatgagcagggcagagaactacaacctacaggccaaaccccaccccactgcctgtttgtacggccaacaagtttaaaatttttttaatgttttaggtttttttttttttaaaaaaaatactatgcccatttgtttacaaatcgtctgtgggtgctttctcactacaatggcagaattcagtagttgagacagacctatggtccacaaaggccgaaatatttactgttttaggagaaaaaaacaacatgaattgtaataacttggacttacttggttgctcagtcctgatgtgtcctgttaaaacctaagagaaacagcaccaagttcaatctagtgcaatcagcctatcacatctaagctgcttttgccagatctgatatctactcccgaccttaagccaggagactttgtaaacttactaggttataataaaacttaagaactatcgatatttactaatctacatcatggaactatttcaaaagcagtcatatggtaagatggatcaggagtctttaaaaataaaactgagaaagaaaaatcatgtgatcaattcagtagtagagacagaggttggtatcaagtctatgttcatacacttaccagtgccacccagcagggccatacaagacacatgaaatgagatcagctcaagggtgacaagatgaaactgggagagggccggggagacccgaactcttaatattggattccacacaagaggaaaaattttagtccagctcccagcatggcagctaatggcaagttagtaccataaagccaactcttggaatatacctgacttccacgataaaatggagatgagtgcaggggtgagtgtatagttaagaaaacaaacaatatattactagtccaggtggtagatgacagatttttattatttacacttctctcaaattattacattcagcatgttttgctttttatgttatttaaagtataaaccctcatataattccctaagatgggtggcatgccaagtagctaaatgaaatatcatcccagcccaaaagtacttattcgaatgaaatattacatttttcttaaataaagcaataaattaggtaccctattatcatggtattttcttttttggccagcttttccagataaggttgtattgctactgcaactaacaaaaaagatgtggcagggctgggcacggtggctcacgcctgtaatcccagcactttgggaggccgaggcgggcagatcacgaggtcaggagatggagaccatcctggcccaacatggtgaaaccccgtctctactaaaaatacaaaaaattagccaggtgtggtggcaggtgtctgtagtcccagctcctcnggaggctgaggcaggagaatcgcttgaacgcgggaggcagaacctgcagtgagccaagatcatgccacagcactccagcctaaactacagagctagaaagtggctagagcagcc

SEQ ID NO: 22793 - DNA, 703 bp, Homo sapiens
gatcaggtaatctgtgaatagggacagttttcttttaaatctatacatttatctctttattttctggttaggatcctcaaaggtaatttttaatgaattactaggtcagttttgatgaactagaattgtcatttcggttcgcatagcagatacatgccttactggaacttggtatcaagtgactatatcctaatggaattgaatatgggatgttagagtgttgtttatcagttgagtctgttttggagacagaacttggatgcctttgctcaggatctcttcctatgacagttcttaggtagttgaatgttctctggttgaattgtggttcttggtgactgaagaaggactatctcaagttcccctttgtttctgaatttcccctgtggaatgaaagtcaaaagttgcgtacaaaagagcttttggactgagcctcgatatcattcctttctgtacttttgtgcttttagtgggatgatcttgatccaggctgaaggccagccaggcacctgtatagagtggaatgtatctagatgactgcgttgtttttgttcaatgattagaaactatttattaatcccaaattgtcatgatcaaaatatctatatccatgtctgcataatacatatactgagctggaaattttgccatgaagcaaacgttcattagtgttaagaccattattacgtattatatccatgtc

SEQ ID NO: 22794 - DNA, 387 bp, Homo sapiens
aaggttgaagtggaggtgcagaggatggcattttggggggtatagcatggcaagaaaaagcaaattgcttctttctttttaagaatatttatagacagaaagtgcccccaaatcaataaaaatattaggtttcccaaaagggacttattagtggagcatatttccagagtggagaggaggtggaatccagcttgtatactgaagacatttgaaaatgcagggcagatatccagagtggaggatggtggcgaacagtagtacatccacaagatgggaagtagttgttctgccattgaaatgattattgggaaacaccatgagaagtgcttaggatacaatgttgggtggaaaagctcattataaagtggtctgtgcactgatagaaaa

SEQ ID NO: 22795 - DNA, 922 bp, Homo sapiens
gacatgtcaagcgtgccaaaccttgctctcctaagtttgcttctttccttacacgtgtgctcttaacctcctgccatgccttactattggcaagcagatccctagaacttaggctttaacctgttgactttagagtggcttctaggtcatttcttcttttttacaagtctgcctgtctactaatatgcatcaggtgagtacaagggatagaaaaggcaagaaacaccaaagaggtacttcgtttttattgtttaatctgggttcttaatgggtactcttgagctgtccacattggtgggcattttaaaactaagagcacactaaaagtagaagataccatcacaatgcttatcctggagatgcttgctggggaacagctctgcagccagagcgccgtgcagggcagagtgtaaaactgaaagctggagggctggagaaacaaggactgttttaggttgagttaaagaagacttctgggatggggggatttcacggtgaatggatcttgtaggactggcaggtgggtgtaaggggggcacacatagagggccctgcacaggggacacttaagtactgtggtcctggtgctcagccttttcaccttagcacccctgatattcttttttctctcagtgaattaaaagctgttaccgatcatacagagtgcatttatgaagtagtaattagctttcccatgttttattaatcacatctgtgactgccaatcagagcttctgatcagcatgagataactggtgtgaccatactgagttgctgtaattctagcccagagcaaagaaacttgatgtctctgtcagtgtctgcagccttatcaggggtaaattcctgttcagcctactgcaatgctgaaatagcttgaagatcctcattactacctttgtggaccctcgaggggcctcag

SEQ ID NO: 22796 - DNA, 370 bp, Homo sapiens
gccaaagagctgagacagaagtacaacgtgcgatgcatgcccatccaaaaggatgatgaagttcaggttgtatgaggacactataaagatcagcaaattggcaaagtagtccaggtttacaggaagaaatatgttatctacaatgaatgggtgcagtgggaaaaagctaatggcacaactgtccacataggcattcaccctagcaaggtggtcatcactaggctaaaactggacaaagaccgcaaaaagatccttgaacggaaagccaaatctcgccaagtaggaaaggaaaagggcaaatacaaggaagaaacaattgtgaagatgcaggaataaagtaatcttatatacaagctttgattaaaacttg

SEQ ID NO: 22797 - DNA, 426 bp, Homo sapiens
gaagaaatcataagccctggaccccgaacctcggcggacttcccacacacctcttaagatggtggagaggtatgaggtaatggcttccaggtgtctcaggtcatctgggccaagggggaccctggctggaaggagcagaagagtaagaggaaaagtgcagggtgtgcgggaagaaatggggaatctgaggttctgagagcccccatggagggtgcattgtagctgctgttagcagtctgctgggcactggctgggggaaggtcatgaaaacaattgctttacaaagagcatccacagaaagtgtatttgaattacagttctttaatcaagttgttttactgacattggaactttgacctaagggttttaaccctcgtgtaaaggacatcttttttttttttcttttttttttgagacagactctca

SEQ ID NO: 22798 - DNA, 617 bp, Homo sapiens
cgttagaaggttactagttttaaagtaattagaaactaataaagtatgcaccgcctaggctatactgaatgtaatgtaattccttttggtaattaataatacctctaggaacacgttacaaaaataagagccatcagctgtagaatatcatattcataaatagtttataatgcaaaacagtaactttggtacctactgggtctattggttggaattcttttaacccttttcaataattatggagacacttgtccagaatttattatataaacttttttatacattagacttttacaaacaaatgctctcaaaattcaatattttcttcatgttcagtcaggatattaattcctagcttgctatgccagagtggtaaaagggggtagggcttcattttcaaaatgaacccagcaaagggaacccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacacta

SEQ ID NO: 22799 - DNA, 609 bp, Homo sapiens
gctgttgtccagtgtccccagcaccgagcgagtttgagtccatcagtcagtggatgccattttgaaggtgcagtctggtttcatggttagctgccataacatatgccaagtatcctgctcacatttacgtctctgaacaaatacgcatcagtctggtttcatggttagctgccgtaacatatgccaagtatcctgctcagatttatgtctctgaacaaatatgcattctgctttgttgtgagttccagacaagcactttaaccaaattggcaggcagtagagatagggaaggagtaattgaaaagtattagaaaataaaatgatccaggccaggtgcggtggctcatgcctgttaattccagcagtttgagaggcccaggtgggtggatcccttgaggttaggatttcaagaccaccttggccaacatggtgaaaccccatctctactaaaaatacaaaaattaattcgcgtagtggcacacacctgtaatcccagctactcggaaggctgaggcaggagaatcacctgaacccagatagcggccgttgcagtgagtcatcattgcaccactgtactccagcctcggcaacagagcgagactccatctc

SEQ ID NO: 22800 - DNA, 408 bp, Homo sapiens
cctggactgcatcatgaggaagcctttggagggtgttaagcagagtggtgacatgggcatgtcagagctttagatatatcatatggccaccatgtggagcctggtttgggggcttgagaaaagcaaaggtagaggcagttaggagattgttggaaagggttcaagaaaaactattgccagccaggcgcggtggctcatgcctgtaatcccaacacgttgggaggccgaggcgggtggatcatgaggtcaggagttcgagaccagcctggccaacgtggcgaaaccccatgtctactaaatacaaaaaattagccgagtatggtggcgggcgcctgtaatctcagctacttgggaggctgaggcaggagaattacttgaaccagggaggcaaaggttgtagtgagtcaa

SEQ ID NO: 22801 - DNA, 200 bp, Homo sapiens
cgggttttcgctgttttagccaggatggtctcgaattcctgacctcaggtggaccacccacctcggcctcccaaagtgctgggattccaggcgtgagccaccgcgcccggcctgccattttcattaaccacatatcttcgttgtcactttagcagttgtaggagaatctgctgacctcgcttcacaaattttttgaatct

SEQ ID NO: 22802 - DNA, 497 bp, Homo sapiens
gatctgctctcctcagcaatcagaagcttgaaactctggacctgggccagaatcatttgtggaagagtggcataattaagctctttggggttctaagacaaagaactggatccttgaagatactcaggttgaagacctatgaaactaatttggaaatcaagaagctgttggaggaagtgaaagaaaagaatcccaagctgactattgattgcaatgcttccggggcaacggcacctccgtgctgtgactttttttgctgagcagcctgggatcgctctacgaattacacaggaagcgggattcgggtctctaagatgtcttatgaatgcaggtcagagggtcacatgttaacactagagtctgtcgagaggtaggatttgacactggttttctcactatttttgggagattctgcacgagtcacgcacccccttcacatgacgctatgtactttctcacagggataataaagttagagcactctcgttgcagctgcg

SEQ ID NO: 22803 - DNA, 648 bp, Homo sapiens
agtgagctgagatgacaccactgcactccagcgtgggcagcagagtgagactccaccttaaaaaaaaaaattacataaaaaaaccacgaaaggctttgttcatttctatctttgggataatattttttcacttaatatatgtatcaacctatatttatttgagtactttctcatttacatctttaatccttatggaatttattttgtgtgtggtatgagtgttgcatttgcaattaaagaatgctatactgatggcctactggtatatttcattttaataacctggttgcctagctctgaagaagatttaaaagtcctctaacttttcatgccaaagaatgaattaattttctcaaaatgtttccactttcttttcattgtgcccaaattactctattggaccatctgcttttctaagattaaaactgctttctggagattggttgcacagcaacataaatgtacttaataatactgagtcatacacttagaaatggttaagatggtaaatcttgttatgtgtattttataatttttcctttgtcttaataattctatttttaaggaagctattctaaggaaataatctaataggaaaaaacccccagggaatggtatctcaattaaaaaaaataacaaaataactta

SEQ ID NO: 22804 - DNA, 1118 bp, Homo sapiens
ccaatgaatgttaataatataaggatataaacatgtcacatgacagtgcacatacatacagtattaatatacatgtattttacatatgtatttctgaaggcaatatattaagataaatttatctctggagtgaaagtttccaggtgactatattttgatttctagtgttaatattacttttgtaatcaagaaagttttaaatgttttttaaatagaaattggattttaattgcacctactgtcctgtttgaaaagctataccatgaaattatagaacatttcaagtgaacattcacagaacctagtaacagccctagccagtgctgctaaataagacacttcgtagatttttttttacagttagttagtaattatttggaatttcaaaaaaaaatttttttttccataaaactcctaacataaagggaccaggtccttattctaaactttggattaaagactgagggaatataacatctaatacatacttaaccattaccgtgactttttacttttttcccttttcctattttaaaatattgttttaggtttgtttttatttaataataattattttgaaggctattacttattgcgcattgatgtgccagatactgagctcaatgttttctcctcacaccctcttaggttaaatgaaaattatgcaaatgaccaagcaggtttaaaaaggttagggccatacaattatgtcaaattccaaactctgcttaactaccgtggtaacctttgatgtcctgtttctcaggcctgtggttctttaattttttataaaaaaggggaagagggatgaggtatcagatagctgatgttgaattcaaccgtttattttccaaagtagaaatacctatttatttttttcctgattatgaacattattttttaaaaggcaatttggaaagtgaaattttccctcgatataccataatttacaacagggtaccaaaatgtacactgtttatttttggaataattttggcagcagtctaaactttttgggatattacctaactgcatgtgaatggtcagttaccttgtataaagtcctaaggtgatgtgatttctctgacctcaatcattatcactttataggatatata

SEQ ID NO: 22805 - DNA, 458 bp, Homo sapiens
ccttccttctactcaaatttaaacatgactccccaggagccaaccaattcacccaccatatattccaaatctaccaagaatgcttagctccccttccccacaaggaagaaagggaggattaggcattccttttgctcctccttacaaaataatataataataataatgaaaatatggccaggcacagtggctcaagcctgtaattccaatactttgggaggctgaggtgggtaggttgcttgagcccaggagttcaagaccacctgggcgacgtggtgaaaccccatctctacaaaaaaaatccaaaaattagctgggcatggtggcacgcgcctgcagttccagctacttgggtgctgaagtgggaggatcgcttgagcctgggtggtcaaggctgcagtgagctgagatcacaccactgcactccaacctgggcaacacagcaagaccctgtctta

SEQ ID NO: 22806 - DNA, 489 bp, Homo sapiens
cagagttctaaaaccaaaatgaaaagtatagagatgattgtcctgtgaaatggccccaagcctcagacccattaccatctacctctggcctcacttgggggctactgtagatgctcagcacagaacctcttagctgtggttgtgacttcctggctggccaggcctgtaagaggcggaggaagaagtgctgtggcgagctctgtgactcagaggaaagcagccaggacatgacgtcctgcacgactgcctggggtggctgcagggaggtggcctagggacagatgaagctgcagtggggaccacctcccctgcagaagcagttttcttgtccctcctcatccaaacacactccaacttaaaaaatcattatgcataactccgaaagcaggtccatgctgtacctgtgtgtgtcctgccagatttctttgttcctgggggaaaacagcaataaacatcacattccttttcagtgttgaattgctactgctt

SEQ ID NO: 22807 - DNA, 706 bp, Homo sapiens
aaatatattgcagcttaagtgatttagccagattctcctccccacatctctccaggacacaattgtggttatcagttaggacactcttcactttgttttgataattctgagtgtgcaaggatgcttagaagacagttcttcctcctcgctccataggcttcccaaggagcacacaccaggacatcaggatgagagtcaagccaggttccctgtgcacacacatacacatgcatacactcatgcacacacacaccaccaccaccaccaatctccagccttggctcatcacccagaatgactgggatagagttagatgtagaattagatgtctagggaatttcccaggattattctagggcagaggtatcaaactggtggccacctgtgactctgcctgcctacaaatgaaatgtgtttggtcttcagaatgcttctgataaagttcagttaggagcccacatttaaatatggcaaggttttacatagaaacctgaattttcaatttggaaaatctggaagctgcagcaatcctgggccacatttccttatggtgacacttggttcagcccttttgaggcaaagcacgtcctctgcagttcactgcagccttgcaatcccaaatttatggacagtttcagggcagcagtacttctttcacacacagtgctaatatcaatgttttgaatgttcctattagatctcattt

SEQ ID NO: 22808 - DNA, 633 bp, Homo sapiens
tattaagaacttccactgtggcaagaatttaagcgaaaatgattcacagcccagtgtgaaataacagaatgcagccatttgagaagcagttgtaaattttacctactatgtatattgcgtatatgctttttaatttaaaatttccttatgctttttctttggtttttctagacttgatctattttttctttcattcctttgaaactagagttttgcattaaaaagtaaaaggagtatgttgataaacagaattctgacactacagaatcagctacaagagtctacatttaaagactagtggaaaatgagtgaagttcatcctcataaagtacttctgaatttgagttgaatacatggcaccttcaggatattatcctgctgctttgagatcctgaatatgccttgcaagtaataattaaactttatgctccatcctggctaacacggtgaaaccccgtctctactgaaaatacaaaaaaaaattagccgggcgaggtggcgggcgcctgtagtcccagctactcgggaggctgaggcaggagaatggcgtgaaccccagggggcggaggctgcagtgagccgagattgcgccactgcactccagcctgggcgacagcgagactccgtctcaaa

SEQ ID NO: 22809 - DNA, 506 bp, Homo sapiens
tattaagaacttccactgtggcaagaatttaagcgaaaatgattcacagcccagtgtgaaataacagaatgcagccatttgagaagcagttgtaaattttacctactatgtatattgcgtatatgctttttaatttaaaatttccttatgctttttctttggtttttctagacttgatctattttttctttcattcctttgaaactagagttttgcattaaaaagtaaaaggagtatgttgataaacagaattctgacactacagaatcagctacaagagtctacatttaaagactagtggaaaatgagtgaagttcatcctcataaagtacttctgaatttgagttgaatacatggcaccttcaggatattatcctgctgctttgagatcctgaatatgccttgcaagtaataattaaactttatgctccatcctggctaacacggtgaaaccccgtctctactgatttttcaccatggagtttcaccatgttggccaggctggt

SEQ ID NO: 22810 - DNA, 307 bp, Homo sapiens
aaaaaatgtagaaaaaaacagggtttcccctgtttggcccgggggggtcaaaatccctgaattgggagccccccccttgtggccccccaaaagcttggaaaccccgggataagccccccccttcaagccggggggcagggagggccccgtttcaaaaaaaaaaaaaaaaaaaaactttatgctgctgcttaggaaagatgaaattgggatgtggggacaaggatctgagcaaacaaatctggctttttggtgacaactatgcttagcctatttgaacaagagttatggctccattggaaagcaggac

SEQ ID NO: 22811 - DNA, 392 bp, Homo sapiens
actccagtgttcttccattaaatacccattttcttcagttgagttggaattggctttatgatacttgcaatgacaagagttttgactaatagcttatgcgtctgttaacattggtaaccaggaagaacacacagcagcatggaaaaggaattttgatgaattttacaaagagcacgatataaaattgtgactgatatgcattgcagttatttgcaataatcatgcctatgcaagacaagtgaaagagaagtattttaaaaatctatgggtggctgtaatcccagctactcaggaggctgaacatgagaattgctgaaacccaggaggcgaaggttgcagtgagccaagattgcaccactgcgccccaggctggaccacaaagcgaaactctc

SEQ ID NO: 22812 - DNA, 388 bp, Homo sapiens
gttattttaggcttaccgattctactactcatttgaaaatgatgaagtagtgcattctttcttacaaagaaagtttagtatccatccagtcagttacttttcatcctagtataatacccaatatgtaaaatcctgactgatggctgggtgcggtggctcacgcctgtaatcccagcactttgggaggccgaggcaggcggattacgaggtcaagagattgagaccatcctgaccaacatggtgaaatcccgtctctactaaaaatagaaaaattagctgagcatggtggcacattcctgtagtcccagctacttgggaggctgaggcaggagaatcgcttgaacccaggaggcagaggttgcagcaagccgagatggcgccactgcac

SEQ ID NO: 22813 - DNA, 407 bp, Homo sapiens
  misc_feature (371)..(371): n is a, c, g, or t
  misc_feature (393)..(393): n is a, c, g, or t
  misc_feature (403)..(403): n is a, c, g, or t
ttaagtgatagtaagttaatagtaacgtatacagattttataacataacactcataaagctagcaactttatagatttgtaaaaatgcagttgaaatgaccactgcagcttaatagttaatagttctttttggtgtctaatactcagaaacctgttggaaactaattttgtgtagtttgatatccactggccaaattaccatttgaatttactaaagaattcattgcttcactactgtaccatagtttataaaggactttttgagtgctctttgattcttgtctctgaaggaatcttaggcataatgccaacatagtgccaaccataatagttttccagtttaagtacttcctatttctatcttaaagggntgggcatgtgttttaaacaatntttaggttcnggta

SEQ ID NO: 22814 - DNA, 164 bp, Homo sapiens
agacgtcctctcagtaagggaccagatctcacaaaactcccggttctcagctgagctaggggcttggcatcaagtctttgtttgatctgatttactggataacctcaggcaggtgacttgaccgcacttcggggactttatcaggtaatactgtcaagagcagt

SEQ ID NO: 22815 - DNA, 744 bp, Homo sapiens
gagaccaggagttcgtgaccagcctgggcaacatggcaaaaacatgtctcttcaaaagtacaaaaaattagctgggcgtggtggcatgcacttctagtctcagctagttgggaagccgagaggggaggattgcttgagcctgggaggcagaggttgcagtgagccaagatcatgccactacagccttgatgagagagtgagaccctgtctcaggaaaaaaaaaaataattcatttccttgtggctttatgagtaaggacccagatttttttctggctatcatctggaagccactctcaagtcctagaggctgcccacagttctttgccaaagggttcactaacatgtctgttcacttacgccagtaaaagccaggcacagtggctcatgcctgtaatttcagctcagtgaagtagaggtgggaggatcacttgagaccagaagtttgagaccagccaagggctttcatttaattaagttaggcccacccaggacctgaccccaaaatcagctgattcacgacctcaattacatctgccaaacctcttatttttgccatgtttattacctaagcaatccacactaggggtcaggagtgggttgtggggacagcagaagcaggagttgtggggctacctagggtctgtcacgtggtcctttaataatctcatataatcctttcttgtgaattcctatggcatctatatggaagctattagtataataatatattctgtgcaatgtt

SEQ ID NO: 22816 - DNA, 160 bp, Homo sapiens
aagcgaggtggtaattggggctcataatgatggctgaagtgtcctctgaattatcaaagagcaattacattacagccagtcccattttagtgttaaacacattgtactgtatttgattctttggaaattggtgatccctttgtgatctctatgatgattc

SEQ ID NO: 22817 - DNA, 2023 bp, Homo sapiens
cattctggaaccgggaaggtacacccaggcatgacaatagcttctctcctcacagaaatttaactgatttcttcattctccatttagcaaggtcatggaagatttggaggaaacattatttgaagaatttgaaaactattcctatgacctagactattactctctggagtctgatttggaggagaaagtccagctgggagttgttcactgggtctccctggtgttatattgtttggcttttgttctgggaattccaggaaatgccatcgtcatttggttcacggggttcaagtggaagaagacagtcaccactctgtggttcctcaatctagccattgcggatttcatttttcttctctttctgcccctgtacatctcctatgtggccatgaatttccactggccctttggcatctggctgtgcaaagccaattccttcactgcccagttgaacatgtttgccagtgtttttttcctgacagtgatcagcctggaccactatatccacttgatccatcctgtcttatctcatcggcatcgaaccctcaagaactctctgattgtcattatattcatctggcttttggcttctctaattggcggtcctgccctgtacttccgggacactgtggagttcaataatcatactctttgctataacaattttcagaagcatgatcctgacctcactttgatcaggcaccatgttctgacttgggtgaaatttatcattggctatctcttccctttgctaacaatgagtatttgctacttgtgtctcatcttcaaggtgaagaagcgaacattcctgatctccagtaggcatttctggacaattctggttgtggttgtggcctttgtggtttgctggactccttatcacctgtttagcatttgggagctcaccattcaccacaatagctattcccaccatgtgatgcaggctggaatccccctctccactggtttggcattcctcaatagttgcttgaaccccatcctttatgtcctaattagtaagaagttccaagctcgcttccggtcctcagttgctgagatactcaagtacacactgtgggaagtcagctgttctggcacagtgagtgaacagctcaggaactcagaaaccaagaatctgtgtctcctggaaacagctcaataagttattacttttccacaaatcagtatatggctttttatgtgggtcctctgactgatgctttcagattaaaattgtttccaagatagagagccgactccactttcatagttattgtttctggtcactatataggcatcacatttttgtgtggatatgaaacttaggaaggatcctcttgactccttgtgatgtggcaataaattttttttaaaaaactgaaaatacttaggaaggatccgcataatttttttctgcaacttaaatgaaatgcatcattcttgttaattataccatggtgaattaatcacttttgaagcaatatcagttattttttgaataataacttttctaaagccttaagtcttaatattaaatatatgattagccaggcacggtggctgacacctgtaatcccagcactttgggaggccaaggtggggggattacccgaggtcaggaattcgagaccagcctgaccaacatggagaaaccccgtctctactaaaaatacaaaattagccggtcatggtggtgcatgtctgcaaacccagctactcgggaggctgaagcaggagaatcacttgaacctgggaggcagaggttgtggtgagccaacatcacaccattgcactccagcctgggcaacaagagtaaaactctgtctcaaaaataaataaataaaatagataaataaatatatgattaactaattttaaaaatgttaaaatgtattcttaaattcattttaattttgtacaataacctgctagacacatttttaaaatgcaacatgtgtacttaatttctttatgtaatctatgtatatacatttatgaattaaagtaattgttggttatctta

SEQ ID NO: 22818 - DNA, 992 bp, Homo sapiens
ttttttttttcatttttagtggagatggggttttaccatgttagccaggatggtctcgacctcctggcctcatgatctgcccacctcatcctcccaaagtgctaggattacaggcatgagccaccgcgcccggcccatatatagtcttttaaaatgtagtatcaggaggcaaaagaaagcaagaaaactttctggaggacagtttttcctaaagcaaaaaataaatggctttactaacaaatcacttcagaaattccatgtattcagttttgtaatcttggggagagaaggaatttctaaatgtcataaagataaaagccataaatgaaaatattaatgatttcactgcataaaaacttaataccacatcaaatgccagaaataaaatgaaaagtcatataacctgagatggatggcagaaaaatgggttaacatccttagtatacaggaacctcttgcatatgagttaatcagaagcagccacagataccaatagaaaaatgggctaacaatgaaaaattcaccccccaaaatgcagattgccattgaagataggaaatatgttcaaacttattagtagtcaaatgtaagctcaatttgcacctatagaattggcaaaaaatgagaaattaattataatacccgtgtagtaaaatggacactctgttgtactattggtcattgaatcaaagcagtcttgacagtatgcaaaatccttaaaatcatggacacttttgatcaagcaattccatatgtaagagtttatcctaagcaaatcattaggatgttggtcaaagtgtacagtgttaggaggaatacattttttgagataacactgcacaacatggtaactacagttaataatggtggtgctgggcacggtggctcacacctgtaatccccgcaccttggaaggctgaggtgggtggatcgtttgagcccaggaattcgagaccagcctgggcaacatggtgaaaccccatctctaccaa

SEQ ID NO: 22819 - DNA, 1472 bp, Homo sapiens
tttttgaaggtcacctgtatttccatagatatgtaattttatttaagcaggtttattatattaaggcggcgaggcagcgccgaagactacaagttccagcatgcaccgcgtccgggcgggttcgggctcccagcgagggcttcagggacgccagcccggaggcatcggccggaagtgtcgtagggcaaccacgtagtactctctgcgcatgtgcaaagcgctgtcgggggccgccctagctgccgtcgccgccgccggggctctatggtctctccctagagctttgccgttggaggcggctgctgcggtcttgtgagtttgaccagcgtcgagcggcagcaacatggaggaattcgactccgaagacttctctacgtcggaggaggacgaggactacgtgccgtcgggtggagagtatagtgaagatgatgtaaatgaattagtgaaggaagatgaagtggatggtgaagagcagacacagaaaacccaagggaaaaaaagaaaggcccagagcattccagccaggaagagaagacaaggtggcctctcattagaagaagaggaagaggaggatgccaattcagaatctgagggaagcagtagtgaggaggaagatgacgctgcagagcaggaaaaaggcattggatcagaggatgccaggaaaaagaaggaggacgaactctgggccagcttcctcaatgatgtgggaccaaaatcaaaagtgcccccaagtacacaagttaagaaaggagaggagactgaagagacaagttcaagtaaattgttggtaaaagcagaagagctagagaaacctaaagaaacagaaaaagttaaaatcaccaaggtgtttgattttgctggtgaagaagtaagggtaactaaggaagtggatgctacatctaaagaggccaaatccttcttcaagcagaatgagaaagaaaaaccacaggctaatgttccttcagctctgccatcactccctgccgggtcagggttaaaaagatcaagtggcatgagcagccttttggggaaaattggtgccaagaagcagaaaatgagcacccttgagaagtccaaactggactgggagagcttcaaggaggaagaggggattggtgaagaactggccatccataatcgagggaaagaggggtacattgaacggaaagccttcctcgaccgagtggatcacaggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagagg

SEQ ID NO: 22820 - DNA, 1401 bp, Homo sapiens
tttttgaaggtcacctgtatttccatagatatgtaattttatttaagcaggtttattatattaaggcggcgaggcagcgccgaagactacaagttccagcatgcaccgcgtccgggcgggttcgggctcccagcgagggcttcagggacgccagcccggaggcatcggccggaagtgtcgtagggcaaccacgtagtactctctgcgcatgtgcaaagcgctgtcgggggccgccctagctgccgtcgccgccgccggggctctatggtctctccctagagctttgccgttggaggcggctgctgcggtcttgtgagtttgaccagcgtcgagcggcagcaacatggaggaattcgactccgaagacttctctacgtcggaggaggacgaggactacgtgccgtcgggtggagagtatagtgaagatgatgtaaatgaattagtgaaggaagatgaagtggatggtgaagagcagacacagaaaacccaagggaaaaaaagaaaggcccagagcattccagccaggaagagaagacaaggtggcctctcattagaagaagaggaagaggaggatgccaattcagaatctgagggaagcagtagtgaggaggaagatgacgctgcagagcaggaaaaaggcattggatcagaggatgccaggaaaaagaaggaggacgaactctgggccagcttcctcaatgatgtgggaccaaaatcaaaagtgcccccaagtacacaagttaagaaaggagaggagactgaagagacaagttcaagtaaattgttggtaaaagcagaagagctagagaaacctaaagaaacagaaaaagttaaaatcaccaaggtgtttgattttgctggtgaagaagtaagggtaactaaggaagtggatgctacatctaaagaggccaaatccttcttcaagcagaatgagaaagaaaaaccacaggctaatgttccttcagctctgccatcactccctgccgggtcagggtgagtatttgagtctcactccctgatgtacttggcacgttggagaagctttcagtgcaaatacctactttcgctgcagatcagactccttgcctgagagagagaattatgatgctgctttgcctttgctgcaatatttaccagaatggaagatgcaaaggaaaattagccataactttctcaggaggattgcttgaacccaggagtttgtgaccagcctgggcaatacagtaagaccctgtctcttaaaaaaaaaaaaattagctgggcatggtggcttgcacctctgtcctagctactgtggaggctgaggcaggaggatcccttgagcccagaaggttgaggctgcagtgagccgtgattgtgccactgcactccagcctgggtgacagagagatcctgtctctt

SEQ ID NO: 22821 - DNA, 751 bp, Homo sapiens
cagtgactctgagccatgttcattctttgtccagtagtatcacaagagctagagaatcctaaaacatccgtcacatgttaaaactcaccaaagtctatagatccagctggtcaagaagtaagggtaactaaggaagtggatgctacatctaaagaggccaaatccttcttcaagcagaatgagaaagaaaaaccacaggctaatgttccttcagctctgccatcactccctgccgggtcagggttaaaaagatcaagtggcatgagcagccttttggggaaaattggtgccaagaagcagaaaatgagcacccttgagaagtccaaactggactgggagagcttcaaggaggaagaggggattggtgaagaactggccatccataatcgagggaaagaggggtacattgaacggaaagccttcctcgaccgagtggatcacaggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagaggataatgaagatgaaaaaaacacacaccttc

SEQ ID NO: 22822 - DNA, 912 bp, Homo sapiens
ttttttggtgctcagactttcatacattaagtctttttactatttcaaagatttctttgtcattctttggttgttacatttttctatagaaaaacaaaatagcatttttttttaaagaccatgttggatttgtcaaacctgactccagtgccagagtaaagagcgttgtactaacttaacgcttgtgtctgaatgaagttggccaaatgcttacatatgtttcctggtggtgattctttcagtattctcagttcacatgccactgggtcatcagaagacaagtatctggatttcggagccaacagtttgcttttatttaagctgcaagaccctccattgccataagatctgccactgccataataacaaaacctcagctggaacttctgctgcagccattgaggttaaaaagatcaagtggcatgagcagccttttggggaaaattggtgccaagaagcagaaaatgagcacccttgagaagtccaaactggactgggagagcttcaaggaggaagaggggattggtgaagaactggccatccataatcgagggaaagaggggtacattgaacggaaagccttcctcgaccgagtggatcacaggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagaggataatgaagatgaaaaaaacacacaccttc

SEQ ID NO: 22823 - DNA, 681 bp, Homo sapiens
cattctgagttgatcttaagctcagcatgtactggggtgtgacccaaacagggaagttgacatcctctctactaaagttaatagaatgagaatgttcagggtcattgttcagtcccagcagtctggtgttcagtgtggacgttggcctgttggctcacaccaggcagagggggttaaaaagatcaagtggcatgagcagccttttggggaaaattggtgccaagaagcagaaaatgagcacccttgagaagtccaaactggactgggagagcttcaaggaggaagaggggattggtgaagaactggccatccataatcgagggaaagaggggtacattgaacggaaagccttcctcgaccgagtggatcacaggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagaggataatgaagatgaaaaaaacacacaccttc

SEQ ID NO: 22824 - DNA, 968 bp, Homo sapiens
tgcaccttgacgctgtgccaagtgctgttttagccctttacgtgtaagatacaccacagcctgtgagtaagcatttgctttgtagattaggaaaccaaggaacatgcagtaaataactggcctagagtcacacagttaagctggaagttggaccttggcatgtgactccaaagccctgcctgaagcgctgctcctcccctccttgcaagcagagacctgccacacagagcccacagaggtctgaagaaggcaggatttcctgttcgtagctcaggagagcagacagtggtgttaagcaggaaaagcacattagaattccagtttacttacagtgctctccacaccaggaaggaaatgccccaaatatgaacatggcttccactaagataaatggccccaatctaggggattcccatttgcatcagaaaaactgttaatctagagatcagagtttttacctgctacatctttcatattttctttccttaggttaaaaagatcaagtggcatgagcagccttttggggaaaattggtgccaagaagcagaaaatgagcacccttgagaagtccaaactggactgggagagcttcaaggaggaagaggggattggtgaagaactggccatccataatcgagggaaagaggggtacattgaacggaaagccttcctcgaccgagtggatcacaggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagagg

SEQ ID NO: 22825 - DNA, 882 bp, Homo sapiens
ttttttggtgctcagactttcatacattaagtctttttactatttcaaagatttctttgtcattctttggttgttacatttttctatagaaaaacaaaatagcatttttttttaaagaccatgttggatttgtcaaacctgactccagtgccagagtaaagagcgttgtactaacttaacgcttgtgtctgaatgaagttggccaaatgcttacatatgtttcctggtggtgattctttcagtattctcagttcacatgccactgggtcatcagaagacaagtatctggatttcggagccaacagtttgcttttatttaagctgcaagaccctccattgccataagatctgccactgccataataacaaaacctcagctggaacttctgctgcagccattgaggttaaaaagatcaagtggcatgagcagccttttggggaaaattggtgccaagaagcagaaaatgagcacccttgagaagtccaaactggactgggagagcttcaaggaggaagaggggattggtgaagaactggccatccataatcgagggaaagaggggtacattgaacggaaagccttcctcgaccgagtggatcacaggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagagg

SEQ ID NO: 22826 - DNA, 582 bp, Homo sapiens
tttttgaaggtcacctgtatttccatagatatgtaattttatttaagcaggtttattatattaaggcggcgaggcagcgccgaagactacaagttccagcatgcaccgcgtccgggcgggttcgggctcccagcgagggcttcagggacgccagcccggaggcatcggccggaagtgtcgtagggcaaccacgtagtactctctgcgcatgtgcaaagcgctgtcgggggccgccctagctgccgtcgccgccgccggggctctatggtctctccctagagctttgccgttggaggcggctgctgcggtcttgtgagtttgaccagcgtcgagcggcagcaacatggaggaattcgactccgaagacttctctacgtcggaggaggacgaggactacgtgccgtcgggtgagcgattccgcctgaggcgagaagcgaattgccccgccccacgcctcacgtgaggcgcgctctgcccccgcgggcgtctgccctgtggcccaggtggtccaggggggctcctgttctcgagcgtccgctccctcaggcccctcatcctcggccgctccggcccgaggcgtgt

SEQ ID NO: 22827 - DNA, 786 bp, Homo sapiens
ttttgatgtatgtatgcaggaggcctagctttctcttacccaccaattcaacacaccactaaagccaagaaaaacagcatcaccatgctgctgtagagaaaagtgaggctcaaagatgttcattcctttgcccagctaatcagtgagctagagctaggacttgaacccatgcttgtgtaaaccggtattctttcttctgcccttaaagtcttgttagaaaattgcaacatcttcctgccacccagcctctaatatactttctcattgataagctgttgccttccttttattttcaccatccttgtttagaccaaatgtgagtggtttggattgtactggaagagtcatgggtggtcactctcggcaccatttactgtaacttagtttatccctgggggatgggactgtgcaggggaggagtttttcctactggattctactgacaaacactgttttcatcttctaggtacattgaacggaaagccttcctcgaccgagtggatcacaggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagagg

SEQ ID NO: 22828 - DNA, 878 bp, Homo sapiens
ttttttggtgctcagactttcatacattaagtctttttactatttcaaagatttctttgtcattctttggttgttacatttttctatagaaaaacaaaatagcatttttttttaaagaccatgttggatttgtcaaacctgactccagtgccagagtaaagagcgttgtactaacttaacgcttgtgtctgaatgaagttggccaaatgcttacatatgtttcctggtggtgattctttcagtattctcagttcacatgccactgggtcatcagaagacaagtatctggatttcggagccaacagtttgcttttatttaagctgcaagaccctccattgccataagatctgccactgccataataacaaaacctcagctggaacttctgctgcagccattgaggtctgtacataggcctcctgctctcgcttctggttccatgtaatatcattgtttataaaaagaattagtgtctgttctgtataaaacaacactgtggggcagaagctttgcagtcattagtaagaggggccaccgtgaactacagttgcattgaaaagcaattcttttccctcttaggaaatagaactttaacttaggcttgcttttataacacctgaaggaatggaagaggaaagagtagtgttctcgagggtaccttaacttacagcttgtgttgtaggtcgagattggctgcattattatgttacatggtttcttgagccatggtgagcatattttccaaaccaaaaatcagcatagctattcggacagtattttttaagtcaaatgtaattacacatttagaagtaaaattaaaagttgagactgtccaggaaaacccagaacatagggatgccttgcctggaagacggga

SEQ ID NO: 22829 - DNA, 432 bp, Homo sapiens
ttctgtaaagtatagctttcctttatcaattggaacaatataaatatttaattcttttccctcaattttcaaaataggtagtaattttaaatagcagtctaaaatggtacaaatttttttttctgtctttttaatatcatgaggggctcacagatttttattcagtgtgttttcattttctaacaattacctgttttaatgttcaggtcttcactgctttggccagtaggagctctttcaggctggatcttgtatccttttaatttgatctttttattattattatttattttttatgagtcggcgtcctgcttactgtagccttcaattcctggcaggagaatcacttgaatccagtaggcagaggttgcagtgagccgagatcgtaccactgcactccagcctgggcaacagagcgagactctgtctcaa

SEQ ID NO: 22830 - DNA, 187 bp, Homo sapiens
atgccagctaatttttgtatttttagtagagacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagagg

SEQ ID NO: 22831 - DNA, 1502 bp, Homo sapiens
tttttgaaggtcacctgtatttccatagatatgtaattttatttaagcaggtttattatattaaggcggcgaggcagcgccgaagactacaagttccagcatgcaccgcgtccgggcgggttcgggctcccagcgagggcttcagggacgccagcccggaggcatcggccggaagtgtcgtagggcaaccacgtagtactctctgcgcatgtgcaaagcgctgtcgggggccgccctagctgccgtcgccgccgccggggctctatggtctctccctagagctttgccgttggaggcggctgctgcggtcttgtgagtttgaccagcgtcgagcggcagcaacatggaggaattcgactccgaagacttctctacgtcggaggaggacgaggactacgtgccgtcgggtggagagtatagtgaagatgatgtaaatgaattagtgaaggaagatgaagtggatggtgaagagcagacacagaaaacccaagggaaaaaaagaaaggcccagagcattccagccaggaagagaagacaaggtggcctctcattagaagaagaggaagaggaggatgccaattcagaatctgagggaagcagtagtgaggaggaagatgacgctgcagagcaggaaaaaggcattggatcagaggatgccaggaaaaagaaggaggacgaactctgggccagcttcctcaatgatgtgggaccaaaatcaaaagtgcccccaagtacacaagttaagaaaggagaggagactgaagagacaagttcaagtaaattgttggtaaaagcagaagagctagagaaacctaaagaaacagaaaaagttaaaatcaccaaggtgtttgattttgctggtgaagaagtaagggtaactaaggaagtggatgctacatctaaagaggccaaatccttcttcaagcagaatgagaaagaaaaaccacaggctaatgttccttcagctctgccatcactccctgccgggtcagggttaaaaagatcaagtggcatgagcagccttttggggaaaattggtgccaagaagcagaaaatgagcacccttgagaagtccaaactggactgggagagcttcaaggaggaagaggggattggtgaagaactggccatccataatcgagggaaagaggggtacattgaacggaaagccttcctcgaccgagtggatcacaggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagaggataatgaagatgaaaaaaacacacaccttc

SEQ ID NO: 22832 - DNA, 1626 bp, Homo sapiens
taaaccattcaaatatccacactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagatcaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggatatttgaatggttttaaaccattcaaatatccacccgaggactacgtcccgtcgggtggagagtatagtgaagatgatgtaaatgaattagtgaaggaagatgaagtggatggtgaagagcagacacagaaaacccaagggaaaaaaagaaaggcccagagcattccagccaggaagagaagacaaggtggcctctcattagaagaagaggaagaggaggatgccaattcagaatctgagggaagcagtagtgaggaggaagatgacgctgcagagcaggaaaaaggcattggatcagaggatgccaggaaaaagaaggaggacgaactctgggccagcttcctcaatgatgtgggaccaaaatcaaaagtgcccccaagtacacaagttaagaaaggagaggagactgaagagacaagttcaagtaaattgttggtaaaagcagaagagctagagaaacctaaagaaacagaaaaagttaaaatcaccaaggtgtttgattttgctggtgaagaagtaagggtaactaaggaagtggatgctacatctaaagaggccaaatccttcttcaagcagaatgagaaagaaaaaccacaggctaatgttccttcagctctgccatcactccctgccgggtcagggttaaaaagatcaagtggcatgagcagccttttggggaaaattggtgccaagaagcagaaaatgagcacccttgagaagtccaaactggactgggagagcttcaaggaggaagaggggattggtgaagaactggccatccataatcgagggaaagaggggtacattgaacggaaagccttcctcgaccgagtggatcacaggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagagg

SEQ ID NO: 22833 - DNA, 1649 bp, Homo sapiens
tttttgaaggtcacctgtatttccatagatatgtaattttatttaagcaggtttattatattaaggcggcgaggcagcgccgaagactacaagttccagcatgcaccgcgtccgggcgggttcgggctcccagcgagggcttcagggacgccagcccggaggcatcggccggaagtgtcgtagggcaaccacgtagtactctctgcgcatgtgcaaagcgctgtcgggggccgccctagctgccgtcgccgccgccggggctctatggtctctccctagagctttgccgttggaggcggctgctgcggtcttgtgagtttgaccagcgtcgagcggcagcaacatggaggaattcgactccgaagacttctctacgtcggaggaggacgaggactacgtgccgtcgggtcttcactgctttggccagtaggagctctttcaggctggatcttgtatccttttaatttgatctttttattattattatttattttttatgagtcggcgtcctgcttactgtagccttcaattcctgggctcaagtgatcctcctgcctcagcctccccagtagatggaactacaggtggagagtatagtgaagatgatgtaaatgaattagtgaaggaagatgaagtggatggtgaagagcagacacagaaaacccaagggaaaaaaagaaaggcccagagcattccagccaggaagagaagacaaggtggcctctcattagaagaagaggaagaggaggatgccaattcagaatctgagggaagcagtagtgaggaggaagatgacgctgcagagcaggaaaaaggcattggatcagaggatgccaggaaaaagaaggaggacgaactctgggccagcttcctcaatgatgtgggaccaaaatcaaaagtgcccccaagtacacaagttaagaaaggagaggagactgaagagacaagttcaagtaaattgttggtaaaagcagaagagctagagaaacctaaagaaacagaaaaagttaaaatcaccaaggtgtttgattttgctggtgaagaagtaagggtaactaaggaagtggatgctacatctaaagaggccaaatccttcttcaagcagaatgagaaagaaaaaccacaggctaatgttccttcagctctgccatcactccctgccgggtcagggttaaaaagatcaagtggcatgagcagccttttggggaaaattggtgccaagaagcagaaaatgagcacccttgagaagtccaaactggactgggagagcttcaaggaggaagaggggattggtgaagaactggccatccataatcgagggaaagaggggtacattgaacggaaagccttcctcgaccgagtggatcacaggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagagg

SEQ ID NO: 22834 - DNA, 1546 bp, Homo sapiens
tttttgaaggtcacctgtatttccatagatatgtaattttatttaagcaggtttattatattaaggcggcgaggcagcgccgaagactacaagttccagcatgcaccgcgtccgggcgggttcgggctcccagcgagggcttcagggacgccagcccggaggcatcggccggaagtgtcgtagggcaaccacgtagtactctctgcgcatgtgcaaagcgctgtcgggggccgccctagctgccgtcgccgccgccggggctctatggtctctccctagagctttgccgttggaggcggctgctgcggtcttgtgagtttgaccagcgtcgagcggcagcaacatggaggaattcgactccgaagacttctctacgtcggaggaggacgaggactacgtgccgtcgggtggagagtatagtgaagatgatgtaaatgaattagtgaaggaagatgaagtggatggtgaagagcagacacagaaaacccaagggaaaaaaagaaaggcccagagcattccagccaggaagagaagacaaggtggcctctcattagaagaagaggaagaggaggatgccaattcagaatctgagggaagcagtagtgaggaggaagatgacgctgcagagcaggaaaaaggcattggatcagaggatgccaggaaaaagaaggaggacgaactctgggccagcttcctcaatgatgtgggaccaaaatcaaaagtgcccccaagtacacaagttaagaaaggagaggagactgaagagacaagttcaagtaaattgttggtaaaagcagaagagctagagaaacctaaagaaacagaaaaagttaaaatcaccaaggtgtttgattttgctggtgaagaagtaagggtaactaaggaagtggatgctacatctaaagaggccaaatccttcttcaagcagaatgagaaagaaaaaccacaggctaatgttccttcagctctgccatcactccctgccgggtcagggttaaaaagatcaagtggcatgagcagccttttggggaaaattggtgccaagaagcagaaaatgagcacccttgagaagtccaaactggactgggagagcttcaaggaggaagaggggattggtgaagaactggccatccataatcgagggaaagaggggtacattgaacggaaagccttcctcgaccgagtggatcacaggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagagggaacaaaaaaagcaaaacgaaataaaaaaacaaggacagaaaaacaaataacaaaacacgaaagaagggggggc

SEQ ID NO: 22835 - DNA, 903 bp, Homo sapiens
cttttgggtctttgctgacatgttccccaccccgcagatggtgtctgtgagcttggagacatccagcatatgttcaaagacctggtgcagagcctttcttaactgacgaactctgggccagcttcctcaatgatgtgggaccaaaatcaaaagtgcccccaagtacacaagttaagaaaggagaggagactgaagagacaagttcaagtaaattgttggtaaaagcagaagagctagagaaacctaaagaaacagaaaaagttaaaatcaccaaggtgtttgattttgctggtgaagaagtaagggtaactaaggaagtggatgctacatctaaagaggccaaatccttcttcaagcagaatgagaaagaaaaaccacaggctaatgttccttcagctctgccatcactccctgccgggtcagggttaaaaagatcaagtggcatgagcagccttttggggaaaattggtgccaagaagcagaaaatgagcacccttgagaagtccaaactggactgggagagcttcaaggaggaagaggggattggtgaagaactggccatccataatcgagggaaagaggggtacattgaacggaaagccttcctcgaccgagtggatcacaggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagagg

SEQ ID NO: 22836 - DNA, 1494 bp, Homo sapiens
tttttgaaggtcacctgtatttccatagatatgtaattttatttaagcaggtttattatattaaggcggcgaggcagcgccgaagactacaagttccagcatgcaccgcgtccgggcgggttcgggctcccagcgagggcttcagggacgccagcccggaggcatcggccggaagtgtcgtagggcaaccacgtagtactctctgcgcatgtgcaaagcgctgtcgggggccgccctagctgccgtcgccgccgccggggctctatggtctctccctagagctttgccgttggaggcggctgctgcggtcttgtgagtttgaccagcgtcgagcggcagcaacatggaggaattcgactccgaagacttctctacgtcggaggaggacgaggactacgtgccgtcgggtggagagtatagtgaagatgatgtaaatgaattagtgaaggaagatgaagtggatggtgaagagcagacacagaaaacccaagggaaaaaaagaaaggcccagagcattccagccaggaagagaagacaaggtggcctctcattagaagaagaggaagaggaggatgccaattcagaatctgagggaagcagtagtgaggaggaagatgacgctgcagagcaggaaaaaggcattggatcagaggatgccaggaaaaagaaggaggacgaactctgggccagcttcctcaatgatgtgggaccaaaatcaaaagtgcccccaagtacacaagttaagaaaggagaggagactgaagagacaagttcaagtaaattgttggtaaaagcagaagagctagagaaacctaaagaaacagaaaaagttaaaatcaccaaggtgtttgattttgctggtgaagaagtaagggtaactaaggaagtggatgctacatctaaagaggccaaatccttcttcaagcagaatgagaaagaaaaaccacaggctaatgttccttcagctctgccatcactccctgccgggtcagggttaaaaagatcaagtggcatgagcagccttttggggaaaattggtgccaagaagcagaaaatgagcacccttgagaagtccaaactggactgggagagcttcaaggaggaagaggggattggtgaagaactggccatccataatcgagggaaagagggatggattaaaggagcccagcccctaggccagtgaagggactggagctctgttcttcaccttggctgagcatgagaatcctctggtgacattttccaaagttcaggtgaccacctctgtacagagctgctgaatcaagagtctagaacaggtaggtcacaaatatctgcatctttaaattttacttctcaggtgattctcatgcacagccaaggttgagaatcactagaccacaggttcaaaattctagaggcataagacaggtacagtgacatgcacccatagtcccagctactcactgcactccagcctggacaacagagaaagacccggtctctttacca

SEQ ID NO: 22837 - DNA, 998 bp, Homo sapiens
tgcaccttgacgctgtgccaagtgctgttttagccctttacgtgtaagatacaccacagcctgtgagtaagcatttgctttgtagattaggaaaccaaggaacatgcagtaaataactggcctagagtcacacagttaagctggaagttggaccttggcatgtgactccaaagccctgcctgaagcgctgctcctcccctccttgcaagcagagacctgccacacagagcccacagaggtctgaagaaggcaggatttcctgttcgtagctcaggagagcagacagtggtgttaagcaggaaaagcacattagaattccagtttacttacagtgctctccacaccaggaaggaaatgccccaaatatgaacatggcttccactaagataaatggccccaatctaggggattcccatttgcatcagaaaaactgttaatctagagatcagagtttttacctgctacatctttcatattttctttccttaggttaaaaagatcaagtggcatgagcagccttttggggaaaattggtgccaagaagcagaaaatgagcacccttgagaagtccaaactggactgggagagcttcaaggaggaagaggggattggtgaagaactggccatccataatcgagggaaagaggggtacattgaacggaaagccttcctcgaccgagtggatcacaggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagaggataatgaagatgaaaaaaacacacaccttc

SEQ ID NO: 22838 - DNA, 601 bp, Homo sapiens
gttttagctagtcatcaatttggtttggtatccaagccctgcctctggaatcctgtcctgcctactacttcatagccactatccaagataaggttaaaaagatcaagtggcatgagcagccttttggggaaaattggtgccaagaagcagaaaatgagcacccttgagaagtccaaactggactgggagagcttcaaggaggaagaggggattggtgaagaactggccatccataatcgagggaaagaggggtacattgaacggaaagccttcctcgaccgagtggatcacaggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagaggataatgaagatgaaaaaaacacacaccttc

SEQ ID NO: 22839 - DNA, 1091 bp, Homo sapiens
tttttgaaggtcacctgtatttccatagatatgtaattttatttaagcaggtttattatattaaggcggcgaggcagcgccgaagactacaagttccagcatgcaccgcgtccgggcgggttcgggctcccagcgagggcttcagggacgccagcccggaggcatcggccggaagtgtcgtagggcaaccacgtagtactctctgcgcatgtgcaaagcgctgtcgggggccgccctagctgccgtcgccgccgccggggctctatggtctctccctagagctttgccgttggaggcggctgctgcggtcttgtgagtttgaccagcgtcgagcggcagcaacatggaggaattcgactccgaagacttctctacgtcggaggaggacgaggactacgtgccgtcgggtcttcactgctttggccagtaggagctctttcaggctggatcttgtatccttttaatttgatctttttattattattatttattttttatgagtcggcgtcctgcttactgtagccttcaattcctgggctcaagtgatcctcctgcctcagcctccccagtagatggaactacaggtggagagtatagtgaagatgatgtaaatgaattagtgaaggaagatgaagtggatggtgaagagcagacacagaaaacccaagggaaaaaaagaaaggcccagagcattccagccaggaagagaagacaaggtggcctctcattagaagaagaggaagaggaggatgccaattcagaatctgaggggtacattgaacggaaagccttcctcgaccgagtggatcacaggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagagg

SEQ ID NO: 22840 - DNA, 830 bp, Homo sapiens
cattctgagttgatcttaagctcagcatgtactggggtgtgacccaaacagggaagttgacatcctctctactaaagttaatagaatgagaatgttcagggtcattgttcagtcccagcagtctggtgttcagtgtggacgttggcctgttggctcacaccaggcagagggggttaaaaagatcaagtggcatgagcagccttttggggaaaattggtgccaagaagcagaaaatgagcacccttgagaagtccaaactggactgggagagcttcaaggaggaagaggggattggtgaagaactggccatccataatcgagggaaagagggatggattaaaggagcccagcccctaggccagtgaagggactggagctctgttcttcaccttggctgagcatgagaatcctctggtgacattttccaaagttcaggtgaccacctctgtacagagctgctgaatcaagagtctagaacaggtacattgaacggaaagccttcctcgaccgagtggatcacaggcagtttgaaattgagcgagatctcaggctgagcaaaatgaaaccttgatgttacgggctaaatcaagagcagcttaatcctgtttacaatgtgagctttttgtgcgtctgtgaaatgttttacagtgtttctcatcatctgtttcccagcaaggtcttttttttttctacattgaagttctgtctatgtatcttaatcacaaatggtttcattcactttacttttaaaaatttgtccttaaatgaataaataaaataaaagttggtcctgtgagaggataatgaagatgaaaaaaacacacaccttc

SEQ ID NO: 22841 - DNA, 200 bp, Homo sapiens
catatacaaaagtaaagagagttgtaaaataacttccacatactcattgcccagtttcagtagttatcaacatgttttctaatctcatgtcatgtatttccctccacttttttttttcctggaatatcttaaagcaagttctgcgtcatattattgcactaggacatacttcactatgtatctctaatagagtctttctt

SEQ ID NO: 22842 - DNA, 399 bp, Homo sapiens
gccatgtggttcaggtgggcctgtcacctctctggggcacattcttcactaatgagcagagacactgggttagatctaggtgatcagggccatccccctcccatgtccaagcagacactgccacttaatcacagctttcttcctccttactgtcttccagcccacactcagccttagaatccttttcctacagccaggcagtaatagctgatggattaatcaaggtgaaaataaagatgaacctgagtttctgcccagagctagataatccccttgggtcccttctagttttataatttctccacagcagactcaacaaaagctcctgctctgtcatgatgtcccctggggtttggagagccttaccaggctccccagggtttccattggaaactcttc

SEQ ID NO: 22843 - DNA, 829 bp, Homo sapiens
agggagacaaaaacattttgatgagaagaataattatcattaaccttcatatttttggggaaaaaaggagttttcttgccatcaatatcttttcatacttgcccagagctcatctcctccttctgctgcagcctgggtggtcagcatgactttttgtctggatggctggtaggtggcacaccctgaagttgtgcaggagccatagtaaaagcatttcaggggaagatagtctaatgacactggagtctatctgtgtatcctcaaagggagaactgggcatctggcagataattccatcatcaaatctgtagtgagcctactgcaaaataagaattctctttagaaggctggtctgtggacatcattaaacaggagaaatttccacatggagaaatttcctgaaagaaactagataggaattaaaaaaaaaaagtatggctgttcacgcaactgttttctaagcttcccttcaaccatttctagactattctgagtaaagacttggaatatcccctgctttgttgtcgttaaggtcctgttcttgcgtacattcatttctctgcctcttttgttacaacatctcttccttatggaaatgttctcttgacttccagaagagtattgttcaatttccaagtttgtgtgtggtggccccaggacaagtctggtctgtgtcacaaagaattttagttcagttgctggttgatatcacagagatcaccagaaaggccaggggttgtccttaagttccctctgcctgcagtcctgctttgttttggacaagtaggagtgacaagcaggtcagcacagccctttagagatacctgca

SEQ ID NO: 22844 - DNA, 564 bp, Homo sapiens
gagactaaggggtgaagtaccttccctgtgagctcagaactttcacttaaaaacgcctaagcctagaggttgatgacatcacatgggctgtgtgtaatgtgtttgtagcctcattcacactgtgaataacttgttaaattgcatattttgaggtgtattttgaagctcttaggacatagttttagggacaaaaacaaaccccctagaatactgtttttaaccatagggcacttgttacctgcctctatatactgtaatctgaaagtaaagtttctagaatatttttgatgaaagtttcgggccgggcatggtggctcatgcctgtaatcctagcactttgggaagccaaggcgggtggatcactttaggccaggagtttgagattagcctggccgacatggtgaaaccccgcctctactaaaaatacaaaaattagctgggtgcggtgatgggcgcctgtaatcccagctactcaggaggctgaggcaggagaattgcttgaatctggaggagagtacgtagaaagtactccaaacccccgcctggaaaagaaacccaaaaaag

SEQ ID NO: 22845 - DNA, 416 bp, Homo sapiens
atgtctgccctgggcttggcaacaaacatgcagacatgagtgtttcatacctgccatctggggcctcctgaatgagacagtcctacacggattaatgcaatactttatcatagaggctgataagttaaaagggctgtattctatccacctgcagtgtgaaaagtgcacctgaacatgtaaatcctcctttaatgtcagaaggtagtattattatgctttgtccatggctttgtgtagcaaagaaagatacttggtgttttcccctgcttcctggtgcagagttcctaaaacccttggaattttcttttttagaaaaaaaaaattttttttttgagacagggtctctctgtcacccaggctggtgtgcagtggtgtgattgtagctcaatgcagcctcagcctcccaggctaaagca

SEQ ID NO: 22846 - DNA, 465 bp, Homo sapiens
gatggtccattgttcctcagcattctttctcttctcccaaattttccttagtattttaccctgctttagccaccaggttagaaattgcatgtgtgtgtatacccattttttcagttggctgtgaagcagagaatatcaactagttttggatgttgacccttgaaaatctttgggtgaaaatatgttcaaatccattgaatcctcattggaaaagaggtttaaccttcaaatccattacattcaacatctttggattcattccactctgaagaagatggaggtgttaatgagattgctgtacatgagcgtgaacaacgatgcagtggaaaagggatgttaacagcttagtgttcacctcctcaaaagttgaatgagttggccaggcacggtggctcacgcctgtaatcccaggactttgggaggctgaggcgggtgtatcacgaggtcaggagtttgagaccagcc

SEQ ID NO: 22847 - DNA, 327 bp, Homo sapiens
gtggtctgctgtcagtcatgcgatgccttatgagagtcaggttggaaagtaagccacattatcccgagttaataaaaaacccatttaaatgaaggtttcatggtttgtaaggtgtgacttaacccctaccttgcaatggacttaggccttgtttataatttagtatcttactgccacagtgttttgtcagtcttacatttttttctttcctttcccccccaaattcaaacaagtgtcagtaatgatttttttttttagatggagtcttactgttacccaggctggagtacagtggcacaatctcagctgaaatgattgtcctgcctc

SEQ ID NO: 22848 - DNA, 610 bp, Homo sapiens
ctgtaatcctagcactttgggaggctgaagtgggcagatcacttaaggtcaggagtttgagaccagccttaccaacgtggtgaaaccccgtctctagtaaaatatgaaaatcagccaggcttggtggcttgcgcctgtggtcccagctacttaggaggcagaggctcgaaaatcccttgaatctgggaggcagaggttgcagtgagccaagattgcatcactgtactctcacctgggagacagagcgagactctgactcaaaacaaaacaaaacacaaattcgttttatttattttgtatattttacaatataaaatatattatacattataagcaataactcccactcctccacccccaacccctggaactcctaatctactttctgtctctatgaatttgactactctagttacctcatataagtggaatcatacaatatttgtccttttgtgactggcttctttcacttagcctaatgtcctcaaggttcatccatgtcacagcatgtgacagaattatttatttatttatttatttattttgagacagagtctcgatctgttgcccaggctggagagcagtggtgtaatctcagctcactgcaacc

SEQ ID NO: 22849 - DNA, 414 bp, Homo sapiens
gtactatctgcagtttcaggcatccagtggggttttggaacctgtcccctgtggataaggagggactactgtattactgtcattcccttaaaagatttaattatggtcttaatgtcccagtcttttctatcttcccgttaatgggatgattttctagcccagtgctaggggccaccgtcatgccgagaaaaggcccttccttagggtgtggccagggtcttcccttgagaggctgagtctggtggaaccagcacagggccactcactgtgtttctgaagacagcccattagggggctgggtgtggtggctcacacctgtaatcccagcactttgggaggccaaagcgggagaatcacttgaggtctagaattctagaccagccaggccaacatggtgaaaccccgtctctacta

SEQ ID NO: 22850 - DNA, 486 bp, Homo sapiens
gcactggggttggctggggctaggagtttgtgatgaatccttccagtatttttctgaaaaccagtgaactattttgtaggtttctgtgtcgttagaaacatgcaaacctatccactaaaaccactccagttgatctattaagtcattcgttaggtcttacctggactctcttcactgtcactatcatgatctgtccacatcactggccctttctcctatcacctagctctcctgtgagcccagcactgatataaagtggtttctagtcttcttggactctcaatttaacttgcttcccatgggaatcttctaactgtttccccaaaccaccttgtagacattcatttctttgtttaggattctaagaataggaaagagagacataagctagattccattcctgtttcagtaagattatctttccaacacaagaaaggaatacatctaaaaaattctttcagcattttttcccgctttattgagaaa

SEQ ID NO: 22851 - DNA, 395 bp, Homo sapiens
tcacatattcttagactgagttttgtctctaggaagcaaaatatgaatttctgaagggtagggaccatatgccccaccccagttctggccaagtgttaaaaattaaatacagccgggtgcagtggctctcgcctgtaatcccaacactttgggaggccgaggtggacggatcacctcacgtcaggagttcgagaccagcctgaccaacatggtgaaaccctgtctccactaaaaatacaaaattagctgagtatggtggcacatgcctgtaatctcagctactcgggaggctgaggccagagaattgcttgaacccaggagatggaggttgtggtgagctgagaccacgccattgcactccagcctatacaacaagagcgaaactcccatctcca

SEQ ID NO: 22852 - DNA, 401 bp, Homo sapiens
gactatacagtagatgcctacttcatagtacaagttgtccaaatacatgaagttgcttcttgtttctttctttgctcttaagaaaaagatatggtgtgaaagatatgcagttaggctgggcgcggtggttcacgcctgtaatcccagcactttgggaggctgaggcgggtggatcacttgaggtcgggagttcgagaccagtctgaccaatgtggagaaaccctgtctctactaaaagtacaaaattagcctggcatggtggcacatacctgtaatcccagctactcaggaggctgaggcgggagaatcgcttgaacccaggagcaagaggttgtggtgagcggagatcgcaccatagcactccagtctgggcaacaagagtgaaactccgtctcaaagag

SEQ ID NO: 22853 - DNA, 226 bp, Homo sapiens
tgtgaagatgccagaccccaagggagaagtgggaggaggactggctttccaaaactcaccagtcaaataaaatccctttttgtagtgtggcaagagtgtgtgaggatcagagtaaggccccaagtgttacaccagtgagcttcctgaaatatctgggataggaagcacagtacttacaatcataattgtcctgtatgtatactatggtttcagagcatgggtagag

SEQ ID NO: 22854 - DNA, 472 bp, Homo sapiens
cagttatgcctagaatgaggaagaggctagttagaaaggacagagaatatctggggcttaaagtggtagtaaggagcttctatttcttgaaatccttctatccagtagagtgataaaagatctttctcacttcacttacttctgcatgatttattagattaatgtagaagggagtcacagaggctagcaaattccccacagtatgcccacagacgatattttgaaatgcatctaatgatcatattgtaatctcaaacatgccaaaagatgatgttccttatcctaacacactaacactaataccttcttccaactaatggtgtatttatatgttgtgtatgtttttgtctcaatttcatttttatttcccatttagagtacattagtttaggtccagtttaatgtgctcaaaaatccattaaattccttttaaatggccgtatgatagtaaaatcagtcgtgctctaagaaa

SEQ ID NO: 22855 - DNA, 336 bp, Homo sapiens
cctacctgtcagctcccagggcaccctaactttcacaccaagctgttttaaggcttccaaaggcctctctcaccagcctcttctatatcatgtgaacaacaaatcacgttccctcccctcttttcctactgattcagacagaatcttcattctgaacaacaaaaaattgacgtatatcttttgagatctagacttcacagcataaaaaaattgataaagcctactaattataccaagtagggtaaacagtggttaaattttttttaatgtgaagcttgactaaagtctacttacacagaactatcactatatgaacaatatggtagacaggtaatg

SEQ ID NO: 22856 - DNA, 334 bp, Homo sapiens
aagtggctgttaacagattttcaaatgcctgaagagattgctgagacctgctagagtcatacgttcggggaattaagtctttatcctagacaacaaggtacagatgcaaattgcagtgttattggagggtcaatcggcaaggatatgattatcccaaaatggagttcatcgaccctagctttcctttagattatatataaataaaagtgcagtcctcttctaatggccacagttggttttcttgtagcccagaaagtccaaattaaaggaaataaattcagttttatgttagccttccttggtgcatcagggtgtcagtggaaataggatcagg

SEQ ID NO: 22857 - DNA, 169 bp, Homo sapiens
aatggggacaccagaaggggaagagagaaaagcagcaatatttgatgcaataatgactgagaatttccccaaattaatgacagacaccacatcacagatccaggaaactcaagacattgagcctaggcatatagttttcaaatgtcagaaaatcaaagatggccatggt

SEQ ID NO: 22858 - DNA, 336 bp, Homo sapiens
aaacgtgtacaagacatcaacatatgaaagctccctacagtgttgttcatgataatagaatcagtgtaccagggtagacttaaacaatggagataacaacatggatgaatatcaacaacaatggggaacaaaaaagtaagatacgggagaacagacacattacgatcccagccatataaattgtaaaagagcaaaattaacgtttactgtatatgaagatgtttaggtagaaaaaccatccactgaaacaacaagttaatgggtgcagcacaccaacatggcacatatgtaacaaacctgcacgttgtgtacatgtaccctaaaacaaagtataat

SEQ ID NO: 22859 - DNA, 856 bp, Homo sapiens
tacagagaatcactttgctttatcaagtgttgagtcaaagtgttaagtaaaagttgacatgcctgcaacttatttttaaatagcaaatcataatcatcccacactgtctaaagcactaaacttaacatataaatcatatacccttactagaaagagctagctagaaaaatgtaaataataaaattaaaattgctaaactccctcattatgtatttataattagcagccaaattattaactctgttttcagaatttctgaaataggttgttgatattaaggaagccattcaacaaaaacctcaacaagtatagtcttaaaatcaaatcagcgaaataatcttttaaatgtttagctattcattagcatttgcattaaatttcagcagcagtggttgcttttagctttttgggatgttatttttctgcacaaacatactgcaaagaacacacttgaaaaaaataaaagttattcattttcatgctttacacatgactttgcaattgcactaatcagattttatttctcaaatagtagtcatggatcctagcaagtacttcttcatttatatggttgctctcctgtccatattctttgctcatatttactgtgtcatttgccttcaggtaccacagttacctggacatatgcccatttgcctagtttgacacagctacttaagggtaagcatcccgatctgtggaaaagtataaaaacaaaatcagggatctcagaatcacctttgttcacagtgattaccattatgttgataagtgaaaaacaaggaaggaaattctctgaaagaaaatgtcatgtattcagggatgggccttacaatgggaatacaggtgccacagt

SEQ ID NO: 22860 - DNA, 371 bp, Homo sapiens
gagtgagccaccatgcccggtgaactagccgtattttaaaacacaaataacattaaaacctatatttactaaggattaatattacaggacaaaattcacactaaataaaaattacattgactttataaaaagataacttttattagaaattaactattttatttgaaagttacgattttgattttatggtggcatattgtacctcctttgatcaatatgtacaaatttcaaaagtgataaaaaatatattctgtatatacttgtttaggatgacatttgatgttgcctgtatttgtataccatccagattctcattcttgactttgagatttgatttgaaatattttgaataaatgttaatcatgattatc

SEQ ID NO: 22861 - DNA, 614 bp, Homo sapiens
  misc_feature (571)..(571): n is a, c, g, or t
tgaggccaaaaaggcctttttttcttttatgtagtagaatataattatatttttaaaatgtgtatattttttcaaaaagtaaatttatttttattttatcataggttacaaataataattgtatatgtttacagggtatactgtgatgttatgatacatgtattcatagtgggatgattaaattaagctaattaacataaccatcacctcacatactgatttcattgtagtgaaaacatttggatttttttttagtaatttttaaacatgcattactattaattttagtcaccattatgtgtgtttaatgcttttcaactaacaaagaaaagaatttaaagagtgaatgttgtacttttttacatgaattgaatatacatttcctataaacatgattgcattgcgttatttcaaaatataagagttagtaatatggaaaatgatgaataagaacagttttataagttggtggggagtgtaaagagtagttggctggaagataagtgacccgcacattcattttggttctatggttgatccattcactggtgactctggttgcccaaaaggntttttttttttttcttctttttgctgacccgttcgcactgttc

SEQ ID NO: 22862 - DNA, 690 bp, Homo sapiens
tgaggccaaaaaggcctttttttcttttatgtagtagaatataattatatttttaaaatgtgtatattttttcaaaaagtaaatttatttttattttatcataggttacaaataataattgtatatgtttacagggtatactgtgatgttatgatacatgtattcatagtgggatgattaaattaagctaattaacataaccatcacctcacatactgatttcattgtagtgaaaacatttggatttttttttagtaatttttaaacatgcattactattaattttagtcaccattatgtgtgtttaatgcttttcaactaacaaagaaaagaatttaaagagtgaatgttgtacttttttacatgaattgaatatacatttcctataaacatgattgcattgcgttatttcaaaatataagagttagtaatatggaaaatgatgaataagaacagttttataagttggtggggagtgtaaagagtagttggctggaagataagtgacccgcacattcattttggttctatggttgatccattcactggtgactctgggaaaagattgactctgagaaagaacaaagtatatgaggtatattagcatgtattcatagtttaaatttaaaattatatgatttggagactgaatataatgctaaatttaataaaatatcgcattgaaagaag

SEQ ID NO: 22863 - DNA, 633 bp, Homo sapiens
  misc_feature (561)..(561): n is a, c, g, or t
  misc_feature (566)..(566): n is a, c, g, or t
  misc_feature (570)..(570): n is a, c, g, or t
  misc_feature (576)..(576): n is a, c, g, or t
  misc_feature (585)..(585): n is a, c, g, or t
  misc_feature (592)..(593): n is a, c, g, or t
tgaggccaaaaaggcctttttttcttttatgtagtagaatataattatatttttaaaatgtgtatattttttcaaaaagtaaatttatttttattttatcataggttacaaataataattgtatatgtttacagggtatactgtgatgttatgatacatgtattcatagtgggatgattaaattaagctaattaacataaccatcacctcacatactgatttcattgtagtgaaaacatttggatttttttttagtaatttttaaacatgcattactattaattttagtcaccattatgtgtgtttaatgcttttcaactaacaaagaaaagaatttaaagagtgaatgttgtacttttttacatgaattgaatatacatttcctataaacatgattgcattgcgttatttcaaaatataagagttagtaatatggaaaatgatgaataagaacagttttataagttggtggggagtgtaaagagtagttggctggaagataagtgacccgcacattcattttggttctatggttgatccattcactggtgactctggacntgggngggnagttgnccttaaaanttttttnntgggggagataaaagcgttgtgtcgcgtatgcaacccact

SEQ ID NO: 22864 - DNA, 920 bp, Homo sapiens
gaaagggcggggtggaggaggggaaagggcgggggtgatgccgcgcggtcgcaggcttgggatggtgttcgcgcctccgagacccggacagaggcaagcaggggcgccgtgggtgccagagaggcggaagaggaggcctgatggggataccttcctgctgtccttcctgagcacaacctggctgaaaacctggaggtcacaacagtacaaagaatcaaagtcaagatcttgtgccagagagcaaatgaactcttcctcttgctgagaaaacccaccctgctcacctaaaccctggccttgcctggtaattccatccatgcgcctggaaggccccagacatcaaggctctgaggggccaggcacggggagaacccagcagtgccctgccctgcagtctgagctaccagattccttgtgaagataatttgaggaccatgactcacccaaccacatttcctggggcctcaaattgaaaattcaggatgggcttttctatatgactggctgatatccaactatgccatggtctttacatgccatgaacattctttcctgccagagttctaagaatctgtgttctctgccttagaccttctgcagatgagcccacaggaagctccacgtgtagctgagctacatgcaccaggcctcagtttgccccaagtcccctgtgtactctctcatggcctgtggccaagaaatgtattctctcactttggacttaggagtccaaagagaagcccagaaacaaaattgcttgaacttgaatttgtgtgcgtgcgcacgtgtgcacgtggtggtgaaggtgtatgttttcggctgttctatgcgtcactgtcaccaaactcccaaataatagtaacatttgtttagatgatgtctgctgacaaatcacaaacacgacgctaactcgcaactct

SEQ ID NO: 22865 - DNA, 904 bp, Homo sapiens
gcctgggggttaaatcggccgagggcgcgcggtcgcaggcttgggatggtgttcgcgcctccgagacccggacagaggcaagcaggggcgccgtgggtgccagagaggcggaagaggaggcctgatggggataccttcctgctgtccttcctgagcacaacctggctgaaaacctggaggtcacaacagtacaaagaatcaaagtcaagatcttgtgccagagagcaaatgaactcttcctcttgctgagaaaacccaccctgctcacctaaaccctggccttgcctggtaattccatccatgcgcctggaaggccccagacatcaaggctctgaggggccaggcacggggagaacccagcagtgccctgccctgcagtctgagctaccagattccttgtgaagataatttgaggaccatgactcacccaaccacatttcctggggcctcaaattgaaaattcaggatgggcttttctatatgactggctgatatccaactatgccatggtctttacatgccatgaacattctttcctgccagagttctaagaatctgtgttctctgccttagaccttctgcagatgagcccacaggaagctccacgtgtagctgagctacatgcaccaggcctcagtttgccccaagtcccctgtgtactctctcatggcctgtggccaagaaatgtattctctcactttggacttaggagtccaaagagaagcccagaaacaaaattgcttgaacttgaatttgtgtgcgtgcgcacgtgtgcacgtggtggtgaaggtgtatgttttcggctgttctatgcgtcactgtcaccaaactcccaaataatagtaacatttgtttagatgatgtctgctgacaaatcacaaacacgacgctaactcgcaactct

SEQ ID NO: 22866 - DNA, 949 bp, Homo sapiens
gcctgggggttaaatcggccgagggcgcgcggtcgcaggcttgggatggtgttcgcgcctccgagacccggacagaggcaagcaggggcgccgtgggtgccagagaggcggaagaggaggcctgatggggtgagcacagggccagggcaggcactgcctgtgaatggcgccagggataccttcctgctgtccttcctgagcacaacctggctgaaaacctggaggtcacaacagtacaaagaatcaaagtcaagatcttgtgccagagagcaaatgaactcttcctcttgctgagaaaacccaccctgctcacctaaaccctggccttgcctggtaattccatccatgcgcctggaaggccccagacatcaaggctctgaggggccaggcacggggagaacccagcagtgccctgccctgcagtctgagctaccagattccttgtgaagataatttgaggaccatgactcacccaaccacatttcctggggcctcaaattgaaaattcaggatgggcttttctatatgactggctgatatccaactatgccatggtctttacatgccatgaacattctttcctgccagagttctaagaatctgtgttctctgccttagaccttctgcagatgagcccacaggaagctccacgtgtagctgagctacatgcaccaggcctcagtttgccccaagtcccctgtgtactctctcatggcctgtggccaagaaatgtattctctcactttggacttaggagtccaaagagaagcccagaaacaaaattgcttgaacttgaatttgtgtgcgtgcgcacgtgtgcacgtggtggtgaaggtgtatgttttcggctgttctatgcgtcactgtcaccaaactcccaaataatagtaacatttgtttagatgatgtctgctgacaaatcacaaacacgacgctaactcgcaactct

SEQ ID NO: 22867 - DNA, 383 bp, Homo sapiens
gcctgggctcagtgggactgtcaactggaatggccatatgtggactctcttagcatgatggtctcttctagaagcttgggttcccagagagaatgttcaagaggccccaaaggacaccacaaagcttctttatgaccaaggctcggaaatccaggaagcttgctcccatcacgctctattactccaacaagtcactcaggccagcccaggtccaagaggaggaaacctagactccatcttgcaatgtgaagaattgcaaataatttgtgtcacccttaagcaaccagcaactcatctaggttgattggcatttcagcaatgtggtgggaagtggtgggactgatgttgaagagggacttgaatgtcatgagaggctggggagg

SEQ ID NO: 22868 - DNA, 1326 bp, Homo sapiens
cagcgcctgtgcagatggcaagatccgaatttacaatttcctcaacgggaactgtatgaaggtgttaaaagccaatggcagaggtgatcctgtgctgtccttctttattcagggcaacaggatggtggtcaacacagagagcaatgttctcatgttccagtttgagcacataaagtggcagtatgccgtggaaaaaacgaaacaaaagaagaataaggagaaagaggaggaaaaagaagaaaatagtctcatggaaattctctctaagtgtaatattcaggttcacagcccaagagagtctgtatccagtaaacaaactgtgatccaagagctcctaccaggcaaacctcccaagtcccgagtactcctgaagccggccaagttctcttcagcagtgttaatagaggaacttcaaagtcaaggaaagtcaaaatcaccccgaagagatgatgatgcggagaaagcacaaaaacaaggacaattggaaactcctggaaaactgcccagtcacccaaagaaaaagtcttggaaaatccctatgtcacctgaccaattcctcctgactgttagcgccctgcagcacgcccgtaattccggggaatttgcctatccctgtaggccccaaacagaaattactgatgtctggggaccttcaatttcatacccaaggaaggtcttgaatttcaaaggaaaatcaatccaacgtgcagttgatcggttgagattgagcaatcctcctatagatgtgaaacgaaccagtattccccttgaaatccagaaactgcagcccaacttgaagatctctttgcacagtcctagagcccagtccaccatacccgagcccatgattatccgctccaggttctctggcagcttaaagggtggagaccaagtgaccagttcaattgaaagggctgtgtgcagtacgggtcccctgaccagtatgcaggtcattaaaccaaaccgcatgctagctccacaagtgggcacagccaccctgtctcttaagaaagaacggcctcgcatctatacagcccttgatccttttagagtgaacgctgagttcgtgctgttgaccgtgaaggaggagaaggagcaccaggaagccaagatgaaggaatatcaggccagggagtccactggagtggttgatccaggaaaagccagcaaagctgcatggatcaggaagatcaaaggcctgcctattgataatttcacgaagcaagggaaaacagcggcccctgaacttggacaaaatgtatttatctaaaccagccttgggaaattacagtgttttacaataaacagaaagccaagcggaaaaaa

SEQ ID NO: 22869 - DNA, 134 bp, Homo sapiens
aatgttcccttgtggtgatgaaaagaatgagtattctgcagcaattgggtgaagtgttctataaatgtcaggtctattaagtatggtgtctactttaacttttgtgtctctgttgattttctgtctggatgatc

SEQ ID NO: 22870 - DNA, 125 bp, Homo sapiens
gtaagctggggagataactgtggtcaaaaggacaagcctggagtctacacacaagtgacttattaccgaaactggattgcttcaaaaacaggcatctaattcacgataaaagttaaacaaagaaa

SEQ ID NO: 22871 - DNA, 336 bp, Homo sapiens
caggctggtcttgagctcctgacctcaagtaatccgcccactttggcctctaaagggctaggattacgggcattagccaccacacccagccacatatcaatattaaccttgaatgtaaatggcctaaatgctccgcttaaaacatacagagtggcaaattaaaaaaaaaaaaaaaagacccaaccatctgctgccagcaagagacccccccacacacactggttaaagacagttacagactcaaagaggtgaaaaaagatttatcatgcaaatggaaaacaaatgccagcagtagtatccattctcgtatcagataaacttcaaaccaataacagt

SEQ ID NO: 22872 - DNA, 366 bp, Homo sapiens
gacatgggcacagtcattttagtgaaacctaagaaagtgcagaggaaaggagagatgctaagaaagtacaaaggaaaggagctaaagctagccatgtaaggccttgcagaaggggatgcctgagttaagtttgcaatgagaagtgaaaaatgcaggaaggcatggttggctagaccatctgcgacagcatgggcctgtgcagaaagaaggcccactgggtgctagatgtctgattgggtcagaactgtgttatgcacatgcccatctgggtctgtgaaacaaatgaacttcatccagctgcttcagaaagaattaaacaggtcccaggatgctcatcacctgaaagaactgaagcatgcacctgga

SEQ ID NO: 22873 - DNA, 592 bp, Homo sapiens
gttgctactctaggacactgcttagctcatcagttcttagatttcaagattccatttactacaaaaaactgaaaatgatctttagggaccaatacagaatcaccaacttcttaagacattaaaaataaaaatcccctgactgcctcttactcaaaatagtcccttagtcaagagtgtagtgcttgacttttggctttacccactaattagaagtatgtaaccttaggccaggtacttagcctttcagtgctcaaacgaggtaagcacagtacctgcctcatggatgcttgtgagcactgagaatagtgtctcacacatagtaagagctatgtaaatgttagatgttatttgttataattactagtttgcagttgtggggaagttatttaatctcttttgtcttagtttcctaacttgcaaaatgtaaacaatgatacttcatagggttgtggtaaggattaaacaaactaaaagttattaagtgtatagaactgtttggcgcatagtaagctctttataagcatgggccatcactatcactactattttttaaaggatattttaacattaaaagaataaatgtggcattttg

SEQ ID NO: 22874 - DNA, 481 bp, Homo sapiens
cagtgggaaactaatagagcatctttcctttttttctagttaaaggactcacttgtacgtgtacacatttctcaggagtcctgtcaaccactgggaagaaagaggctggacttctgcattgaacccaggaacggggtttcacagcaatggaaacctggggttaaatatcaatggaaccttacatgacttgaagaatctttaatacaagctaggttttgaccccaaattagacatttggcagcctctcattacagtctatcttgcaaacctcagtgtggcaaggaatcagattcacccacactccctagtctaaaggattgtcctctgatccttccaggtggattaagccctttctaatctgtcatggacagagcaatgtacctgcctttgtttgttttccttaattctttcaagtgcctttgggtaataaatggttgcgtactcaggtttttagtccaaattttttttcttcaactctagg

SEQ ID NO: 22875 - DNA, 413 bp, Homo sapiens
tctttctatccttactcctgagagagttcagagttttaaaatatgtccctgtggtttcacctattttccactcaatagtaaaatagtcaaagattaaaatatctttctctaaaaaacatttctcattttttttgcattcgaattgttgacagaccaaaataaaacaaaaaacaaaaaaattcacaagaatgttctgaaatagtttcgtgatttgcataatattattcattctgtggaatctactagaggtgatttttagaagaaaaattataaaattatccaatgaactcagcttttcaaagagcagatgcttccaaagtatttttaaactgaactccttgtgttacatgaagttttataaaaacttatctctaatcattttattcagtgacctaattatcttcagtctatca

SEQ ID NO: 22876 - DNA, 196 bp, Homo sapiens
ctatgggtttatggcagtgactctcaactaggggcacttttttttttgccctctccatccacagatatttggcatgtctggggcaattttttagctgtcacactacgcagtgctattgacatctagtgaatagagaacagagtcactgctaaatgtcctacaatgtacaggatatcctccataaagaagaattttc

SEQ ID NO: 22877 - DNA, 315 bp, Homo sapiens
tacaaagtctatattttaccatcattaatactgaatattatatttcaataagaatctttagaattttaagagaaatttgagtattaaaaaaattatctaatatacccaattagaatcttttcacatgagactacagagaaagatttgtatttgtaacaaaaaattagctgggcatggtggcaggtgcctgtaatcccagctacttgggaggctgaggcaggagaatcgcttgaacccgggaggcggaggttgcagtgagccgagatcatgccattgcatttcagcctgggcaacaagagcgaaactctgtctcaa

SEQ ID NO: 22878 - DNA, 569 bp, Homo sapiens
ttgcaggggaaggagctggatcagactgacagggtttcactcagactatttcaaacaatgaggagccttgacctcattcccaacttttgccgtccatagtggttgatttcttgttttctctttctctctttttttaacagaaactcttaagctcaaggctaaattacagtggggacttgcctttgtctacagtccatggtttctgtattggctcaagccttgaaatcttgaaacaagcctaaattaaaattttctcttagcttaagaaaaaaagttacatattgtcaagacccttatgtgtgtggtccattaaaaaggtcttgatattagaagataacagcaaattgtttcttatcccacaacagctttgcctttcagtgtcctttgtggtggttttcgtaggtcagtggtacaattcaacactcttccaataagccataataataattgttggcacaactgttattacaacaggacttgcctgggttccatctattaatttttacagacagtaggaagctcacaccgaggagacattggtaacttcctggacaagggcaaagaaagga

SEQ ID NO: 22879 - DNA, 148 bp, Homo sapiens
gcccccatgcccagcctttcattctctcttaccatggattccttttgtttttcttttatggacttattttttttcccccttcttttctttttgcccttggtacagtaactctgtttcttcttcgtaaatgttctcattttctctttag

SEQ ID NO: 22880 - DNA, 530 bp, Homo sapiens
gagatggagtcttgctctttggcccaggctggagtgcagtgatgtgatctcagctccatctcccaggttcaagcaattctcccacctcagtctcctgaagagctgggacaggtgcgcaccaccgtgcccagctaatttttgtatttttagcagagacggtgttagcccggctggtctcacactgacctcaagtgatctgtccgccttggcctcccaaagtgccgggattacaggcatgagccaccgcgcccagcctcattgaaaatttacttttcaataccagactgcagagttctttggggcagagacactctgtcagtgtgctctttttccaaagtatctcctgctatcagtttttccccttgaaccaagtcttcctaacaaatttgttgtgtcattgctttctagggaactggaccagcaaatgtggcctttagtggttaatctcatctgtgccaaaatttagttgctaccagagtgaaatttggtgtgtaaataatgttcagaggaaatgtggttggagtgtagta

SEQ ID NO: 22881 - DNA, 420 bp, Homo sapiens
acaactggtgagcactgaggagcctagggccgcggtactgtgctggagtcggtgatctcaggctacagtttatataagacatcaccactgggggaagctggttgaagggttcacaggactgtatgtgcaggaacttcttgtggttctgtattacttcaaaataaaacgttttttaaaaacccactttatagaaacaaaatgaggcttttttttttctagaaagacagctgacaaacaaaatgagattttaattaacgaacaaactgaatactgaaatgcaaagtaaagaatgattatgtatggctgggcacggtggctcacgcctgtaatcccagcactttgggaggccgagttgggtggatcgcctgaggccaggagtttgagatgagactgggtaacatacagggacgccattttttc

SEQ ID NO: 22882 - DNA, 456 bp, Homo sapiens
tctggattcaattttctctttgagggaaagtaccataatagttcttgcatttattactgttagtaatgaattctcagattttaattgtctgaaaaagtcttaacttacctatatgttgcatattttctcctatatgtgttgtataaagtataacaaagagaaaatcgtttttagtcattattatgccttcacttttaaatgataggttaactgggtataaaattctgggtacacaggcatattttttctcagcactttgaatatatttatgtctgttgttaatttattgcttcttagctctgaaaccacccttctttgccacactttgtgatattggacctaaactctgtagattacatttctcccttgacagatggcttagtgttaggttctgccaatagagggcacaagagggacactgaaagcctgggaaaagaaggaagagggaactttgtt

SEQ ID NO: 22883 - DNA, 382 bp, Homo sapiens
gctgcctgtcgtgacttcccagtgcatccttcctgtgcgctcttactaggctgtcctaaccgggccattttccctgagggtctcagacccagtcctgagtcgcaggagtcctttcccatggccacctcgctgtggaactgtttgtatggtcctactgacttcctctcttcagcttctgactctgacacggtttcgtccggaaacttccttttctgaccttcctggccagggtctccctcctcactttcctgtcacctcctggggctcctttgaagagtctgcccctcctctgtccctgcctgagacattggggttcccaggtgtgcccctgtcttgcacctgcacttcttcttctgccttgtgttctcgaggatgtggcctc

SEQ ID NO: 22884 - DNA, 399 bp, Homo sapiens
gaagcagggaatgctatccattgtaaccctctaccaggggctctgttacagtaatatataacaaatatgtcttctatttatcactttttaacagagtttttttaattagaaaataatctggagaggtttttaaaaatacagatctccagccaggcgctgtggctcacaccagtaatcctagcactttgggaggccgaggcaggtggattgcccgagctcaggagttcaagagcagcctgggcaacacagtgaaaccccatctctactaaaatacaaaaaatcagctgggcatggtggcgcctgtgttcccagttactcaggaggctgaggcaggagaatcacttgaacctaggaggcggaggttgcagtgagccaagattgcgccactgcactccagcc

SEQ ID NO: 22885 - DNA, 395 bp, Homo sapiens
gtaatactaccactggactaaaaagttccactgcttctccacctcacaacgatccaagaacttcaatgactgccagtgacccgcactccacaagtaagtcaacaatacttccaggcacaatgattcccatcttacgcagtaaccagcaccaccagaccacatcccagtaaccaagctccacacctctcctaaaaccccagtattaaaatacatcatcactggagggccttttaagtccgaaaggtcctgacttgctcctagcaatgcagactaaagacaatcctaaatcaaaacaaaaaggctccctgtccagccaacaccgactcctccctcaacttcgagctagctccgcacactcaagtcagcctgggggcactctgacagggtgggcagag

SEQ ID NO: 22886 - DNA, 890 bp, Homo sapiens
agctactcaggagactgaggcagaagaatcacttgaaccccgggaggtggaggttgtagtgagccaagatcgtgccactgcactccagcctgggcgacaaagtgaaactctgttctcaaaaaaaaacaacaaaacaaaaagtaacaacaaaaaagaaactatattccaaaaatccaaatttcattggcagtttgttctgggagcttcagacacatagaaggtgtcagttaaccagttcttacctaagaggtactgctaagagcctagtccctaagcaaagggagcttcagagaaacacagaaggtgccagttaaccagttcttacctaagaggtactgctaagagcctagtccctaagcaaaggacattcctcgtagctctgtcctgtctcctcatctccaaaatactttaccttctactttgaaatgcccactattatattcaaaagccctagttacttccagggaaaattatctattgagcaatgaatttcggtagcttcaattggattccaactcttgagcaagttttcatctcccttgcctgaatggccctggggaggactatttaaattgggggcgagtggatgaggatgctaaacctagaggtctcccaattaccaaaggcacctgggcaccagggactaaagtttgtctcaggaatttactgagatatgaggctgagataaaatcattttttggtacataaggtatcttgaacaaagcagatcagtttaacacaaaatcaacaatcgtaatttccctttttaaatttccaaatctatgtagcaatatcctttcctttaattcattcatcatctctattcactttttgtattctgtaaatcatttgaacttttataagaattatattttccccttgaggtcaca

SEQ ID NO: 22887 - DNA, 585 bp, Homo sapiens
atatgagatattcagcagagcccatggcctctgctggacagacagtgggaaggggaagctctgtgggggccctaaaagaatttcttgttaaccccccgaggttggcccttcctctccactggccatgatccacctgaagggaacttgagcatttaattcaacagaccagcatatacttcctcctgtggcctgatgagcaagtggagtgagcccaggcctgcagagtgacacaacagtaggtagacagttgcagaaggaaatagctgacccagaaggactctgggccagggccacccagcatgggaactggtttacacatgctatggaaactctgttttgatcacatgggaaacttcaggagctgatttttccctgccttgctcaatcctcttttgaaccctatcttaatgataacatggtagcgggagagggcagctctttcagaaggcaaaccccaggaaggcagacatttctgctttgtctgtgttattcactgccctattccaagaacctagagcagtgccttgtacttagcaggtcctcaataaatgattgttgtatgacaatcacacttgcctgtctgac

SEQ ID NO: 22888 - DNA, 527 bp, Homo sapiens
aaagaaagaaagaaaaagaaaaaagtgatttgaataggcatatttagagacatccctctttcacttatttgcttaaagactttcttttttttcaaaaccgatttatttgtcaaccatttcatgtcatgggttcagatgaatccaatatttgtatgaagcgtgcatctttttgtctggctttaaaataatcatctataacacaaaaatatccctctatgatccttacaattttaccattagcaatttctagaattatcagtggaggtgcatagtaaaggtaatatagtccaggtttctagcaaatgaatgcccctttcaaacctctgataaggggttatccagttgtttttgtatatttctgataatgtaaacatgtatctttttctattgttgttaatactgatttatcacagattaatacaattacagagtttgaattaatcatttttcaaatgagaaaactgagatcgaaggaataaattatttacccaatgtcatacagcagattttgacaaagccagaaggat

SEQ ID NO: 22889 - DNA, 194 bp, Homo sapiens
gtgtgggtgtatagtacagtctctggtgtaagtaagtgctctatagtaatgtcagctaccacacccagccagaacctgctttctaaaagcaccctaaacctctttggttgtgaatttatatattctctgccttccaagggctggtctttgaggatattgcttggaactaagttcatacagtagatattttattt

SEQ ID NO: 22890 - DNA, 428 bp, Homo sapiens
tgcgatcactcccgagcaggagggaggcaccctgctgcccagtagtagcaccactcctagaggaggagggcccagcctgtatgggggcagtggggccccccaccaggcatccatcctgcctggcccagatggtccctctgctggtggctggcttcgggtggtggctccgggaagcacacatttccaggaagggccctgtaatcaagtgaagttgccggatgtccttgagtcactggctcctcttcgtcttgactcctccgttgttgcttccggtcactccctagtcttggctcctttttcttcccttctctgtgctgttctaattcccaggaggtgagggaaggtttccccttcacctcctgctgacctgcttctcccctggcctgaagcctgtggttctgggatggggatgaggataaggatgaggt

SEQ ID NO: 22891 - DNA, 742 bp, Homo sapiens
gctactacaagaagggtgtttcagaaacgctctatcaaaagaaacgttacactctgtgagttgaacgcacacgtcactaagcactttctgagaacgattctatctactttttacatgaagatgtttccttttctagcagagacttcaaagtgctctaaatatccacttgggaattctacaaaaacggtgtctcaaaactgctctatcaaagggaatgttccattctgtgagtcgaatgcacacatccgaagaagttactgagaattcttctctgtaggtttagatgaagaaatcccgtttccaacgaaggcctctaggaggtccaattatccacttgcagattctacagaaagagtgtttcaaaactgctctatcaagagaaatggtccaccgtgtgtgtggaatgcagccatcacacattagtttctgagattgcttctgtcttggttttatggggagatatttccatttctagcataggcttcaaggcgctctaaatatccgcttggaaatactacaaaaacagtgtttcaaaactgctgtatccaaaggaaggtgccactcgctgagttgaatgcacacatcacaaagaagtttctgagaattcttctgtctagatttatacgaagaaatcccgtttccaacgaaggcctcaaagaagtccaaatatcccattgcaaattctacaaaaggagtgtttcccaactgctctgtcaagaggaatgttgcactctgtgacttg

SEQ ID NO: 22892 - DNA, 235 bp, Homo sapiens
gcccagttgaccctgtgtttttgaaacacccgagtgtgtccagtaatctgcgaacattatgaagtcctacccctaaaattcttaaagatatatttcagtgcagttaaactgcagtcatgtgtcacttaacaatgaggatatgttctgagtgaacttcctagagtgaacttccacaaacctagttggtgtagcctactacacacctaggctatatggtataggctattgctcctag

SEQ ID NO: 22893 - DNA, 222 bp, Homo sapiens
ctctgagataagtgaagtaagaccaactgcagaacagtgtgtatagaatactaccatctgggtaaagaaagaggaatttttaatttctggaaagatgcctctggatagggaactgtgttgctggggaagaggggtgagacggagacttttcactgcagacccttttaaaccttaaacctgtgaatgttttagtgataaaaataaataaaatttaaatctaaa

SEQ ID NO: 22894 - DNA, 228 bp, Homo sapiens
atattccaaaagcagtcccaggggcttgttcgctaccagcagtttcccaaaggttctgccttctgcagaaaacacattacccaacttgtgtcacccttcaactatgtcagaacagctgccatggaagttccctttagattagaaactgccttcaagaaaaagaggccacaaaatggaccttgatggtctgttcatccaggcggaattcgctatttgctcaaattgaat

SEQ ID NO: 22895 - DNA, 122 bp, Homo sapiens
tgaggtctacatttacagttaagagtattagtgacttgtatgtgggagaattgggtctactctaacacaagtgtgttcttttcattgtagtgtacctgttatataaatataaaatctgtata

SEQ ID NO: 22896 - DNA, 484 bp, Homo sapiens
ttctgtaaaattcgatggaccaccaattggatagtaagagctgcccagcctggacttacattctttcaattaatacataaaacaaaaagggggatatgcagggagccgaaggcccgtgggacgtgaccagctcagcatttcgctggaggctatatgatcaaacagcaaactgtttatcatgaatgcaggatgtgggcaaactcacattgtcctgccaccaaaacgtttgctgagggacatcattccctgatggctccttgaagttatctacggagaaaattagcgcctattgttcaaagcatgtagttcaaagcctgctgtgaaccaaacagctgactgacaattacccgacaatcaccgcccccaaccccgctttttcgctatctcttttgcctaataaatatggagggctgtgtaaaccagggcccttgtccactagaggcaaggttccccctgaccccttcttccaaatatactcttttgc

SEQ ID NO: 22897 - DNA, 479 bp, Homo sapiens
accctgcctgaggatactgtgtgtgtgtgtgcacgcgcatgttcgcaagtgtgtgatatgtacacccattacacactcttctcaccctccctgcctgaggacacactgtgtgcttgtgtgcatgcgcatgtgcgtatggtacacccattacgcgcaccccctcaccctgcacctgcctgtcagatcactcctctttcagcccattcatttgttcagcaaactttttttttttttggaataagagtttaaaaggcttttctttatttgggttttcaaaaaatttcctatctttgacttgtttttatgtcgttttctttttaaatttaaatccttaaagaaatttgccatttatcatggcacatggtattgtgtacatggcaattatgttcatacctataaacagcaattatgtaggaaatagaatcataaataagcatataatcttatgaataaatttaaatgaataataatttttggtt

SEQ ID NO: 22898 - DNA, 304 bp, Homo sapiens
tataatttgtgctactagagcgtcttggaaacccaggcctataataaaaggcaatagccatcttcttactaagttttgggagttcttgtaggccttggctatcttgcatgaattttacctggttgtgagagctagtgtcaacctgataatattgattatccttgctctagaagtttgtttgtcccttagggtgatggtatacatctaaacattttagtgctggctgataaaagaaataatgtcaaacgtttaaccacaaaaatctctactgtgctttctcgcatgattaccattaagacgttca

SEQ ID NO: 22899 - DNA, 234 bp, Homo sapiens
tcttgcttgcccctctatagtctgttctcaacacagtagccagtgtaatctttttatagtggaagttagatcacttccagtagttccatctcactctacctaccttacacaccttatctcttactactctccttttctgctccactagagccacactggtcttcttgctattccttcaacagaacaagaatgtgcctttcttatggctgttgtgctccctgttctttctgcctg

SEQ ID NO: 22900 - DNA, 388 bp, Homo sapiens
aatggcttagcagactcatagagacatgttttcactcctgtgtgatttccttctcagcctcagcttcctcactgtgtttatgaatgctagaaatctatgtattttaagacctgcttaaaaaataaatgtggtgtgggccatccgaggtgacactgtttaattcacagagcgaatgagtcgtgctctggatctccctggagaggatgctccccatagctctgtttcatgcagatgctagttggaaatgagatttattaactggctctctgcccactgcatctttgtttgtatactccaggcttttaagaatgaatgtataagtctagaggactatttccacatgggtgttttgagcatgcgactacagtagcacatgtttctgaatact

SEQ ID NO: 22901 - DNA, 396 bp, Homo sapiens
gcctcggcctcccaaagtgctgggattacaggcgtgagccaccgcaccccgccctaatgtttgtatttttagtagagacggggtttcaccatgtttgccaggctggccttgaactcctgacctcaggtgatccgcccacctcagcctcccaaagtgctaggattacaggcctgagccaccacaccagggctaaggaagggctattactgaaaaggatggggcatgtttcatatttaacaatcagcccaaggttcccctgcagttcactcacatgtccttctgtgggcgtgtgtcttcgtgcacacctaaaaccatgtccgagtcgatggcgtgtccttatccatggcattgtcctgggtatgggctgacccaggcccaaccaccctgctgtctcct

SEQ ID NO: 22902 - DNA, 388 bp, Homo sapiens
tcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttcaaaaaaaaaaa

SEQ ID NO: 22903 - DNA, 338 bp, Homo sapiens
ttttttttttaatctgtggaagaaagtttgaagtatttatgtaaccagattttaattcaaaaataactgtaaaaatcaggaaaatgtgtattttgtgcatatttatgctgattcgtatactgctcaattccattgtgttggggagaatatgaaatgaatgtacaacaggaaatgaattgcattctgtagcagtgataaaacaagctctgggcattacgtttttaagtgaagttttccttaagttttaaaaaaattttattccaacagcaaaacccacacgtaaacattgcaagctactactgcactccagcctgggtgacagggcaagaccctatctc

SEQ ID NO: 22904 - DNA, 405 bp, Homo sapiens
gtctctccccaaacttgttcagttttcctggggctcccattccctggattctgttactttctccttaaatattgatggctcgttgctagcagttccccccaaaccatgacgtaactgtgtcttctgtcaatttcaccacgttcttgcaaatggaggcaactcctgataagacccaatcccagatcagcctgggctgccgagagcttccaagaacatcaggtaaatggagactgatgctaaagtcacagccgccgagttcagcaggttcttaaagccatcgtgagccttctccgcctcttgcctgctttgtctttactttttcctctctgtggttttttttcccccaccagcatttaaatatcaacaagtctttcttacctgaaaaataaataccttgaacagaaa

SEQ ID NO: 22905 - DNA, 179 bp, Homo sapiens
gcttccggtgggttgaggtcaagttgatcatcctacaattcacatcaagaattacacagctgacaaatctcactggtggccacgctgagaaagcccagttcattccttcccagtgccagagagaaggtgtgggcatcagagaggtgagtttcttaccaaccaagtaagggacattcatc

SEQ ID NO: 22906 - DNA, 223 bp, Homo sapiens
taattagtttatgtatcactaacaacagaattgctactctaacatgtattccacaacccctgaatctgcacaacagattatattttgggaacctgaataatagtttagatttttctatgtgctttaaatataaattcagaaataaaatcagcaaaaatacaaaagtagtcaatttttaaaaaaatgttacttatctttttccacagagtcaaaagggacaaat

SEQ ID NO: 22907 - DNA, 457 bp, Homo sapiens
taacctggttattgtaagcatctaggattttagggttgcttattaccttagcattactgagactgctgatggacacaacttctttggctaaagggaagataaaaatagactgaaactaaaattgttctgctttacaaagacaactcccgatccgcagacctcaatttgaattacaatcagacagcaaggcttgaagaggctggcaatattccatcagagagaacaataaatgtatgaagtctgaataatgaaggaaacatttacaaatacacttgacagaagaagaagggaggcagggtggtggctcacgcctggaagcccagcactttcggaacccaggacaggcagattggttgagctgaggaattcgagatcagcctgggaaacatggtgaaaccccgactctacaaaaaatacaaaaattagccgggcacggttgcacaggcctatagtccca

SEQ ID NO: 22908 - DNA, 663 bp, Homo sapiens
tgagtatttacaacttatacatgtaattgaattctcactacagccctaggatgtacatattattaaccacttatataggtaagaaagctgaggctctgagaagtttagtaacttgtcaactgtcacccaactaaaaagtttcagagctgaggatttagacttagagctgtgtaacttcaatacacagactctatctacttcacaacctgcaatgtgattctgattcctttaattcctgttgtatgtactatgtcagctcaaacccctacccctgtccctgcccatacctccacccactcacctccctaacctccttatgtccctcgcagtagcaagatgtaggtgataggaaggacttcggtgtgagaattagaaatgatgtaaatgtttacgcaggagtgctgggataggagtcgggatggtgagggtagttagatttttgcctcacttgccctgaaagtggtaatagggagaaaccaatctgaattacaattacttaaatgtatcacagactgtcactttgtattcctccaacatgtttggtaacaagtgtttaatgtatgttaaaacaaagaaggtttttatacccttccattaaaatatgtcagtgggcccttccattttatggagtggaatgggaaggcccttgacagccaggaacca

SEQ ID NO: 22909 - DNA, 460 bp, Homo sapiens
taagtgtatatgattgttacctatatgcacattgttgtacagcatatctctagaaaggtctcatctagcatgactgaaatcctatacccatcaaactgcaactaactttcccctctccaaaaacaccattttagtttgtatgagtttgactcctttagatgcctcatgtaagaagaatcaggcagtgttgttgttgtttttgagatgggcttatttcacttagcataatgtcttccaaattcttgttgcagcatgtgacaggatttccttctctttttaacaccttcatttataggtcagctatgtggaagacagaataatttccccgtagaaataaataatggcagatattgcaggacaacccaccaaaacccatataaatcttacttgaaacagtattgagagtagccctctatcacttgatttacaccctccttcttccgtcccaccctccttgttg

SEQ ID NO: 22910 - DNA, 481 bp, Homo sapiens
aaatcacagagttgattatttttcccaaataagagatgggcaggaaagtgatatttcaaatctcaaaaaacacaagccctcttgcttctattccccaccataaattctttttggctccaagtggtggaggaaaaggaggtggcaggcaggggtggcttgcagccacactcccgtgttgtcattcttccccagcagaccacctctggggctgcctcctccacagaggccaagcgtattgcatgtctgccgccttgcccctcgagattaaaaatatcatgtctggtctgaaaacactttctcaaggctgttcctgaacactacctacccacccagattagaagactgcgtctgttaatctaaaacatgtttctagcagaggaggaaggagtgccttcattactcccaggagctgctcccatccttcgggaggaattcaatttggagcggaaatggagaatttcatcagatcttaagtaggagc

SEQ ID NO: 22911 - DNA, 547 bp, Homo sapiens
acttctgtaagcagagacctctgtatccccaggacctagaaggttacccagacatagtagttgcttaattaaaaaaaattattgattgaatgaaagaagactattaaatgttcagttcttctttttttattctgattccctgtgtatccaggggcctcttatttggctgcatgtatgagtttggctgtaatgaaagtattggccgtatatgaccataaacaggcattcctatttctgtcacagttatatttgtcattctgtattaatacatctatatcctgatttctattgaagcatggttaattttgtttgcttctaagcaatgtagctaccctgttgatgctgataaaaataaatttctgaacctataagactgaggattgggcctaggttgtagtaaattggcaagataatggatgctaccctgtcaagagtcctctgaagagaaaagtctgccacccttcaccaggtagaaactccaggcagtgccacattttccagtttgacgccctgtgataccctgaaaagacagatgtttgactctttt

SEQ ID NO: 22912 - DNA, 378 bp, Homo sapiens
tatttcttcctcatctctgtatgttgtcttttgttatatttttaaatttaataatttttcaaactaaatttactttgttcttgagatactaaaggtatcaaattgagtataaagaatattctttgtggccgggcgcagtggctcacgcctgtaatcccagcactttgggaggctgaggcgggcagatcacaaagtcaggagataaagaccatcctggctaacagggtgaaagcccatctctactaaaaatataaaaaaaaaataagccaggcgtggtggcgggcgcctgtagtcccagctactcgggaggctgaggcaggagaatggcatcaacccaggagacggagcttgcagtgagccgagactgcgccactgcac

SEQ ID NO: 22913 - DNA, 873 bp, Homo sapiens
tgaggctgctgtcgccggtgcctgtggacagcagctgcccctgccctcccatctgttcccaggacaagtggaccccatgtttccatgtggaaggatgcatctctggggtgaacgaggggaacaatagactggggcttgctccagctgcatttgcatggcatgccccagtgtactatggcagcagagaatggaggaacactgggtctgcagtgctgaagggtttggggagtggagagcaagggtgctctttcggggctggacagcccgtcttgtgacagtgactcccagtgagccccagaaatgacaagcgtgtcttggcagagccagcacacaagtggatgtgaagtgcccgtcttgacctcctcatcaggctgctgcaggcctctggcgggcagggcactgggagaggccctgagaatgtccttttggtttggagaaggcagtgtgaggctgcacagtcaattcatcggtgccttagtccaagaaaataaaaaccactaagaagcttttgtgaagaggctcttgattgcagcatagtgggagggagggagctgcctggcctgtgtcctcattgccctgggacctccctctctgatgggaagcgtgtggctggagcaggcggcttctgtctggttcttaggggctggttgtggagtgggaagaattgggtgggctctgtctgagctctgagggaggattcagggtttgcacaaaaccctgcccacagcaggtcctgtgtgcaccagcagggctctggccttccgcgggacagtcctcggggagaggaaggttggagccgctgcgagcctggctccccagggctctgcccctgtacttttttcagcccatgtccagggcagactgagctctgaa

SEQ ID NO: 22914 - DNA, 750 bp, Homo sapiens
atatgtgctgaagaatactgtttttcaaaatactccagtttttaacccgtttgtgccagaggttgcgaattttttgtgtgaaaaatcaggccttggcaatgaccttgagcagtagaatataaatcccacaagcttagcgttccagtaatggaacactaggcataaatgggttaacaagtggtaactaagggctatataaaatttggttaacccttgacagcagcagtgcataccagatacttcatgactttcataggttagagtgttttattctcagttatttgaacactcacagtattcatcccacccatagtgacacagctctatgctaagggatcataaatgaattcacacagggtgcctgttcctgcagtatcaccacgtagtgaaggagacatgcattcagctaatgacagtgggaaacagcaaaccacagaggccggtcctgtggaagcacacaggagagaagcaccagctgctgcgtcatctggcacttgactcacttgaggaaaacggttgttttccaacgaggtcatgttcttagagctttttctgacatgttacttttatatattcttcttatgaagtcaaattgtaaaaatccattctcatttgatgtatttcccacattgcacatttattgcacttcagaacctggaaattgtatgctaagtatgctttgtattttgctttttaaagaactaactcatctggtttcaggactagatctactgtagaaagaaaaaaaaa

SEQ ID NO: 22915 - DNA, 180 bp, Homo sapiens
agcaaaatatagggatatagtttggagagtaaggctctggttttgatttaataggagttccaagataagcaatcttaggagggcctagtactgtccccaaacttttctagcaagacagagaagttgctattttctattcttgatgggcaggagtcagtcagtgaaagaatacagctatgg

SEQ ID NO: 22916 - DNA, 203 bp, Homo sapiens
taacctattaaattagaaaagatttttcttaaaagctaatacacaatgctgttgatggaggaagggtattcttacagttgtcggtagaagagtaaattggtacaagccttctggaaatcagtctaacatatcaagagactaaaaatattcatatcctttttactaattccactccaaggaatcaatctgaaagaaataatcag

SEQ ID NO: 22917 - DNA, 537 bp, Homo sapiens
gcctcctgaagtgctaggattacaagcatgagctactgcactcggccagtgcaaacacttctttgcgatccttcagtagccctcagtagtcctgtactcacaatcttatcggccctctgtggcaacaactccaggtctgccagcacaggtaggatccagctttcataccttcccagggcctgaactcggtcatgcagccattgtgtactccctgttttctgtactctctatcatccttccccagggcttcctctctctggaagcaccttggccattaaaccagcctggtggcctagaggacatcctactggaactaggatgtgattctcttaggccccctctctcagctgccctctctcaaaaagcaagctctccttggttctattaaaaatgtgtcggccgggcgtggtggctcatgcctgtaatcccagcactttgggaggctgaggcaggagaattgcttgggaggcagaggttgcagtgagccaagatcgcgccactgcactccagcctgggcgacagagcaagcctctgtct

SEQ ID NO: 22918 - DNA, 503 bp, Homo sapiens
attgttaaactctgtggtattttttttctttgtgtgtgttttatgagttagcattattttatagaaagatttagggatttattatttatattatttatattactattatttagattattctgacagtcttctgtgtcctcagacaagttagcagagcacagatataatacattagtcagaatttttccatttccgtgttcagattaatcttagaataatttttacctgtctttgttaacaggtattatgcttttaacttcttaactcctagtacatgagtaaaaggtagtaatcatgacatagccaaatgacagagtgcttgtatttgccacaaagcatgtagttccttgtaaatccttgagaaaggtaaattatctctctctctttttttgagatggagtctcgctccgtcgccaggctggagtgcggtgagccgagatggcaccattacactctaacctaggcaacaagagcaaaactctgtctcttaaacaaaaaaaaaa

SEQ ID NO: 22919 - DNA, 205 bp, Homo sapiens
atcttttcacatatttcagtgtattttttttatagatttaaaatatacctgaaaacttttctaggaagaataattattcatggaaagagcattgtaatggcatgttttggggagaaaagacatgccaagtcttgtttactacatttaagatgtttacaactatactgggctgctttattaacaatactgtacttgcataatatgg

SEQ ID NO: 22920 - DNA, 314 bp, Homo sapiens
tttttgttttttttttttcattttcaacagaagagagttgatttggtttggctgtgtccccacccaagtcttatcttgaattctagttcccataatcctcacatgtcatgggagggacctggtgggaggtaattgaatcatgagggtggtttctcccattctgttcttgtgataacgagttctcatgagatcttatggttttataagcatctggcatttcccctgcttgcactccttctctctcctgccgctgtgtgaagaggtgccttccaccatgattgtaaatttcctgaggcctccccagccctgtggaa

SEQ ID NO: 22921 - DNA, 502 bp, Homo sapiens
ggtggcggggaagagagagagagagagagagagaaacctatatggccagaggtttagttctctatgtaaattatcaatcctctttttcttcatctttgccagcctgtcctatatcaaatcagttcagccgaatcacagccagaaagacccctgtgcctagaacagggcgcatgtttgcttaattcacctccagacccactcctcagcccagtcttgtttgcaagcacccctccctcactcagcatgtctgggttagctttgcaaccacagagtcactggaggcaaagagtgccttaggtagcaggaggtgaaaagtgttccctgggaatgtcttttccacctgatccccattcccgagcatccttgggtcacccatggcctgcctccagtgggtgcagagggtagctccttccagagggcccaggtgctaatgacaggtcatggcatctgaagcctgggctggctcaggaggcagaagaaagtgagcaactgtggctcctgc

SEQ ID NO: 22922 - DNA, 433 bp, Homo sapiens
gatttaagccacagacattgcccaaattatagcctagcactaacaacactaacattaaagtaatagagtactctttagcttgctgttgtgatggatttttaaggaagcagtatttccttagaaaccacattaaaacctaccaattttgtgaacatttataagaatacatctgagtcatttttgttagagaaatattgaacactaaaactgtagcagttctaagatagagtgctgttaaatgttttgaacaacaggagtttattgcatagactgaactaataaaggactgaaataattttttaatgttatgaaaaatataattcttcagcgaactaaggtatttaaatactttgtatatcttgcaatacagttacttccattgcactgacttaaaaggatgtccctcattttgtaacttattgttttgataatg

SEQ ID NO: 22923 - DNA, 186 bp, Homo sapiens
aaaaatgtcattgtgcatgaaacatttctttatataggattattttctcaggatagatttccacattagtggaattactgggtcaaaatgaatgaagtttcaatacatgttgccaacccactttcccaaagatgatttgaattttcaccactgatttacgagaacacctcaacctcttcgctgtct

SEQ ID NO: 22924 - DNA, 2499 bp, Homo sapiens
ggcctgagagccgactgaggccttgtggactgcagtgggccctccggtccctctaaacccccaggcctcctctctgcttggtatctgtttgggattgaagaccgttggttccataaacctccatgaagatgggagtctacctgaagaggcagcggaggaggaaatggcaggtcctaatcaactctgcattcgccgctggactaccaagcatgtagctgtgtggctgaaggatgaaggcttttttgaatatgtggacattttatgcaataagcaccgacttgatggaatcacattgctaacattgactgaatatgatctccggtctcctcctctggaaatcaaagtcttaggggacattaaaaggttaatgctctcagtccgaaaattgcagaaaatacatattgatgttttagaagagatgggctacaacagtgacagtcccatgggttccatgacccctttcatcagtgctcttcagagtacagactggctctgtaatggggagctttcccatgactgtgacggacccataactgacttgaattctgatcagtaccagtacatgaatggtaaaaacaaacattctgttcgaagattggacccagaatactggaagactatactgagttgtatatatgtttttatagtatttggatttacatctttcattatggttatagtccatgagcgagtgcctgacatgcagacctatccaccactcccagatatattcttagacagcgttcctagaatcccatgggcctttgccatgacggaagtatgtggcatgattctgtgctatatttggctcctggttcttcttcttcacaagcacaggtcaatacttctgcgaaggctctgtagtctgatgggaactgtattcttgcttcgctgctttaccatgtttgtgacctccctctccgtgccaggacaacacctgcagtgtactggaaagatatatggcagtgtatgggagaaattacatcgagcctttgccatttggagtggctttggtatgaccctgactggcgttcacacatgtggagattacatgtttagtggccacacagtcgtcctaactatgctgaatttctttgtcaccgaatatacaccaagaagctggaatttcttgcacactttatcctgggttctcaacctctttggaatcttcttcatcttggctgcccatgaacattattctattgatgtgtttattgctttttatataacaacaagactctttttgtactaccatactctggccaataccagagcatatcagcagagtaggagagcaaggatttggtttcccatgttctctttttttgaatgcaatgttaatggcacagtacctaatgaatattgttggccattttcaaaaccagcaataatgaaaagactaattggatgaatactatctttctaatgaatttgtgattaaatatataatagttgttgaaaatgagtaactttgcgttctccccctaggttgttcttagatgcctggcttatgtgttgacaaagtaaagttttctgttctgagcaaagttatgattataaaaagcaagaaagaacaatcaagagtccttatgtagctatttgaacagaaagcttaagtagatgttttctgccccttctctttaggaagacttaatgttgtgattgaagtcaggctgtacccttacctgttgagtatttgcttattgaactttaaacaagtcaacttgagcagtttgctggttgaggaattttcattgatttccagtagggctctagtcaagaaataatatgttttgaagctccttattacctttagaagaagaaaccctaacaagtgacagtacttgttctttggactaatctttgtttcattttaaaaaatgcaaccctgggacatgatctgttttactgacaaagagtttttgccttctgaaccatctttaaatatactgagcataccaggatgcctgaaataagaagagaatgaaagaggccatagatgacgtgacagagtactggctaggatgccattggtctcctcattaatgcaaatgtagggctggcatatttcaccaaagatgcaacaaaagatgcagtgccagtgtgaccctcagtgagtattcatgagggaaaaatggctgcatccataaaaataaatgggcttaatgttagtggtataggtacccagaataacttctttgtgctatagttgttagatgacagttcaattttatgcttttttaatggtgttattaaatgagccaaataggagtgttttaccagatgttagataaagttcttaatgccgttaagtagggaggtatgcatgcaaagaattgttttctcctgaaaagaaacttacagcacgcaaaatataactttttggtttttgaaatttatcattcttggctgttggaagtaaacagtctcagacatacttggatatgaaaaagtttcgttgttttttacttttaaatataatggtgtatatacattctt

SEQ ID NO: 22925 - DNA, 2440 bp, Homo sapiens
ccggcgaggcggggagggccccggactccgacggcggctcggacgccgactcggaggtgggtccggggagcccgactcggaccgcggaggcagcggaggaggaaatggcaggtcctaatcaactctgcattcgccgctggactaccaagcatgtagctgtgtggctgaaggatgaaggcttttttgaatatgtggacattttatgcaataagcaccgacttgatggaatcacattgctaacattgactgaatatgatctccggtctcctcctctggaaatcaaagtcttaggggacattaaaaggttaatgctctcagtccgaaaattgcagaaaatacatattgatgttttagaagagatgggctacaacagtgacagtcccatgggttccatgacccctttcatcagtgctcttcagagtacagactggctctgtaatggggagctttcccatgactgtgacggacccataactgacttgaattctgatcagtaccagtacatgaatggtaaaaacaaacattctgttcgaagattggacccagaatactggaagactatactgagttgtatatatgtttttatagtatttggatttacatctttcattatggttatagtccatgagcgagtgcctgacatgcagacctatccaccactcccagatatattcttagacagcgttcctagaatcccatgggcctttgccatgacggaagtatgtggcatgattctgtgctatatttggctcctggttcttcttcttcacaagcacaggtcaatacttctgcgaaggctctgtagtctgatgggaactgtattcttgcttcgctgctttaccatgtttgtgacctccctctccgtgccaggacaacacctgcagtgtactggaaagatatatggcagtgtatgggagaaattacatcgagcctttgccatttggagtggctttggtatgaccctgactggcgttcacacatgtggagattacatgtttagtggccacacagtcgtcctaactatgctgaatttctttgtcaccgaatatacaccaagaagctggaatttcttgcacactttatcctgggttctcaacctctttggaatcttcttcatcttggctgcccatgaacattattctattgatgtgtttattgctttttatataacaacaagactctttttgtactaccatactctggccaataccagagcatatcagcagagtaggagagcaaggatttggtttcccatgttctctttttttgaatgcaatgttaatggcacagtacctaatgaatattgttggccattttcaaaaccagcaataatgaaaagactaattggatgaatactatctttctaatgaatttgtgattaaatatataatagttgttgaaaatgagtaactttgcgttctccccctaggttgttcttagatgcctggcttatgtgttgacaaagtaaagttttctgttctgagcaaagttatgattataaaaagcaagaaagaacaatcaagagtccttatgtagctatttgaacagaaagcttaagtagatgttttctgccccttctctttaggaagacttaatgttgtgattgaagtcaggctgtacccttacctgttgagtatttgcttattgaactttaaacaagtcaacttgagcagtttgctggttgaggaattttcattgatttccagtagggctctagtcaagaaataatatgttttgaagctccttattacctttagaagaagaaaccctaacaagtgacagtacttgttctttggactaatctttgtttcattttaaaaaatgcaaccctgggacatgatctgttttactgacaaagagtttttgccttctgaaccatctttaaatatactgagcataccaggatgcctgaaataagaagagaatgaaagaggccatagatgacgtgacagagtactggctaggatgccattggtctcctcattaatgcaaatgtagggctggcatatttcaccaaagatgcaacaaaagatgcagtgccagtgtgaccctcagtgagtattcatgagggaaaaatggctgcatccataaaaataaatgggcttaatgttagtggtataggtacccagaataacttctttgtgctatagttgttagatgacagttcaattttatgcttttttaatggtgttattaaatgagccaaataggagtgttttaccagatgttagataaagttcttaatgccgttaagtagggaggtatgcatgcaaagaattgttttctcctgaaaagaaacttacagcacgcaaaatataactttttggtttttgaaatttatcattcttggctgttggaagtaaacagtctcagacatacttggatatgaaaaagtttcgttgttttttacttttaaatataatggtgtatatacattctt

SEQ ID NO: 22926 - DNA, 750 bp, Homo sapiens
cccacacagggcaggcaccccacacagggcacagaccccacgcaccccacacggggcaggcagctcacacagggcccagaccccacgcaccccacacagggcacagaccccacgcaccccacacagggcacagaccccacacaccccacacagggcaggcacctcacacagggcacagaccccatgcatcccacacagggcaggcaccccacacagggcacagaccccacacaccccacacagggcaggcaccccacacagggcacagaccccacgcaccccacacagggcagggatcccacgcagggcacagatcccacgcagggcagggccagcccaaggccaggcccctcccctgtagatctcctcccaggcaggaccagagccacagtcacttccacactatctccttccctagaaacctctgcagactcttcctcctctcctcgatacacaggggcccctgccacagcctgactctctgccacctcgtgagtctctggaaagcagggtcggcctctgaatacagaggacttgggtcctgccggaggatgcttggccagtgggtgctggcacgtgagcagcccccggggagtcagagtggggctgcagcgaaggccgtggtggtcgaggtgagggtggtggccaggtcttgttgccgcagtgaggattctggggttaccctaagagccaccacattcaggcactcaagaaaaagcacgtcaaaataaaatattttcacctgattaa

SEQ ID NO: 22927 - DNA, 541 bp, Homo sapiens
gcggccgctccaacatcagaatggccccacacagggcaggcaccccacacagggcacagaccccacgcaccccacacagggcagggatcccacgcagggcacagatcccacgcagggcagggccagcccaaggccaggcccctcccctgtagatctcctcccaggcaggaccagagccacagtcacttccacactatctccttccctagaaacctctgcagactcttcctcctctcctcgatacacaggggcccctgccacagcctgactctctgccacctcgtgagtctctggaaagcagggtcggcctctgaatacagaggacttgggtcctgccggaggatgcttggccagtgggtgctggcacgtgagcagcccccggggagtcagagtggggctgcagcgaaggccgtggtggtcgaggtgagggtggtggccaggtcttgttgccgcagtgaggattctggggttaccctaagagccaccacattcaggcactcaagaaaaagcacgtcaaaataaaatattttcacctgattaa

SEQ ID NO: 22928 - DNA, 1218 bp, Homo sapiens
  misc_feature (816)..(816): n is a, c, g, or t
  misc_feature (823)..(823): n is a, c, g, or t
cccacacagggcaggcaccccacacagggcacagaccccacgcaccccacacggggcaggcagctcacacagggcccagaccccacgcaccccacacagggcacagaccccacgcaccccacacagggcacagaccccacacaccccacacagggcaggcacctcacacagggcacagaccccatgcatcccacacagggcaggcaccccacacagggcacagaccccacacaccccacacagggcaggcaccccacacagggcacagaccccacgcaccccacacagggcagggatcccacgcagggcacagatcccacgcagggcagggccagcccaaggccaggcccctcccctgtagatctcctcccaggcaggaccagagccacagtcacttccacactatctccttccctagaaacctctgcagactcttcctcctctcctcgatacacaggggcccctgccacagcctgactctctgccacctcgtgagtctctggaaagcagggtcggcctctgaatacagaggacttgggtcctgccggaggatgcttggccagtgggtgctggcacgtgagcagcccccggggagtcagagtggggctgcagcgaaggccgtggtggtcgaggtgagggtggtggccaggtcttgttgccgcagtgaggattctggggttaccctaagagccaccacattcaggcactcaagaaaaagcacgtcaaaataaaatattttcacctgattaaaaaaaaaaaaaaaaaaaaaaaaaaaaaaaaaaaaaaaaaaaaataaaaaaaaaaaaaaaaaataanttttggnccgattaggccaattaaattttagttttaagcaagcttatgcatccggccgtaattcaagctcgctgggacaattacccctataaagagttttttttctttccactggccgccgttttacattataaggccgggaaaatctttggggtggcccaatttaattgtcttgaggcaattccccttttagggggggggttaaaaaaaaagggccccccttttacccctttcaaaagttaaaccctggattgccaaaataaatggggggggaaaaactcctttttaaagggggtgaaattttgaaaaggacgccttttttacccttaaaaaaaatggggaaaatttggtaaataaaatgaaaggccctattttttaaaaattgcccaattttgaaacgtg

SEQ ID NO: 22929 - DNA, 378 bp, Homo sapiens
tgcggaatgccaacgtaacaaagtccaagtcaaaggtcaagctgtgcactaaaatctctcaagtcacccgcttggccctcttccaaatgtactttacttcctttcattcctgctctaaaactttttaataaactttcactcctgctgtaaaacttgcatcggtctctcctgccttatgcccctcagtctaagtctttcttctgaggaggcaaaaattgaggttgctgcagacctgtccagatttgccacgctaacaacacagcatactgaacttgactctgaaataagagaagctggcctgagtaagacttagaaatacagaggaaaaatgatatgattgcctacttgtagtataaacatatactttgtggagataaa

SEQ ID NO: 22930 - DNA, 570 bp, Homo sapiens
tgacttgctgaaaaatagaaaccagatgggaagtatattagcattatgattgaaataagggtaaatgagcaatgtgtgaaggttttcactgacttcacctaaaagatagtttagctacttgaattttagtaaatagaatttttcctttatttcatcggtccccccaccttttttttttttttgcacctgccttgtaaatttaatagttaagtgacctctgcctagaggatgatatttggggaggtttgatgtttcctgtgggaataagacgattcacaggtgagagtggggccacattagctgttattgtttccatgggtcagtgtggaaaatggattaatcatattctaaacgttcatggacctcattacagtcacaattgtctattctgtttcctaccctgaacacattaaaatggtaggaactaatgccttatttaattactaaaagccaccattttctttgatagattgagctacagattgtaaacttcatgtatttctttataagtcaacccttttcaaagatatgcacatcaaactgaatgaataaataaatattgagaagttg

SEQ ID NO: 22931 - DNA, 1231 bp, Homo sapiens
  misc_feature (1231)..(1231): n is a, c, g, or t
tctgaccagcaccatggcggtggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgaaaaaaaaaaaaacaaaaaaaaaaaaaaaaaaaaaaaaaaaaaaaaaaaaaaaaaaaaaaaaaaaaaaaaaaaaaaaaaaaaaaaaagaaaaaaaaataaaaaaaaaaagaggggggggccgccgcaattaatgtatttctctaggtgggagggacgctagagattgaaatcgaccacacgagatttgttgatatcacaggagggggacccctcaattgagtagcgattcgtttagaatagactgacacggctggcgtcgcttaattaacgacgctcgggtgacgtgagcagaaaaattaggttcatcgatcgtatattcttggagcaaagccaccatttaggcgggtggaaggaaatataggtgggaagaagacacatan

SEQ ID NO: 22932 - DNA, 547 bp, Homo sapiens
agtttgttttgtctcagcataaatcataggatcgacatctattagtcaaataggcaaactgttcccatctttcaccctgtcagaccattagaagatgggccacagcaacattttttttttcgttttccaaatccaaaatgaaatttggaaaaagctgctaattagaattcttctccaaacccagttaaaactgagaactacttattctgtcataaaaacttatgagagatttcctaagtctatatacatacagagatatagttctgcttgtgataagttggaaagagtgcatcgttttatgagttggcaagaatatacttgatcttagccaaaaggcccagaagtgatgacttggcaagaataaatgcttagcgtttacttattcatgaagcatttacaggccaggcaaggtggcttatgcctgtaatcccagggctttggaaagccaaggtgggagaatcacttgaggccaggagttcaaggttacagtgaggtatgtcatgccactgcactctagcctgggtgacagagtgagaccctgactctt

SEQ ID NO: 22933 - DNA, 516 bp, Homo sapiens
gctggtcagttctgctctaggccagctcagctgattttagtggtcacctggcagctaggttgaagccgggttgacggccgcattcacatatctgatggttgtcctgatgttatctgggcccacagggtgacttggctacgtgtccataattatctagctggctagcctgggcttgttcacagtggtggttgcagggttcctaaaagcagcagaagagggctggccccagtgtgcaaagcacctcttaagccactgcttgcacaacatttgctcttgtcctgttggccaaagcaagttacatggctaagtccacagtcattgtgggcagggcctacccaaagatgtggatgcaaagaagctgagcaaattagggttcgtttctgcaacactcctccataacatacattcagaaaagcattcacccataatattacagtggggtgccattcacagatgggacacccatgtagccagcacccaaatccagcaatggaaacatgaccagcctgccagaat

SEQ ID NO: 22934 - DNA, 508 bp, Homo sapiens
caaactccagcctgccctgcctgtctcctgcaggcggctacctctgggcaggtgcaggtttcagggtgcatatggaggggaagtgatggtgggggtaccccgtgtttgcagagctggcgggagaccacggcattcctatggcccatgtcccctcacccccgcccccctgccccagcgctgctgaacctcgacgtgtgtgtctgaaggtctccatccgtgcctctccagacgttgcccaccttcccctttgctgggcagtttgtgtaacgcggccagcaggcaccgcgaggccttgcttcctcacctctcgcccgctgtcggagctccatgagttgagcttgactgtccggggagtggagccacctctagcaggtacctgggtgtacctgttatcacccatctgtcagctgccgctagacagcggagggagcccagcatgggggagagaggggacactcagagggttgtctgagcagaggtggttctttcagaatcagaggaaggttgt

SEQ ID NO: 22935 - DNA, 413 bp, Homo sapiens
gtcacggttgatcttgtttatactctattcgcacgcctatttccctaccttcctacccccaactcacctgatgtacttagaagcaagttgtgggcagcattttgatatctacttcaaaaacttaaaaaattttttttttctatagtactgtttttttttcttaacttttaaaactttgttaatcccagaactttgggaggccgaggtgggtggatcatgaggtcaggagattgagaccatcctggctaacatggtgaaaccccgtctctactaaaaatacaaaaaattagccaggcatggtggcacatgcctgtagtcccagctactccggaggctgaggcaggagaatggcatgaacccgggaggcggagcttgcagtgagccgagatcgcaccactgcactccagcctggg

SEQ ID NO: 22936 - DNA, 445 bp, Homo sapiens
gaatgaaaatgttagaattctatgacaagccgtaggttataatggaactaattctggaccaagaatcaggagtcctgagtcctggctcttagaaaggaattgtagtatgcagtatttaaagaatgtagactttggattagtgacacagctttaaatctcagctcttttgtgtagctgtataataattgtataaatttaagcaaattggttaacattttagggccatgtataaaatatgaccagtaaattcctgtcttttcaagttgttaggagtaaatgagacaacatgaagtacaaagatgctacactatgtgatagtgattaaaatactgtaaatttgagctggtccgaaggtagtgagttaactcaattgattatgtagtcagtaacagatcgaacttgttctattctgttgccccccttttcactattgcactcgactagt

SEQ ID NO: 22937 - DNA, 413 bp, Homo sapiens
tttagtaatatacttgtcaaacctaagaaacacattagtacatcactaattaactaaactccagacttcgatcagttggtgaacatggtgtttttcaggctgcctctctgtaaagccatgatttcccctttccctactcttctttggaggcaagtcactaaccctagcccaccctcaaggggaggaggggaggaactaaggtctgtttcctgtagggaccagcgtctacatatattatttagaattgtattgaaagaaatatctcactcaccctaacttttaaaaagatacaatgggatatgatatgatttatggcctggacaagatcgtatagacttgtttctttctgctcttctctgttaaatatgataataaacgctggaaatagcacaagaggcaaccaaaagagaatg

SEQ ID NO: 22938 - DNA, 456 bp, Homo sapiens
ccttcatgaagacttccatgaatacaatgaagatagaaaaggaaaagcttgagttgtttgaaatcatgtaatgtaattgtctttcccagaaactgactgtcgttttctcttacgcacagcgggttgaggtatggaatatgaattggatgagatgtttatctctgatgaatacatgttgactggtgtgagtaattgctgcctaggaaaaggactttaatctccttcatacctcctgggtaaattctgctgatttagtaggaggaaggaaaatttagagacaattgggtgtgttggaaatcaacttggtcagcacaatagcccagaagtcaagaattgaggagtatttccagggcttaccattgactctcttgggatcacatcagttaataatttctattactactccgagggcactcatgagcagcagaaatcacctctgtcaaaatagctctgtga

SEQ ID NO: 22939 - DNA, 424 bp, Homo sapiens
tcaaaagatgaaaactgcagagcgatttcaaagcccgtcagctgtttggcattgagacaactaaaattctgtaagaagggcaaatggggtcaaaacacaaaaggaaatacaatattgcctttaacaacggcaactatttctgaggcaaaatgtcacatgtcacctctgtgaaactttaggatagaagcaaatacagatgagtgaggttcctgcagctcatctctgtgaacatggattgttggagaacccgcagcccgctcgggtaaccaacaggaaactggccaggagcaagcctatcaatcaaatcatccactctaacctgccagaagggttctctaaaagagtttttaaaacttaaggcaaaggaaactcagcagtcatatatttatctgaattttcaagaagttttgactaagaactgctc

SEQ ID NO: 22940 - DNA, 246 bp, Homo sapiens
catgtgtcagaacccatagagctatacaacatacagagtgcactctaatgtaaacaatggactttagttcataataatgtaccaatattggttcatcaactgtaagaaatgtacaactcaaacgcagatgttactaatagaactgtgagagagtagagaggggttatatgagaactctattcctatctcctcgatttttttcataaatctaaaactgctctgaaaatagtgtgcgaaaatgtcatt

SEQ ID NO: 22941 - DNA, 409 bp, Homo sapiens
tgtataaccttccattgaatacttcaattttattgaaatttattttttaaaatacctaaggattgtctttaaaaaatctctattagttgatcaaaataactgttaggaacaaaatgaagctacttctatttgtgttggaaattttaataatgaggcaaaataatattattgaaatatatctactatataaaacatttttcctatagaaaaaatgtagttataaggatttgaaaaattaagttattggaaatttactctacaactgctagatagatgaaaatttgaaaaataacagaatgccttcttcctccctttcccattttttgacccctggcaactactgatctgtgtccatctctatcattttatcatttcaagaatgttacatgagtaaaatcatacactatgt

SEQ ID NO: 22942 - DNA, 1414 bp, Homo sapiens
cccgccccggacacaaagctgctccgcgggagcccgcctcacctgcagcacggggcgccgcgggccttcgagaaccatcggaccccgctccggcgcgcgcgtcacagcccaggcctcccggagccgcccggcgccgccgcccccgccgccatttcctcgcgctcgccgtcgcctcgtccccgctgtcaggttactccattcacctgggcctgcagcagcctgcgccgcgcctccgcctcgacccctcccgccggcgcctgcggagactgcgcagcgcccggctggccggcagccagcgcacggcccgcggcaacggcgcacagccgcttggagaatcccactggctcccgcaccgcccctccgcgcccccacgctccgctcgccccgtggcggcatgagagcgagcctgtgattggacagggcctggcggtgaaaggttaatcccggccccccagccactcaggagcagggagacagcgggcgcgcgcgcggaggccggagaggcgtttgcggcccagcgcctggactggaccttggcgttgggccgcagttgcccggagtttttggggcccccgggaacccgcgcgccgaggccggctaagtttggcagactctctgagctctcggaattcgactgcctccattgttgctccttctggcacccacagaccgtaacgtggccgtaattgtttcccggagagcttagcttccctctgagcacctccctcccctttttaaagtaccttcccactcgcctgcgtttcctcgcgttagtggtgcaggggcctccgcatttggggaaataacaaacacccacttccgccccccaccccaaccgggatccccagataatgagaaatagatggtggccctctgtttgtaagctgttcatttgcataggtcggaaccgcgcaccacagcttgaagctaggaattaaaatatcggtgggaattaaataagtggctggcttaaagaacatcttcttaatttatccccaaatgtagacatctcttcagtggaccccctgataggccggtttgctccaggtgaggtgtgctcacagcaactgcaaccgtgtttctttcagaccatgggcgtgagcagaacctactatgcgcccctgctgcctgggctgtgctgttcagtttggggccaccagccccacatggctcctgagcacttaaagtatggctagtcggaatcgagatatatgcattctttaccaaataatgttcaaaaaattgttacatgttgaagtgataaactttttccatatattgggataaaagttttatatgtttattttttagtgtgggttctacagaattttaaatgtcacctgtggcctgcattatattgccattgggcaggctgatctagggcttgcatgcctgtgatccttaggtgcaccct

SEQ ID NO: 22943 - DNA, 1637 bp, Homo sapiens
cccgccccggacacaaagctgctccgcgggagcccgcctcacctgcagcacggggcgccgcgggccttcgagaaccatcggaccccgctccggcgcgcgcgtcacagcccaggcctcccggagccgcccggcgccgccgcccccgccgccatttcctcgcgctcgccgtcgcctcgtccccgctgtcaggttactccattcacctgggcctgcagcagcctgcgccgcgcctccgcctcgacccctcccgccggcgcctgcggagactgcgcagcgcccggctggccggcagccagcgcacggcccgcggcaacggcgcacagccgcttggagaatcccactggctcccgcaccgcccctccgcgcccccacgctccgctcgccccgtggcggcatgagagcgagcctgtgattggacagggcctggcggtgaaaggttaatcccggccccccagccactcaggagcagggagacagcgggcgcgcgcgcggaggccggagaggcgtttgcggcccagcgcctggactggaccttggcgttgggccgcagttgcccggagtttttggggcccccgggaacccgcgcgccgaggccggctaagtttggcagactctctgagctctcggaattcgactgcctccattgttgctccttctggcacccacagaccgtaacgtggccgtaattgtttcccggagagcttagcttccctctgagcacctccctcccctttttaaagtaccttcccactcgcctgcgtttcctcgcgttagtggtgcaggggcctccgcatttggggaaataacaaacacccacttccgccccccaccccaaccgggatccccagataatgagaaatagatggtggccctctgtttgtaagctgttcatttgcataggtcggaaccgcgcaccacagcttgaagctaggaattaaaatatcggtgggaattaaataagtggctggcttaaagaacatcttcttaatttatccccaaatgtagacatctcttcagtggaccccctgataggccggtttgctccagaagagacggggtttcaccatgttggccatgatggtctcgatttctgaccttgtcatccgtccgccttggcctcccaaagtgctgggattacgggcgtgagccaccgtacccagcctgcttcctgttttaacagacgaagaaatggaataacttccaacaacacaggttggagctgaaggagtgcccaggctgcggatggaggaaggacgtgctcgggagaaggtgaagatgggagagaagcaagatcttctgtgtttggaccaaggacacatttccttactccatagcagctgtggtcagtggcttagctcggacaaggagatgagagcccatgtgttgtgagggttcttctgggaactctgagaaggcaggagccgcccccgcccttcactgcctctcttccattctgcagcatggaatatggatgtgtggtctggatgtacagacaccattttggaccataaagacaaggacgattgtctaaggatgacacagccagagcactgagagtggcgagaaggacaggggagctgctgtgccaagcaggactgtctctcttaagagaaaaataaaatttattggtgtttaaa

SEQ ID NO: 22944 - DNA, 1303 bp, Homo sapiens
cccgccccggacacaaagctgctccgcgggagcccgcctcacctgcagcacggggcgccgcgggccttcgagaaccatcggaccccgctccggcgcgcgcgtcacagcccaggcctcccggagccgcccggcgccgccgcccccgccgccatttcctcgcgctcgccgtcgcctcgtccccgctgtcaggttactccattcacctgggcctgcagcagcctgcgccgcgcctccgcctcgacccctcccgccggcgcctgcggagactgcgcagcgcccggctggccggcagccagcgcacggcccgcggcaacggcgcacagccgcttggagaatcccactggctcccgcaccgcccctccgcgcccccacgctccgctcgccccgtggcggcatgagagcgagcctgtgattggacagggcctggcggtgaaaggttaatcccggccccccagccactcaggagcagggagacagcgggcgcgcgcgcggaggccggagaggcgtttgcggcccagcgcctggactggaccttggcgttgggccgcagttgcccggagtttttggggcccccgggaacccgcgcgccgaggccggctaagtttggcagactctctgagctctcggaattcgactgcctccattgttgctccttctggcacccacagaccacatctcttcagtggaccccctgataggccggtttgctccagaagagacggggtttcaccatgttggccatgatggtctcgatttctgaccttgtcatccgtccgccttggcctcccaaagtgctgggattacgggcgtgagccaccgtacccagcctgcttcctgttttaacagacgaagaaatggaataacttccaacaacacaggttggagctgaaggagtgcccaggctgcggatggaggaaggacgtgctcgggagaaggtgaagatgggagagaagcaagatcttctgtgtttggaccaaggacacatttccttactccatagcagctgtggtcagtggcttagctcggacaaggagatgagagcccatgtgttgtgagggttcttctgggaactctgagaaggcaggagccgcccccgcccttcactgcctctcttccattctgcagcatggaatatggatgtgtggtctggatgtacagacaccattttggaccataaagacaaggacgattgtctaaggatgacacagccagagcactgagagtggcgagaaggacaggggagctgctgtgccaagcaggactgtctctcttaagagaaaaataaaatttattggtgtttaaa

SEQ ID NO: 22945 - DNA, 1713 bp, Homo sapiens
tgcatatgatcgtaatgatcagccaggcttacatatagagcagagtgactgctctatattctccactgatactctggcatttattataaaaagttgaaggatggcagttaaattgttcagcatatcccaagaatatcttttccctttgaagaagagtggcctccctattctttgcaattccaagaattaaaagtacagataaatactacaaattggctccctttgccttgtttcctataaacctgttttgtttgtcccacagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaaaaaagccaggcatggtggtgggctactctggaggcccttgaggaccacttgagcccaggagattgaggctgcagtgagccatgactgtgccactgcacctctagtctgggtgacagagcaagaccctgtttaaaaaagaaaaaggccaggcacggtggctcatgcctgtaatcccagctacgcaggaggccaaggcaggagaatcacttgaacctgggaggtggtggttgcagtgagctgagattgtgtcattgcactccagcctgggcaacaagagcaaaactctgtctc

SEQ ID NO: 22946 - DNA, 1865 bp, Homo sapiens
gcatatgctttggtgtcatatctaagaaactatttgatccaagatcatgaaaattgactcccatgttacataattttacagtcagttttgactgtatcttcctgcttcttgaatttctgataatttgtttttgaatgccatacattctgaattttacctttttaggtcctgcataattttgggatttctaaaaacattcttgagctttgttctggcatgtggttagcatgtttatagtttgatcttttcgtgtcttttacctttgttatgcaggaacagagtagcatttagtatatggttaattttccccactactgaggcaaggctcttcttggttcttttacaaatgcccatggatcatgaggttttccactctggctgttgggaccaggacaagacactgttcctggcacgaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaaaaaagccaggcatggtggtgggctactctggaggcccttgaggaccacttgagcccaggagattgaggctgcagtgagccatgactgtgccactgcacctctagtctgggtgacagagcaagaccctgtttaaaaaagaaaaaggccaggcacggtggctcatgcctgtaatcccagctacgcaggaggccaaggcaggagaatcacttgaacctgggaggtggtggttgcagtgagctgagattgtgtcattgcactccagcctgggcaacaagagcaaaactctgtctc

SEQ ID NO: 22947 - DNA, 2636 bp, Homo sapiens
gcttcccggaagtggcggcgcggtcagggctggccttggcttcagctgcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagcttgaaggtttatctatactgttcacctgtgactaaggagttgttgttaacgagcccgaaatacagattttggaagaaacgaattatatctattgaaatcgagactcctacccagatatctttagtggatgaagcatcaggagaggtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaaaaaagccaggcatggtggtgggctactctggaggcccttgaggaccacttgagcccaggagattgaggctgcagtgagccatgactgtgccactgcacctctagtctgggtgacagagcaagaccctgtttaaaaaagaaaaaggccaggcacggtggctcatgcctgtaatcccagctacgcaggaggccaaggcaggagaatcacttgaacctgggaggtggtggttgcagtgagctgagattgtgtcattgcactccagcctgggcaacaagagcaaaactctgtctc

SEQ ID NO: 22948 - DNA, 2692 bp, Homo sapiens
gcttcccggaagtggcggcgcggtcagggctggccttggcttcagctgcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagcttgaaggtttatctatactgttcacctgtgactaaggagttgttgttaacgagcccgaaatacagattttggaagaaacgaattatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaaaaaagccaggcatggtggtgggctactctggaggcccttgaggaccacttgagcccaggagattgaggctgcagtgagccatgactgtgccactgcacctctagtctgggtgacagagcaagaccctgtttaaaaaagaaaaaggccaggcacggtggctcatgcctgtaatcccagctacgcaggaggccaaggcaggagaatcacttgaacctgggaggtggtggttgcagtgagctgagattgtgtcattgcactccagcctgggcaacaagagcaaaactctgtctc

SEQ ID NO: 22949 - DNA, 3099 bp, Homo sapiens
gcttcccggaagtggcggcgcggtcagggctggccttggcttcagctgcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagatgaggaaactgaggaaccagagaggttaaattagttgcccagtgtcacacagccagtaagtggcaggaccaggattccagccagcttgaaggtttatctatactgttcacctgtgactaaggagttgttgttaacgagcccgaaatacagattttggaagaaacgaattagcagtcacaacagcagggttgttcctgttgtctctggcattcagcttgaagttactacaggtcagcccggccagcagtcaggaaggaaagctggaagagaagtggaggggaacagagacaaactggaaggcagaatggcccactaggacagaccgaaacccacttctgtctctcacttcctctggcctcaatagtgctggtctcccgctttggctctgaagcacatgcacctgccccaggactcggaggagctgcacacgggcacccagcagaagctgatgttgctgcggccctgccccagactctgagttaagccagaagatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaaaaaagccaggcatggtggtgggctactctggaggcccttgaggaccacttgagcccaggagattgaggctgcagtgagccatgactgtgccactgcacctctagtctgggtgacagagcaagaccctgtttaaaaaagaaaaaggccaggcacggtggctcatgcctgtaatcccagctacgcaggaggccaaggcaggagaatcacttgaacctgggaggtggtggttgcagtgagctgagattgtgtcattgcactccagcctgggcaacaagagcaaaactctgtctc

SEQ ID NO: 22950 - DNA, 2551 bp, Homo sapiens
gcttcccggaagtggcggcgcggtcagggctggccttggcttcagctgcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagatatctattgaaatcgagactcctacccagatatctttagtggatgaagcatcaggagaggtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaaaaaagccaggcatggtggtgggctactctggaggcccttgaggaccacttgagcccaggagattgaggctgcagtgagccatgactgtgccactgcacctctagtctgggtgacagagcaagaccctgtttaaaaaagaaaaaggccaggcacggtggctcatgcctgtaatcccagctacgcaggaggccaaggcaggagaatcacttgaacctgggaggtggtggttgcagtgagctgagattgtgtcattgcactccagcctgggcaacaagagcaaaactctgtctc

SEQ ID NO: 22951 - DNA, 1467 bp, Homo sapiens
cgtcgacggagatgtgagttgattctccatcagagtcactgaaaagctttggtgactgagatccccctgccactgtggaggaagggaagttttccaaactctcatctgtgatttcatcatttcttttaaagaatacttcccactggggtacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaaaaaagccaggcatggtggtgggctactctggaggcccttgaggaccacttgagcccaggagattgaggctgcagtgagccatgactgtgccactgcacctctagtctgggtgacagagcaagaccctgtttaaaaaagaaaaaggccaggcacggtggctcatgcctgtaatcccagctacgcaggaggccaaggcaggagaatcacttgaacctgggaggtggtggttgcagtgagctgagattgtgtcattgcactccagcctgggcaacaagagcaaaactctgtctc

SEQ ID NO: 22952 - DNA, 920 bp, Homo sapiens
gcatatgctttggtgtcatatctaagaaactatttgatccaagatcatgaaaattgactcccatgttacataattttacagtcagttttgactgtatcttcctgcttcttgaatttctgataatttgtttttgaatgccatacattctgaattttacctttttaggtcctgcataattttgggatttctaaaaacattcttgagctttgttctggcatgtggttagcatgtttatagtttgatcttttcgtgtcttttacctttgttatgcaggaacagagtagcatttagtatatggttaattttccccactactgaggcaaggctcttcttggttcttttacaaatgcccatggatcatgaggttttccactctggctgttgggaccaggacaagacactgttcctggcacggtgagttctgggcactttctttccttttgtttgagtgattcgttgcctggctgcaggtagtttccttacaagcacatgctgcttagtgcactgaacacgtggtggggacgcctctgcagcttttcagagtttctgtgcagcactctcctctctggtcttctgctctgtaaactccaggtacatttatttcttcaatgttccacttccacctcacatcaaggatgtccatgggctctatccagatgttccctccctgactggaatctgttatgaagcagggagtcaggcaatcataggactcatctgtgtcttatttctcatgtcattgtccttaattgctcgatgtccattttcttgagagatagtttctgatttttcgttatttcaagtgggaggttaaatctagtccgttactccatcttacctggaagcaaaagtcctttcttcctttaatcttttgtgccttttatgcatctacccaatccacactcctttttgataaatgt

SEQ ID NO: 22953 - DNA, 2637 bp, Homo sapiens
gcttcccggaagtggcggcgcggtcagggctggccttggcttcagctgcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagcttgaaggtttatctatactgttcacctgtgactaaggagttgttgttaacgagcccgaaatacagattttggaagaaacgaattatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaaaaaagccaggcatggtggtgggctactctggaggcccttgaggaccacttgagcccaggagattgaggctgcagtgagccatgactgtgccactgcacctctagtctgggtgacagagcaagaccctgtttaaaaaagaaaaaggccaggcacggtggctcatgcctgtaatcccagctacgcaggaggccaaggcaggagaatcacttgaacctgggaggtggtggttgcagtgagctgagattgtgtcattgcactccagcctgggcaacaagagcaaaactctgtctc

SEQ ID NO: 22954 - DNA, 2777 bp, Homo sapiens
gcttcccggaagtggcggcgcggtcagggctggccttggcttcagctgcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagatgaggaaactgaggaaccagagaggttaaattagttgcccagtgtcacacagccagtaagtggcaggaccaggattccagccagcttgaaggtttatctatactgttcacctgtgactaaggagttgttgttaacgagcccgaaatacagattttggaagaaacgaattatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaaaaaagccaggcatggtggtgggctactctggaggcccttgaggaccacttgagcccaggagattgaggctgcagtgagccatgactgtgccactgcacctctagtctgggtgacagagcaagaccctgtttaaaaaagaaaaaggccaggcacggtggctcatgcctgtaatcccagctacgcaggaggccaaggcaggagaatcacttgaacctgggaggtggtggttgcagtgagctgagattgtgtcattgcactccagcctgggcaacaagagcaaaactctgtctc

SEQ ID NO: 22955 - DNA, 2904 bp, Homo sapiens
gcttcccggaagtggcggcgcggtcagggctggccttggcttcagctgcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagatgaggaaactgaggaaccagagaggttaaattagttgcccagtgtcacacagccagtaagtggcaggaccaggattccagccagcttgaaggtttatctatactgttcacctgtgactaaggagttgttgttaacgagcccgaaatacagattttggaagaaacgaatttgctggtctcccgctttggctctgaagcacatgcacctgccccaggactcggaggagctgcacacgggcacccagcagaagctgatgttgctgcggccctgccccagactctgagttaagccagaagatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcagaggaggaagatgactatctctttgatgatcctctgccaatacctttaaggcacaaagttccatacccggaaacttttcaccctgaggtattttcaatgactgcagtatcagaaaagcagcctgaaaaactgagacaaaccccaggatgctgcagagcagagtgtatgcagagctctcgtttcacaaactttgtagattgtgaagaatccaacagtgaaagtgaagaagaagtaggaatcccagcttcactgcaaggagatctgggctctgtacttcacctgcaaaaggctgatggggatgtaccccagtgggaagtattctttaaaagaaatgatgaaatcacagatgagagtttggaaaacttcccttcctccacagtggcagggggatctcagtcaccaaagcttttcagtgactctgatggagaatcaactcacatctcctcccagaattcttcccagtcaacacacataacagaacaaggaagtcaaggctgggacagccaatctgatactgttttgttatcttcccaagagagaaacagtggggatattacttccttggacaaagctgactacagaccaacaatcaaagagaatattcctgcctctctcatggaacaaaatgtaatttgcccaaaggatacttactctgatttgaaaagcagagataaagatgtgacaatagttcctagtactggagaaccaactactctaagcagtgagacacatatacccgaggaaaaaagtttgctaaatcttagcacaaatgcagattcccagagctcttctgattttgaagttccctcaactccagaagctgagttacctaaacgagagcatttacaatatttatatgagaagctggcaactggtgagagtatagcagtcaaaaaaagaaaatgctcactcttagatacctaagaattcaaagcgtttcaacctagagcaaccactaaaaaacctgcacagagatgacagtcaatattacaatagagaaaatacagtacttaaaaatgttcaaataacctggttgggtgtggtggctcacacttgtaatcccagcactttgaggtgggcaatggcttgagcccaggagttcgacaccagcctggccaacacagtgaaatgtgtctctacttacaaaaaaaaaaaaaaaaaaaaagccaggcatggtggtgggctactctggaggcccttgaggaccacttgagcccaggagattgaggctgcagtgagccatgactgtgccactgcacctctagtctgggtgacagagcaagaccctgtttaaaaaagaaaaaggccaggcacggtggctcatgcctgtaatcccagctacgcaggaggccaaggcaggagaatcacttgaacctgggaggtggtggttgcagtgagctgagattgtgtcattgcactccagcctgggcaacaagagcaaaactctgtctc

SEQ ID NO: 22956 - DNA, 1344 bp, Homo sapiens
gcttcccggaagtggcggcgcggtcagggctggccttggcttcagctgcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagcttgaaggtttatctatactgttcacctgtgactaaggagttgttgttaacgagcccgaaatacagattttggaagaaacgaattatatctattgaaatcgagactcctacccagatatctttagtggatgaagcatcaggagagaaggaagagattgttgtgactctcttaccagctggtcactgtccgggatcagttatgtttttatttcagggcaataatggaactgtcctgtacacaggagacttcagattggcgcaaggagaagctgctagaatggagcttctgcactccgggggcagagtcaaagacatccaaagtgtatatttggatactacgttctgtgatccaagattttaccaaattccaagtcgggaggagtgtttaagtggagtcttagagctggtccgaagctggatcactcggagcccgtaccatgttgtgtggctgaactgcaaagcggcttatggctatgaatatctgttcaccaaccttagtgaagaattaggagtccaggttcatgtgaataagctagacatgtttaggaacatgcctgagatccttcatcatctcacaacagaccgcaacactcagatccatgcatgccggcatcccaaggcagaggaatattttcagtggagcaaattaccctgtggaattacttccagaaatagaattccactccacataatcagcattaagccatccaccatgtggtttggagaaaggagcagaaaaacaaatgtaattgtgaggactggagagagttcatacagagcttgtttttcttttcactcctcctacagtgagattaaagatttcttgagctacctctgtcctgtgaacgcatatccaaatgtcattccagttggcacaactatggataaagttgtcgaaatcttaaagcctttatgccggtcttcccaaagtacggagccaaagtataaaccactgggaaaactgaagagagctagaacagttcaccgagactcaggtaagaaaaatggtcctgggttcagaggggtgggctccctgcaaacactgctttccagggagcttgggtctgggagaagtggccttgggcagagtggacctgg

SEQ ID NO: 22957 - DNA, 746 bp, Homo sapiens
gcttcccggaagtggcggcgcggtcagggctggccttggcttcagctgcggttttggggtcccggactctgggatcggcggcgctatgagttctttcgaggggcagatggccgagtatccaactatctccatagaccgcttcgatagggagaacctgagggcccgcgcctacttcctgtcccactgccacaaagatcacatgaaaggattaagagcccctaccttgaaaagaaggttggagtgcagatgaggaaactgaggaaccagagaggttaaattagttgcccagtgtcacacagccagtaagtggcaggaccaggattccagccaggtctgtctgattgcagagcctatgtatcagtcatctgctgctgcgtaacaaattacttcaaaatggagtgacttaacactgatcatgtcttattgctcagtttctgtggatcagggattgacagggtagaatgggaaaactcacacagctaggggctagaaccatttggcatgtttttttgtttgtttgtttgtttgtttgtttgaagcagagtcgaactctgctgcccaggcaggagtgcagtggcgtgatgttggctcactgcaatctctgcctcccaggttcaagcgattctccctgctcgggaggctgaggcgggagaatcgcttgaacctgggaagtggagtttgcagtgagacgagatcacaccattgcgctccagcctgggtaacagagcaagactccatctcaaaaa

SEQ ID NO: 22958 - DNA, 553 bp, Homo sapiens
caccttttggctagtatgaagaatgctgctgtgaacagtcaggcacacatttttgtgtggccatcggttttcgcttatcttggttctataactagtggtgaaattgctcagtcccatgggaattctgtttgttgagtggacaaggattccacttgtttctaggatttggagtgtgaggaaattgggagaaaaggcacattgttaaaaggtacataaatgtgttctgtgaaggagggctttgttgagctaggtcctaatgataactgctttccattactattttttctttattttctttttagaaggaagagattgttgtgactctcttaccagctggtcactgtccgggatcagttatgtaagggggtcatttattttgtcattttattatatgtagacacatattgtatttgtagaaataaatttttagggtctaaaattaatagggggctgggtgcagtggcacatgtctgtaatcccagtgctttgggaggctgacgcgggaggattgcttgagcttgggagttggaggctgcagtgagtttttttttta

SEQ ID NO: 22959 - DNA, 393 bp, Homo sapiens
gtgtatgtgcatgcgtgtgtgagtatgcacacatagtgtgtgcacgtgtgtttgtgtgcatgatatcatccacctccacatctgacctttgattgagaaggggatttgtcctccctctgcagagcagtcacaacagcagggttgttcctgttgtctctggcattcagcttgaagttactacaggtcagcccggccagcagtcaggaaggaaagctggaagagaagtggaggggaacagagacaaactggaaggcagaatggcccactaggacagaccgaaacccacttctgtctctcacttcctctggcctcaatagtgctggtctcccgctttggctctgaagcacatgcacctgccccaggactcggaggagctgcacacgggcacccagc

SEQ ID NO: 22960 - DNA, 2622 bp, Homo sapiens
acccggggctcccacatttcagcaggtgccggagctggagctcccaccgccgccgcccgtgcctccggctgccggcgcccctgcctttggctcttcctccccactcgcccgctccccctggcggagccggcgcgcccggggtgccgctccctgcctggcgcgctccgcacctggaggtgccttgcccctctcctgcccacctcggaatttccctgtggctcctttgatccttcgagtctccagctcctctcccttccacctgtttcccccaagaaaggcaggatcctggtccctgctacgtttctggggccatggctggtctgggccccggcgtaggcgattcagaggggggaccccggcccctgttttgcagaaagggggctctgaggcagaaggtggtccacgaagtcaagagccacaagttcaccgctcgcttcttcaagcagcccaccttctgcagccactgcaccgacttcatctggggtatcggaaagcagggcctgcaatgtcaagtctgcagctttgtggttcatcgacgatgccacgaatttgtgaccttcgagtgtccaggcgctgggaagggcccccagacggacgacccccggaacaaacacaagttccgcctgcatagctacagcagccccaccttctgcgaccactgtggctccctcctctacgggcttgtgcaccagggcatgaaatgttcttgctgcgagatgaacgtgcaccggcgctgtgtgcgtagcgtgccctccctgtgcggtgtggaccacaccgagcgccgcgggcgcctgcagctggagatccgggctcccacagcagatgagatccacgtaactgttggcgaggcccgtaacctaattcctatggaccccaatggtctctctgatccctatgtgaaactgaagctcatcccagaccctcggaacctgacgaaacagaagacccgaacggtgaaagccacgctaaaccctgtgtggaatgagacctttgtgttcaacctgaagccaggggatgtggagcgccggctcagcgtggaggtgtgggactgggaccggacctcccgcaacgacttcatgggggccatgtcctttggcgtctcggagctgctcaaggcgcccgtggatggctggtacaagttactgaaccaggaggagggcgagtattacaatgtgccggtggccgatgctgacaactgcagcctcctccagaagtttgaggcttgtaactaccccctggaattgtatgagcgggtgcggatgggcccctcttcctctcccatcccctccccttcccctagtcccaccgaccccaagcgctgcttcttcggggcgagtccaggacgcctgcacatctccgacttcagcttcctcatggttctaggaaaaggcagttttgggaaggtgatgctggccgagcgcaggggctctgatgagctctacgccatcaagatcttgaaaaaggacgtgatcgtccaggacgacgatgtggactgcacgctggtggagaaacgtgtgctggcgctggggggccggggtcctggcggccggccccacttcctcacccagctccactccaccttccagaccccggaccgcctgtatttcgtgatggagtacgtcaccgggggagacttgatgtaccacattcaacagctgggcaagtttaaggagccccatgcagcgttctacgcggcagaaatcgctatcggcctcttcttccttcacaatcagggcatcatctacagggacctgaagctggacaatgtgatgctggatgctgagggacacatcaagatcactgactttggcatgtgtaaggagaacgtcttccccgggacgacaacccgcaccttctgcgggaccccggactacatagccccggagatcattgcctaccagccctatgggaagtctgtcgattggtggtcctttggagttctgctgtatgagatgttggcaggacagcctcccttcgatggggaggacgaggaggagctgtttcaggccatcatggaacaaactgtcacctaccccaagtcgctttcccgggaagccgtggccatctgcaaggggttcctgaccaagcacccagggaagcgcctgggctcagggcctgatggggaacctaccatccgtgcacatggctttttccgctggattgactgggagcggctggaacgattggagatcccgcctcctttcagaccccgcccgtgtggccgcagcggcgagaactttgacaagttcttcacgcgggcggcgccagcgctgacccctccagaccgcctagtcctggccagcatcgaccaggccgatttccagggcttcacctacgtgaaccccgacttcgtgcacccggatgcccgcagccccaccagcccagtgcctgtgcccgtcatgtaatctcacccgccgccactaggtgtccccaacgtcccctccgccgtgccggcggcagccccacttcacccccaacttcaccaccccctgtcccattctagatcctgcaccccagcattccagctctgcccccgcgggttctagacgcccctcccaagcgttcctggccttctgaactccatacagcctctacagccgtcccgcgttcaagacttgagcg

SEQ ID NO: 22961 - DNA, 310 bp, Homo sapiens
gacgtccccacccaccccgtcctccaggttctacgcggcagaaatcgctatcggcctcttcttccttcacaatcagggcatcatctacagggacctgaagctggacaatgtgatgctggatgctgagggacacatcaagatcactgactttggcatgtgtaaggagaacgtcttccccgggacgacaacccgcaccttctgcgggaccccggactacatagccccggagatcatttgcctaccacccttatgggaattctgtcgtttggtgctcctcagaagtttcgctgaataagatgtgggttagaca

SEQ ID NO: 22962 - DNA, 432 bp, Homo sapiens
actgggctattcttttgtaagcagggaatgagatactggttattaaagattttggtaaagtgtaagttactgtaaggcatgattcaggactgcgtcccacaagtccccggaccaggagccagttcggattgtcttgtgggatgtaccaagtttccctggtttacagaggctttttgcctctctgaagcctgagctggccagatggagagctctgtggaaaacttccagcagtgtgtgttgggccaagcactcgaggtgtgaagaaatgtaaaactttcaagtgataatatctagcatcgtgtatgcagccttgaaaaatgacccaacctttgtagaaattctctgttatcactaaccctcttccataatgagcggaggatttcccaagaattgggattctgataagagtcctgcaaaagttgaaaagttttc

SEQ ID NO: 22963 - DNA, 538 bp, Homo sapiens
ctgttaactgacgctgcaggcccagcaactgctccagtctctgcttccacgagattgtcaaattgggcagcagttgggaaatcaatggatatcttcccagtataaatcccaaaatgttcctgaaatggggttacttctgtcccaattgagacagacgtttcaaattccaaataagaggtagtagggtacaacagcacagaaggtactttaaggaagcttgagtcctcagatgcagaagaatttttttccaaactggaatcagaatccagaaaaggctgataggaaataccaacaatgttgacattcccagtttcaatgggcacaggagaaccctcattcattaaatcaggaatatccaacttgctcagcatcccaactccagaaacaaagaatccctataagtttactaaagacaatgacaatttctccatgttggtcaggctggtctcaaactctcgacctcaggtgatctgcctgcctcggcctcccaaagtgctgagattagaggtatgagtcaccgcgcctgggctaaattata

SEQ ID NO: 22964 - DNA, 477 bp, Homo sapiens
gtaagatgaggatttcttttccaatttcagcacagaaggtactttaaggaagcttgagtcctcagatgcagaagaatttttttccaaactggaatcagaatccagaaaaggtgaatttactttcatgctgccagtttcttggaatttaggggaaatattagttaagctgagttccgccatttctgagtgaccagaaatctttttagtcccacaaatatccaaagattgatgaaacacacaagtgtgagcttcacaattctgcgccatttgcctactgattttttcatcatgaataggtggtaaaatccaagatatattacttttaagaagagcaggaggagagcctaaggcatctacctctggttctggcttatcttcatatttggaggcagcaggagaaagctcagcttggcaattctctttaaggccagcatctgaacatttctctcctatctcattatgattaattgattgaaa

SEQ ID NO: 22965 - DNA, 648 bp, Homo sapiens
ctgttaactgacgctgcaggcccagcaactgctccagtctctgcttccacgagattgtcaaattgggcagcagttgggaaatcaatggatatcttcccagtataaatcccaaaatgttcctgaaatggggttacttctgtcccaattgagacagacgtttcaaattccaaataagaggtagtagggtacaacagcacagaaggtactttaaggaagcttgagtcctcagatgcagaagaatttttttccaaactggaatcagaatccagaaaaggctgataggaaataccaacaatgttgacattcccagtttcaatgggcacaggagaaccctcattcattaaatcaggaatatccaacttgctcagcatcccaactccagaaacaaagaatccctataagtttactaaagacaatgacaatttctccatgttggtcaggctggtctcaaactctcgacctcaggtgatctgcctgcctcggcctcccaaagtgctgagattagagggttttctataaacatactgcctaagactgtaaatgaaaacgagacagcaccttgaggacaaaatgcacttcagtcaaaatgaacgtttttggatctgattttacaactatgtaaattaaaaaggttcagaccagctgata

SEQ ID NO: 22966 - DNA, 468 bp, Homo sapiens
tttaatcaaaatgggaaatgttttgtcacataataattgatcatgagtctgatgacaagtggttctgggcatctatcaaatgaacattaatacataatacattttttaagtcaccagataaaggtctttatattacaatttctacattttcagatttgtttatctttgtgttctctcagggaatttgcaccatttgtttatcattttgtgtcaaaatatccgtactggcattctaggccttgtggggataagagacatacaaggaagggccctggctccagagcttccagccactgctctgtctttgccatatgggtctagtactactcgctactactctctagggtttccatgtagaatgcttcaatatttcaatctaatggcagacctttcttccaacctaaacaatttccagacatacagtcttagccagccaaatgtcatcttttctgaataggtcagtgtgca

SEQ ID NO: 22967 - DNA, 1297 bp, Homo sapiens
tagattccagacattgtatagaagaacatttggaaactcactgccttgttttgtttctctctgaccaccagtgcatgcagcccctgtcatgtaccgcctgtttgctcaaatcaatcatgaccctttcatgtgaaatctttagtgttgtgagcccttaaaagggacagaaattgtgcattcaaggagcttggattttaaggcagcagcttgctgatgccaccagctgaaaaaagcccttccttctccaactcggtgtctgagaagttttgtctgcagctcatcctgctacagaatgaactccttgtaattctacaagatatgccatgggccttttcacaggggacacaggcttcttaaaacaacccggcttcctcaccctatgtcctttatttacaaagctgtgctcctattcatgagcatggaatgtttttccatttgtttgtgacatctcttatttctttcaggggtatcttgtaattctcattatatatatcttttgcttccttggttagctgtatttttaggtattttagtcttcttgtggcaattgtgaatgggattgcattcctgatttggctcttggcttgaatgttattaacgccacattttttaaatagacaaaaatatgagattaaaaatgttgaattttactaacaataaaagttgttcaaaggaaaactataaggttcttgtttcaactctgtcataggaagaacaggacagtgagctggcacagagttagggaaattgactgtgtctcatattggctagtgagagtgatctgttggaattgtatatcaaaattttaatgtacatacattttgtctagcaattctactattgggtatttatatagtacatataaatataaatgtatatgtttagtaaatatatacttatagttagtaaatatattttatatctatttagtaaatatactaaatgtcaggcctctgagcccaagctaagccatcatatcccctgtgacctgcatgtacatacgtccagatggcctgaagcaagtgaagaatcacaaaagaagtgaaaatggcctgttcctgccttaactgatgacattaccttgtgaaattccttctcctggctcatcctggctcaaaagctcccccactaagcaacttgtgacacccacctctgcccgccagagaacaaccccctttgactgtaattttcctttaccaacccaaatcctgtaaaatggtcccaaccctatctcccttcactgactgtcttttcggactcagccagcctgcacccaggtgattaaaaagctttattg

SEQ ID NO: 22968 - DNA, 410 bp, Homo sapiens
atccgtattaaagaccatgtgagatgtaggtattatcacttgcaatttattttatgaaaatgaggctcaaagaggtttgtgacttgtccaaagctcaagcctgttctttttccatgagactgccttcatttgcattatctcctaagatcttcacaaggatcctaagagacaggtcaagcaggttttatcattattaccacttaagattgcagaaaacaaactcagactcccttcttgcgaataatcacgtagctagtgttcagaacatacctgctctgttccaggtatctcactaggcatttgagaggtattatttatttctaccactaccctgtgaggtaggtactgttatcctgttatattccataataaattggaagagttggagtttgaaactaaactgtaaatta

SEQ ID NO: 22969 - DNA, 1860 bp, Homo sapiens
  misc_feature (150)..(150): n is a, c, g, or t
  misc_feature (152)..(152): n is a, c, g, or t
  misc_feature (155)..(155): n is a, c, g, or t
  misc_feature (181)..(181): n is a, c, g, or t
  misc_feature (212)..(212): n is a, c, g, or t
  misc_feature (230)..(230): n is a, c, g, or t
  misc_feature (277)..(277): n is a, c, g, or t
  misc_feature (303)..(303): n is a, c, g, or t
  misc_feature (323)..(323): n is a, c, g, or t
  misc_feature (713)..(713): n is a, c, g, or t
  misc_feature (732)..(732): n is a, c, g, or t
  misc_feature (928)..(928): n is a, c, g, or t
  misc_feature (1153)..(1153): n is a, c, g, or t
  misc_feature (1241)..(1241): n is a, c, g, or t
  misc_feature (1435)..(1435): n is a, c, g, or t
  misc_feature (1495)..(1495): n is a, c, g, or t
  misc_feature (1523)..(1523): n is a, c, g, or t
  misc_feature (1547)..(1547): n is a, c, g, or t
  misc_feature (1677)..(1677): n is a, c, g, or t
  misc_feature (1682)..(1682): n is a, c, g, or t
gacatcacggacagggcgacttctatgtagatgaggcagcgcagaggctgctgcttcgccacttgctgcttcaccacgaaggagttcccgtgccctgggagcgggttcaggaccgctgatcggaagacacagagcacagccaagacctgnanagngccctcatccggctggaggaggagcngcagaggagtgccagcctggcccaggtgaangccatgctccgagaacanctggaccaggcaggctcggccaaccaggctctgagtgaggacatacnaaaggtgaccaatgactggacacgcngccgcaaggagctggagcancgggaggcggcgtggaggcgcgaggaggagggacctgctgcagctgggaggggagctggcccggacatcacgagctgtccaggaggcgggcctgggactgagcacgggcctacggctggcagagagccgggccgaggcagccctggagaaacaggccctgctgcaggcccagctggaggagcagctgcgggacaaggtgctccgcgagaaggacctggcgcagcagcagatgcaaagcgacctggacaaggctgacctcagtgccagagtgacagagctgggcctggcagtgaagcgtcttgagaagcagaatctggagaaggatcaggtcaacaaggacctcactgagaagcttgaggccctggaatccctgcggctacaggagcaggnggccctggagacagagganggagaggggctacagcagaccctaagggacctggcacaggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcncctccccggcctgctcagactcctccacgctcgccctgatccactccgccctgcacaagcgccagctgcaggtccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgagnacgcccagcgcgaggtgcagcggctgcggagcgccaacgagctcctgagcaggctggggcacaattggtccatcacagctcactgtancctggaactcccagactcaagcgatcctcccacctctacctcccaactgcccctagttgggggcctgggcctggcctggggaaggatatgggaccgaagcctgagagttaggtttccactcccttcctctgtgccctcaccaccctctgagccctcacctccctgggttcctgggcaactctgatctcagcctngaggatagtagacaagccgccaacatttctaaattttttgtagagatgggggtctcactntgttgcccatgctggtcttgaactcctngcttcaatcactcctcccacctcngcctcccaaattgctgggattacaggcataagccactgtgcctggctctattaaaatttaattaaaatttttaaaaagtgaaaattcaggctgggtgtggtggctcacacccagcttgctggctaacacngtganacccccatctctactaaaaatacaacaaattacccggacatggtggcgggcgcctgtattcccagctacttgggaggctgaggcaggagaatggcgtgaacccgggaggcggagcttgcagtgagtggagattgcgccactgcactccagcctgggggacagagcgagactccgtctc

SEQ ID NO: 22970 - DNA, 1296 bp, Homo sapiens
  misc_feature (364)..(364): n is a, c, g, or t
  misc_feature (589)..(589): n is a, c, g, or t
  misc_feature (677)..(677): n is a, c, g, or t
  misc_feature (871)..(871): n is a, c, g, or t
  misc_feature (931)..(931): n is a, c, g, or t
  misc_feature (959)..(959): n is a, c, g, or t
  misc_feature (983)..(983): n is a, c, g, or t
  misc_feature (1113)..(1113): n is a, c, g, or t
  misc_feature (1118)..(1118): n is a, c, g, or t
aggccaaatgatgtcttcccaataaatgggaggcctcagcggcgagccgaggactgagctagtggaggaggtgaaatcaggaaggcttcttgtaagaggcagcatttggaatgaggcagcccccagcctcgcctgggcgtctttgcccagctaaccccgcggttcctaagtcagcagcctccttctgcctccctcccccaccctcaggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcncctccccggcctgctcagactcctccacgctcgccctgatccactccgccctgcacaagcgccagctgcaggtccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgagnacgcccagcgcgaggtgcagcggctgcggagcgccaacgagctcctgagcaggctggggcacaattggtccatcacagctcactgtancctggaactcccagactcaagcgatcctcccacctctacctcccaactgcccctagttgggggcctgggcctggcctggggaaggatatgggaccgaagcctgagagttaggtttccactcccttcctctgtgccctcaccaccctctgagccctcacctccctgggttcctgggcaactctgatctcagcctngaggatagtagacaagccgccaacatttctaaattttttgtagagatgggggtctcactntgttgcccatgctggtcttgaactcctngcttcaatcactcctcccacctcngcctcccaaattgctgggattacaggcataagccactgtgcctggctctattaaaatttaattaaaatttttaaaaagtgaaaattcaggctgggtgtggtggctcacacccagcttgctggctaacacngtganacccccatctctactaaaaatacaacaaattacccggacatggtggcgggcgcctgtattcccagctacttgggaggctgaggcaggagaatggcgtgaacccgggaggcggagcttgcagtgagtggagattgcgccactgcactccagcctgggggacagagcgagactccgtctc

SEQ ID NO: 22971 - DNA, 415 bp, Homo sapiens
aaaggaagcttgtattaatcaataaaatatccagaaacaatgtctgtgaaacaagtgcttttatccacatttggcaaaagagccaataataaaaacaccaatctataagcaacagctaaaaagaaaagcagctgatttaatttctcactctattgttcaaattagcattttaaaccattgcaccttaattaaagccactcttttaggtacaataatcacaggcaaagcaactactatgtagggtaactataaatgatcaaaacaggacacttttgaaaatgaatggagcactattaataattatgccagggcaatatgcataatctaagcaaaccagccattccactactaataacctcctagatgctgagcttttaaacttacaaggtgttaccaatcccatgaagttcccccc

SEQ ID NO: 22972 - DNA, 375 bp, Homo sapiens
ggtcggtaacttgagcatcctctcgctcctggaatcttggtgcgaggtacggataatgtttagttcaaaacaaaataagtggccgggtgcggtggctcaaacctgtaatcctcgtgctttgagaggccgaggtgggcagatcatttgaggtcaggagttcgcgatcagcctggtcagcatggtcaaaccccgtctctactaaaaacacaaaaattagccaggcgtggtggcacgcgcctgtagtcccagctactcgggaggctgaggcaggagaatcgcttgaatccgggaggtgaggttgcagtgagccgagatggtgccactgcactgtagcctggccgacagagcaagactgttgtctcaaaacaaaaaaaa

SEQ ID NO: 22973 - DNA, 508 bp, Homo sapiens
agcccgcctagggaccgcaccgtcctctgcactttcacagtgaagcctgtgtctctctccgagaagtgtcacgtgtgtcgtgggaatcacgggaattgcttccttaattctcctttcttaatgagggcttgggacagcgctgcctgtttcacatgggacgagcagctggtggtttctggctggcgtgggaccagcgcttcggctgtgtcatcacatctggtggcctgtccagctgggtgtcattgtctcttgtctcttggctgaggcaactgtgatgccatgggggtcacgcttgtgtcagggccaacccagttcttcccatgcacacctctcctgctggagtgcttttccttatgatgacgtgttggatcagtgtggagaatgcagagaggctctgggcctctccttcccatacctactccctggagccgcgatacccggcaagggagcccgtagccagaggctcctttaaatttcattagaataaagatttgattacacagctaaa

SEQ ID NO: 22974 - DNA, 316 bp, Homo sapiens
cttggaattaatttctagaaatggaattatttactcaaaggagatgaacatttttaagtctctggatacacctaatcatattgctttagttataccaatttgcatggcatgtacaggaatgcgtatgggagtgatagcagttgcattatcatttaaaaatctgttaatatggtggttgaaaagttacatcttgttattcatttgatttacctttctttaatgattgaggttaaattatttttcctatgtttattagatagttatagttcttcttttgtgcatgtctgttcaaaaagaacttatttatttgaaaaaa

SEQ ID NO: 22975 - DNA, 600 bp, Homo sapiens
gcccttcttctagagccatggccaagagggagatgaggacatggaaagtagagcgagactcaccaaaaggccacctgcattgaagaaggggagagatgatgatcatggtgggcagtattaagggctggttcatgtacagaaatctccagccttttctaaaagcaattgaagtgccacttccttctccctgcgctggctgcctcctggagtccttccttggacatcagctataagggcctctccagcacaaagcttagggctctatccacaggaaagtaatgctacccacaaaccatccctcagcaacagtctcagcccggaggaacccagaggcagccatagcctttcttttgttccgatgaactagtttgcactacaaatgcagatggggaaacaggaaaagcaaggcttccaaagtctactgacataagaacctggaatcctacccatagtctctgttctgtcctctccctaaagtatatctctctctcaagggagtcatttgaaaatggagaaagtcccccagaataccccaggcctataacgatcacagccacggatggggacaatctgccttctgaaggaagcaggcaaagccct

SEQ ID NO: 22976 - DNA, 391 bp, Homo sapiens
ggactgttcttttagctcttgactaggtcgttttggatctggactttcccaggtcattttggatctggactttcccactgggtgttggtaacaacctcccttcaccctcaacaagggccatgttgggtaggggtgggactggattattttaaagaaaataccattcatttagaacatctgttagttgagggtagaatttatttattttttatttatttatttatttattttttgagacggagttctctgttctgtcctctccctaaagtatatctctctctcaagggagtcatttgaaaatggagaaagtcccccagaataccccaggcctataacgatcacagccacggatggggacaatctgccttctgaaggaagcaggcaaagccct

SEQ ID NO: 22977 - DNA, 435 bp, Homo sapiens
tctcagatgagaacctaacatctagttagtaaaaatctactcatagctcatattctttatttttctttctgtagcagcttctgcacttctattctatctaagactgcagaatttgtccaacttgacattcagattctgcttcaatttccatttggtgctactagcattgtagcttttaaatatttgatgactttctgaaaacaggcagttttcctagccatgtttgatgttttgagaaacacagaacttgacaaaaagtcaatccaattcatatatgcctcttatttaggaaatacaagcttattcaaagacacaaattagctttgctgttaaaagcattctgtttgaagagtttgaagtttaactggtggcaaacttccaccaatgtttccagattaatttttttaaatctccaaggcaatatgtttctccatg

SEQ ID NO: 22978 - DNA, 335 bp, Homo sapiens
  misc_feature (1)..(1): n is a, c, g, or t
ngttcggatatctagcaggtttgcctctcaatccataaacctgggtctctagtgaactgctattccagtctctaattccactgggctggaaattacagattggttgttactggactccaggaggctcccaaagtctcacagaaatccaggagacttaaatgatccaagggcaggaaagaaggctgctcatcccagcctagcagcggatttgctcctcagtcttcagtgtctaagctcagagcagttcctgcaagtctacctccaggcaagggaatctaccgaggtggggcacccctgggggctgtgcctctctaaggcacaccaggtaccctctt

SEQ ID NO: 22979 - DNA, 173 bp, Homo sapiens
acttcagctgtggcagttgcagaaggtcctgctacgtcatcctctctgccgtggtctctcgtgtcagtgttcactgtcagtttgggtggtcaaaatgaattttatctttcatgctttatgtttctaccctttactcaggctatcatacaataaaaagtattgcctgttttaat

SEQ ID NO: 22980 - DNA, 838 bp, Homo sapiens
ctctctctctcttctaacatcaatgcagctcctggtatgtggtcgttctcaggcccaaaggcccattttgcttttggctgcaactctgtaactctgtaacagagaccaagtgcctgcagggagcagatgtttggggcagtatctgctaaggtggctttgctgaaacttgtttctctcattgggtcttggaagtggcgaataggacgttcctatagaaaaactcagaaagagactgtgaaagataatcttaaagaggcactcacgaaacacaagctccttctccgggaaaaagaatcatcacccttgttatcccatgaaaattcatcttctccttttcagctgatatgaggacttgatctgtcctttcctataagtgccatctgtgtttaaatgaggctgttactctaactcaaagcagacttgcaagagtaaaataatcaatcttcatcatattgctgcactttcgacagttaattttctagagtaatttgtcattgtgaggagcataagatttgtctgaatttgtgtcaaaggttattgactgaattgccacctcatcttttcagtcaatctataaatatgggcaagtttgggcagaggctaatggccttctcactaaggggatgagattgtccaagttaggcaactgataagaggtagaaatatctattgtgtcacccatttcttgtggtagcattgacttaaagttaatctcagaaacttcacttaaccttcttaatccttttcttcctgtaaaacaaggctaaaaattgtcataactatattctagtttccacaaaagctaatctaagtcttaaaaattaaaatttttattgtg

SEQ ID NO: 22981 - DNA, 420 bp, Homo sapiens
ccacaaggactcaaatatagaagtacagagtccttctcaggccatatttagtttgctttaacaatatgttatgaaagttttaagagtcatacattcttctttttatattctaaaagtattcaatattagatgatttaaaagccacattttaaaaaattttttgattttttttaagttccggagtacatatgcaggatgtgcaggtaggttacacaggtaaacatgtgtcatggtgttttgctgcacctatcaacccatcacctaggtattaagcccagcatgcattagctttcttccctaatgctctcaccacccctactctcccctgacaggccccagtgtgtgttattcccctccctgtgtccatgtgttctccttgttcgctcccacttataagcgagaacatgcagtgtttggttt

SEQ ID NO: 22982 - DNA, 415 bp, Homo sapiens
agcaccatttattaagcggtgtatcctttcccccagtttatgtttttgtatgctttgtcaaagatcagttagttgtgagtatttggctttatttctgggttccttcctgttctgttctattggtctatgtatctacttttatatcaatatcatgctgttttggttactatagccttgtagtataagttgaactcaggttatgtgatgcctccagatctgtttttttgcttaggattgctttggttatttgggctctttttcagttccacataaaatttaggatttttttttccaattttgtgaaaagcaatgttggtagtttgataggaattgcattgaacatataggttgctttgggccgtatgatcattttcatgatactgattctcccaatccatgagcgtgagatgtattt

SEQ ID NO: 22983 - DNA, 321 bp, Homo sapiens
tgttccttatggtggagtggaaaaaacccagagtccagcacatctggattcttgtctctctctcctaaccaaccgtgtgtgacttgagtagagcacgtgcccctctaagtctcggtgctcttatctgtgagctggggatgatagtgataactccatgggattgttgggaagaatacatgagataaagtttttcaaatgcttgggaccgtgtatgactacaaagtttatcgtcccagcactttgggaagcagaggtaggaggatggcttgagcccagaagtttgaggttacggtgagctttgattgcactgctacagtgtac

SEQ ID NO: 22984 - DNA, 189 bp, Homo sapiens
tttgaagaccaagtcatggagcatgacctcttagttactgaccttttgttatagattaacttctttccttattttcttgtttctgtctcagaccagattgtatctgagataaaagacatcttggctgaggtaaaagaccccttgactattacatccttaacatggaatgttaaatacacctttcccaaa

SEQ ID NO: 22985 - DNA, 189 bp, Homo sapiens
ctgtgccactctgtcccacacccacccccgtgcctactgttggcggagtccttttggagcatatttccacagccatacccccacccccacccccagtctcagtgccccagagcctgctggggaaccagtgggccagggaatggtgacataagccatctcccgtggaggggcaggcccgttttgaatgac

SEQ ID NO: 22986 - DNA, 310 bp, Homo sapiens
aactccaaagtctatactcttcctttatactactccgtttccctattacctgtgaagatgacagaaggaaagatcagggagaaaggggatgacttgagttttgaaattctgataggatcaaatttgagggaagttttagttctctaatacagagcagagtgattctcttgagtcaaggatgtgtgtgggaaagagtaacctagaatgggactaagacccccttcaggtcacctagtagctccttgtagatgggtcgaaggatttgagaaattgaagaaaagtgtttacatgaaagaggaaagtactattt

SEQ ID NO: 22987 - DNA, 408 bp, Homo sapiens
gcactccttaccccctgatggcttgtgagctctgggaagacagaaccacaccttatccctttttgtatttacagtacccaaaagaatgttctaattaatgaattcccactagaccagaaactcttgagtgcatgcagagaaagtagaacactctgtccctgctcctgtgacttgcccggccctgggaagctgacacacacatcctggtcaataagcctgacataccctgaggtcaggccccatctatcatggcctcatcaagcaaacccacagggagccaggattctagtctcgagagagggagcactttctaaaatatcgtaagtcttaaactccatcctccataagaacaacagtctttaggtttccagagaacctaaaatgacatctcacgctataaaatgaagg

SEQ ID NO: 22988 - DNA, 273 bp, Homo sapiens
ggtcgacctcattggaccgtatacttacatgagtgagttttgttgcatgtaaatcatactacaataggccgagcatgagagctcatgcctgtagtcccacttgaaaagatgtttaacatcattagtcattagtgaaatgcaaattaagatcaccgtgagacattactacctgtctgttagactagagaaattacaggtggctcacacttgtaatcccaacacttgagaaggctgagacggcgagatcaattgccctcaggtgttcgagaccag

SEQ ID NO: 22989 - DNA, 196 bp, Homo sapiens
tttaatcactgaatgtattctgagtaactgtgtttctctgtcccatagataacattgttttgcagtttttagcaatgtaaagcaaatactgtcaccattttactggtaatccaagcccttgttaaatgttattccaaggcttaaaataacactggcatttagtgtcgataataaagtacaggttgagtatccctaa

SEQ ID NO: 22990 - DNA, 609 bp, Homo sapiens
caattcaacaagaggatataacaattctaaaaatatatacactcaacaccagagtacacaaacatataaagcatatattattagatctaaaaggagagacatcctgcaatataataagagtagaagtctttaacaccccactttcaacaatgaacagatcaactagatagaaaaccaacaaagaaacattggacttacaatgacatacaccaaatgaacctagcagaaatatacagaagattccgcccaacagctatggaatacacattctcctcaactgcacatgaaacatttttcaggatagatcgtatttcaggccacaaaataagtcttaacaaattgaagaagatagagataatttaagtatttttttaggccacaatggtatagaactagaaatcaatcataacaaaaacttcagtaaccttactaatacatgggaaattaaacaagatgctcccaagtaaccaaaaggccaaagaagaaattaaaaggaaaattaaacctttctttgagacaaatgtacatggaaatacatcatatcaaaccctataagacacaggaaaagctgttcagagaggacagtttataacaaaaaatgcctacatg

SEQ ID NO: 22991 - DNA, 312 bp, Homo sapiens
tagtgttcaagacagcgatatgttggtttttcaagctgtaaacaagtttgatgcacatatgggttcctgtttcccttgcattcaaactctggacccttctgagtatctgtaactgacacattgtagaccacaaatttagatggagggaatgctttctaatactgagtcagctgcctctctgctaccctaattactgtttgataataacattttccagtgggacaaaatgtggaggtgaaagacagtgatattgatgatcctgaccctgtgtaagcctaggctaatgtgtgtgtttgtgtcctagattttaac

SEQ ID NO: 22992 - DNA, 3737 bp, Homo sapiens
ctcgatctgagccacaacttcatatccagctttccgtggagcgacctgcgcaacctgagcgcgctgcagctgctcaaaatgaaccacaaccgcctgggctctctgccccgggacgcactcggtgcgctacccgacctgcgttccctgcgcatcaacaacaaccggctgcgtacgctggcgcctggcaccttcgacgcgcttagcgcgctgtcacacttgcaactctatcacaatcccttccactgcggctgcggccttgtgtggctgcaggcctgggccgcgagcacccgggtgtccttacccgagcccgactccattgcttgtgcctcgcctcccgcgctgcagggggtgccggtgtaccgcctgcccgccctgccctgtgcaccgcccagcgtgcatctgagtgccgagccaccgcttgaagcacccggcaccccactgcgcgcaggactggcgttcgtgttacactgcatcgccgacggccaccctacgcctcgcctgcaatggcaacttcagatccccggtggcaccgtagtcttagagccaccggttctgagcggggaggacgacggggttggggcggaggaaggagagggagaaggagatggggatttgctgacgcagacccaagcccaaacgccgactccagcacccgcttggccggcgcccccagccacaccgcgcttcctggccctcgcaaatggctccctgttggtgcccctcctgagtgccaaggaggcgggcgtctacacttgccgtgcacacaatgagctgggcgccaactctacgtcaatacgcgtggcggtggcagcaaccgggcccccaaaacacgcgcctggcgccgggggagaacccgacggacaggccccgacctctgagcgcaagtccacagccaagggccggggcaacagcgtcctgccttccaaacccgagggcaaaatcaaaggccaaggcctggccaaggtcagcattctcggggagaccgagacggagccggaggaggacacaagtgagggagaggaggccgaagaccagatcctcgcggacccggcggaggagcagcgctgtggcaacggggacccctctcggtacgtttctaaccacgcgttcaaccagagcgcagagctcaagccgcacgtcttcgagctgggcgtcatcgcgctggatgtggcggagcgcgaggcgcgggtgcagctgactccgctggctgcgcgctggggccctgggcccggcggggctggcggagccccgcgacccgggcggcgacccctgcgcctactctatctgtgtccagcggggggcggcgcggcagtgcagtggtcccgcgtagaggaaggcgtcaacgcctactggttccgcggcctgcggccgggtaccaactactccgtgtgcctggcgctggcgggcgaagcctgccacgtgcaagtggtgttttccaccaagaaggagctcccatcgctgctggtcatagtggcagtgagcgtattcctcctggtgctggccacagtgccccttctgggcgccgcctgctgccatctgctggctaaacacccgggcaagccctaccgtctgatcctgcggcctcaggcccctgaccctatggagaagcgcatcgccgcagacttcgacccgcgtgcttcgtacctcgagtccgagaaaagctacccggcaggcggcgaggcgggcggcgaggagccagaggacgtgcagggggagggccttgatgaagacgcggagcagggagacccaagtggggacctgcagagagaggagagcctggcggcctgctcactggtggagtcccagtccaaggccaaccaagaggagttcgaggcgggctctgagtacagcgatcggctgcccctgggcgccgaggcggtcaacatcgcccaggagattaatggcaactacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaaccttgactaccagggacttctattagggagtgggccgatttcaccagtccctgctacccacggctgccattctccctgcgggctgaatccccttccccgccaagcacagtgtttatcttaccccatgcaagactccacccgcagacggtgggcgatatctatgtccctccattcccgtcgcgattatctgcgaaatccaccccgcagcccgccccaccgtgggctctggagccagaggaaacgagcgaagactttggaaacctcgcggtaacgcggtggtttcgggggccagccaaggccagtggagtgctgtggggtcccacctcgacccctcctcctccctttctttctttcctttttttttattttttaattttatttatttatttatttattttttgacggagtcttggtctgtcgccaggctggagtgcagtggcgcgatctcggctcactgcatcttccgcctcccgggttcaagcgattctcctgcctcagcctgcctagtagctgggactacaggcgcgcgccaccacgaccagctaatttcttctatttttagtagagacggggtttcaccatgttggccaggatggtctggatctcttgacctcaggtgatccatctgcctcggcctctcaaagtgctgggattacaggcgtgaggcaccgcgcccggcccctcctccctttcaatccctactcccagaagccgggattcgtggcaacccctagtttttagttccaaagcctcctgccggcagggaaccaaatccttctgtcctcccacccccaccccacttctggccagttggagtccagcccggtgcctggggcgcctttcagctccgcgctcagattttcctgttttcgttgttttcaaagacagcgacatttcgggtctggtgctaacacccccttcccagcctctgggaaaatcgagtgtgtgtgtcggggggtagggagggaatgcgttttctgtcgtctctctcctaacttaaagcgccgcaggaccgcgcgccccttggcggctgagcctgtggacttggtcgcgggccaatttcgttgtccgtgtgttgggctttccggaggtctgtgcgcccaacagcgccgctcccgcggctccacccgacccagaccctagctggaaagcgccggaggcggaggaagctgactgtggcctcccgggccgcggctctctggagggctcgcgccctagttcgcacaaagcctgctcgtgactgtgcgactgtgcgacgggatccggatggagccgagcccctccgtcctcgcgtctcggtcctcgcgtcgccccgccccacccgcccctgcttcggcgggaatcgtgtttgcccggcgtgtagtccctgacaagcgtgccctgtaggagaaaagtctgtgtcctgtgaagtgtgaccgtgtagtgtaggggggcgggcgggggggcggatgggcggggagggagggaaggggaggggcgcggcgcggcgactcggggcggggttcttttttccattttgaaagaaagcgtcggggttggggtggggggagtttcagtcctcgggatcagccctctccgcgaagcgcagcacaagcgcgggcctgggacggagtagccccccggagcccgtgcccttttctaaacgcgtctgtatgcagtcaataaaacaatcgatttg

SEQ ID NO: 22993 - DNA, 394 bp, Homo sapiens
ctttgttggatgcatagtttgcaaataattttcccattctgtagattgtttgtttactctgttgacagtttcttttgctgtgtaaaagctctttagtttaattagttctcacttgtcaatttttggtttttgttgcaattgcttttgaggatatgctgataaattctttgtcaaagctgatgtcaagaatggtgtttcccacgtgtatgagtctgttctcatgctgctaataaagacatacctgagactgaataatttataaaggaaagaggtttaattgactcacagttcagtatggctggggaggcctcaggaaacttacaatcatggtggaaggagaagcaagcacatccttcctcacatggcagcagcaaggaaaattaatgagcaaaag

SEQ ID NO: 22994 - DNA, 6398 bp, Homo sapiens
cgcggacccactgggttgccaagctcgcgccggatgcggagcgcggtgctgccggtggagcttcaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaagatggtgaggtctacagctttgggactcttccctggagaagtggaccagtggagatttgtccaagtagccccattctagaaaatgccctggttgggcaatatgttattactgtggcaacaggaagcttccatagtggagcagtgacagacaatggtgtcgcgtacatgtggggagagaattctgctggccagtgtgcagtagccaaccagcagtatgtgccggaaccaaatcctgtcagcattgctgattctgaggccagccctttgttagcagtcaggattttacagttggcgtgtggcgaggagcacactctggcattgtcaataagcagagagatttgggcatggggtaccggttgtcagttgggtctcattaccactgccttcccagtgacaaagccgcaaaaggtagaacatcttgctgggcgagtggtgcttcaagttgcctgtggtgctttccacagcttagcccttgtacaatgcctcccttcccaggatctgaagccagtcccagaacgatgcaaccagtgcagccagctcttgattactatgactgacaaagaagaccatgtgattatatcagacagtcattgttgcccattaggtgtgacactgacagaatctcaggcagaaaaccatgccagcactgctctcagcccctccactgaaacccttgacaggcaggaagaagtatttgagaacactcttgtagcaaatgatcagtctgttgctactgaactgaatgcagtaagtgctcagatcacaagcagcgatgccatgtcctctcaacaaaatgtcatgggaacaactgaaatttcctctgccagaaacataccatcataccctgacacccaagcagtcaatgaatacctacggaaactgtcagatcattcagtaagagaggactcagagcatggtgaaaagccagtgccatctcagcctcttttagaagaagcaattcctaatctccacagcccgcctaccacaagcacctcagccctaaacagcctggtggtctcttgtgcatctgctgttggtgtgagagtggctgctacttatgaagctggtgccttgtcactgaagaaagttatgaacttttatagtacaaccccttgtgaaactggagctcaggcaggcagtagtgccattggccccgaaggtttgaaagatagcagggaagaacaggttaaacaggaatcaatgcaaggaaagaaaagttcaagtcttgtggatatcagagaagaagaaacagagggaggcagtcgaagactctccctccctggattgttgtcacaagtttcccccaggctcttaagaaaggctgcacgggtgaaaacgaggacagtggttctgacccccacatacagtggagaagcagatgcgctcctgccttctctgagaacagaagtgtggacctgggggaaagggaaggaagggcagctggggcacggcgatgttctgcctaggcttcaaccgttgtgtgtaaaatgtctggatggcaaagaagtaatccatctggaggcaggtggttaccattctcttgcacttactgcgaaatcccaggtttactcatggggtagcaatacctttggtcaacttgggcattccgattttccaacaacagttcctcgtcttgcaaagataagcagtgaaaatggagtctggagcatagctgcaggcagggattattccctgtttttagtggatacagaagacttccagcctgggttatattacagtggccgacaggaccctacagaaggtgacaaccttccagagaatcacagtggttctaagactccagtacttctctcctgtagtaagcttggatatataagcagagtgacagcaggaaaagatagctatttagccttggtggataaaaacattatggggtatattgccagtctccacgagttagctactacagaaagacgattctattcaaaactaagtgatatcaaatctcagattctcaggcctcttctcagtttagaaaatttgggcactacaactacagtccagctgttgcaggaggtggctagccgattcagcaagctgtgttacctcattggtcagcatggagcctcattgagcagcttccttcatggggtaaaggaagccaggagtttggtcatcctgaagcattcaagtctcttcttggatagttatacagagtattgcacatctattacaaatttcctggttatgggaggattccagcttcttgctaagcctgccattgatttcctaaataaaaaccaagagctgttgcaagatttgtcagaagtgaatgacgaaaacactcagttgatggaaatactgaatactttgtttttcttgccaatcagacgacttcataattacgcaaaagttttgctaaagcttgctacttgttttgaagtggcatctccagaatatcagaaactgcaggattccagttcttgttatgagtgtcttgctctccatctcggcaggaaaaggaaggaagcagaatacacactgggcttctggaagaccttccccggaaaaatgacggattccttgaggaagccagagcgtcgactgctgtgtgagagtagtaaccgagccctgtctctgcagcatgctgggaggttttccgtgaattggttcattctctttaatgatgccctggtccatgcccagttctccacgcaccatgttttccctctggccacgctgtgggcagagccactgtctgaagaagctggtggtgtgaatggcttaaagataactacacctgaggagcagttcactctcatttcatctacaccccaggaaaagacaaagtggctacgagctataagccaagccgtagatcaggctttgagagggatgtctgatctccccccttatggaagtggtagcagtgttcagagacaggaaccacccatttcacgcagtgccaaatatactttctacaaggatcctcgcctaaaggatgccacctatgatggacgctggctttcagggaagcctcatggcagaggggttttgaagtggcctgatggaaagatgtattctggcatgttcaggaatggcttggaagatgggtatggagaatacagaatcccaaacaaggcaatgaacaaagaagaccattatgtgggccattggaaagaaggaaaaatgtgcggtcaaggagtctacagctatgcttctggtgaagtatttgagggctgttttcaagataatatgcgtcatggtcatggtcttctacgaagtgggaaattgacgtcctcttctcctagtatgttcattggccagtgggtaatggataagaaagcaggatatggtgtctttgatgatatcactaggggggaaaagtatatgggaatgtggcaagatgatgtgtgtcaagggaatggtgtggtggttacccagtttggattatactacgagggcaactttcaccttaataaaatgatgggaaatggggttttgctttccgaagatgatactatctatgaaggagaattttcagatgactggactcttagtggaaagggaacactgactatgccaaatggagactacattgaaggttattttagtggagaatggggatctgggataaaaatcactggaacctacttcaaacctagtctatatgagagtgataaagacagacctaaagttttcaggaagctaggaaacctggcagtgccagctgatgagaagtggaaagcggtgtttgacgaatgttggcgccaactgggctgtgagggcccaggccaaggggaagtttggaaagcatgggacaatattgctgtggccttgaccaccagtcggcgccagcacagagacagtccagaaatactgagtcgttcacagactcagacactagagagtttggaattcattccacagcatgttggtgccttctctgtggagaaatatgatgacatcaggaaatatttaataaaggcctgtgacactcctctgcaccccctgggcaggcttgtggagacactggttgcagtgtatagaatgacatacgtgggcgtaggagccaaccgcaggttattgcaggaggctgtaaaggagattaagtcctatcttaagcgaattttccagctggtgaggttcttatttcctgagctgcctgaagaaggcagcacaattcctctctctgctcctctgccaaccgaaaggaagtctttttgcactgggaagtcagattcccgatctgaatcaccagagccaggttatgtagtaacgagttctggattattgcttcctgtgctgctacctcggctctacccaccgctgtttatgctttatgctttggataatgatcgcgaggaagacatttactgggaatgtgtccttcgactaaataagcagccagatattgctctcctgggctttcttggggtgcagaggaaattttggccagcaaccttgtcaatccttggagagagtaaaaaggttttgccaaccacgaaagatgcttgttttgcctcagcagtagaatgtctgcagcagatcagcacaacatttaccccatcagacaaacttaaggtcatccagcagacttttgaggagatctctcagagtgtcctggcgtcactccacgaagacttcttgtggtccatggatgacttgtttcctgttttcttatatgtggtgctacgggccaggattaggaatttaggctctgaggtacacctcattgaggatctaatggacccctatcttcagcatggggaacagggtataatgttcaccaccttgaaggcatgttactaccagattcagcgtgagaagcttaactaggctgcataacagcttgaaaactggattatctactacagagtgttataacaccatctggagtcttcctgtagtggcaaaaaagaacagtgttgaaattggaaaggactttgtgttatttaggttgttagaatgagccttaccaataataagagccctgagcccagaaaaaaggactgtatagtttaaagggaggattgaaagggaggtaaaaaatcagattagaccagttcttggcctatgataagttccaaaaataccatttatctactatttgaaaaaagaagaggatatcccttcctacagtaaagggtatgtcagctacatgaagttgtaagaaaagcttccagtagagcttcttatattaaagaagttgatggatatttttgaatttctggtttgcctgaatccacctgcagttaccccgatccgtttgcaagaaccagatcgtacttgaaactatagtggccacactctgccttcctgagtcccttccagtcatgtgtgcatcatgtctctttgccaagggaggggagaaaggaacttttaaactgcagttttaactttttctaagctgtttcttgatgggagaggttctgtgcaaaactaccacattctgtccccaaaatgtggaatgcatccaaataggagtcttctgcctcttaacttaaaagaacataggaattttgtttttggtttctttatcatgctacagagagtgaatacactggaattcagacaccgactctgagctgctaggaacctcatttgtccatgtgcaaacgctgtattccaaggcctgtgaatggcagcctgaggaagttttgcatgcaggctgtgttttcgagcaggactaacaactgggaaataagcaaaaaactgcatcgatccccagcctggtgttgttcttccctatacttcacactgaactcaggatgggaagaaaaaggaaacaagctttggctttttccatctcaaaagtattgtggcacctcaacatttcagtgttttgctttttaaaaaatgccctattgtaagttgttggtttatactgtataagtaacactagtagctgttttgaataacataggtgctcttcctcatctcatctcctacaccgtggtgagcatacagagtgtcctgatttgtgttaagtgactgagaagatgttaattacttttgaaaaaggatcatggtttttgctctactttataatcaagacaagtgtttattaaaatactgttttggaatgttggctgtaatgtaacagcaattttcataataaaaggcattcatcttta

SEQ ID NO: 22995 - DNA, 2670 bp, Homo sapiens
cgcggacccactgggttgccaagctcgcgccggatgcggagcgcggtgctgccggtggagcttcaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaagatggtgaggtctacagctttgggactcttccctggagaagtggaccagtggagatttgtccaagtagccccattctagaaaatgccctggttgggcaatatgttattactgtggcaacaggaagcttccatagtggagcagtgacagacaatggtgtcgcgtacatgtggggagagaattctgctggccagtgtgcagtagccaaccagcagtatgtgccggaaccaaatcctgtcagcattgctgattctgaggccagccctttgttagcagtcaggattttacagttggcgtgtggcgaggagcacactctggcattgtcaataagcagagagatttgggcatggggtaccggttgtcagttgggtctcattaccactgccttcccagtgacaaagccgcaaaaggtagaacatcttgctgggcgagtggtgcttcaagttgcctgtggtgctttccacagcttagcccttgtacaatgcctcccttcccaggatctgaagccagtcccagaacgatgcaaccagtgcagccagctcttgattactatgactgacaaagaagaccatgtgattatatcagacagtcattgttgcccattaggtgtgacactgacagaatctcaggcagaaaaccatgccagcactgctctcagcccctccactgaaacccttgacaggcaggaagaagtatttgagaacactcttgtagcaaatgatcagtctgttgctactgaactgaatgcagtaagtgctcagatcacaagcagcgatgccatgtcctctcaacaaaatgtcatgggaacaactgaaatttcctctgccagaaacataccatcataccctgacacccaagcagtcaatgaatacctacggaaactgtcagatcattcagtaagagaggactcagagcatggtgaaaagccagtgccatctcaggtacctgctcaattttataaaataaaagtgtgtctagagttgaactgtatgggcttttctttagaaactttaaaatgagtaaggcttggtagcattttttattttttgagtttgattataattttgttttatcaggcaagcctagataaaggaaagaacctggattaattcaaaatcactctttatgtttgttctggccctttatgatattgaaaggtgtcatgttgggcttgttttataagtaggagcatttcatttttttttcttgctagtactttttttctatggctaaagtactgaattttggtgggccctgaatagtttaatataactagagattcacaaagattcttcttacttgtgtttgtaacactcttcagaattctgtagagaaaagtcttttccttctttaacagggaagattgttttgtggcagatccttcaattgtaggcagatttaaaacttacaggcaattacatgtttcagtttttttcaattatagctgtggtccttactgggcttaatttgaagaggtggctaatattttatctttttgtttgtttgtttttgagatggggtcttgctctgtcacccaggctggagtgcagtaatgcgattgtggctcactgcagcctcgatctcccaggttcaagcgatcctcccatttcagccttccaagtagctgggactatacacatgccaccacacctgctgattttatttttaagtagagtagagcctgttgcccaggctcatctcaaactcctgagctcaagcaatcctcccacctcagcctcccaaagtgttgagattacaggcatgagccatcatgcccagcctattttatatatcttattaaaactattttcattttgaagatttgtggtagaatgaacaaaagttgtttatcagtagcacatggtaaagtttgagttcccgcttaaactaaattgttttaaaaggattatttctgtgttttactcttagtgtggccttttgattttgctttaccaaaactgtaagaaaacaaaacaaaagatcatactcataaaagatctgtcctgcagtgtttctttttaggtttttgaaaccacatagcctcttgattctcaattcttattgtttactctgtcagaatgtgaacatgaaggtatttttagaaatagtctttatttcacaatctattcactgaaacttgtgggtatttgaatttttaaaaaaatcaaggataagctgtttggagaaaggtattataaagtctgaacaaagcaaaagtagtagtttaacaagaatgcatgtagaaaattcttagactgtacatgcttatcacattttacttactttgttaaacattggaagtttttgttacttatgctagtaacaatgtgtgtgtttctattgaattaaatttaatttatttaaattaaatg

SEQ ID NO: 22996 - DNA, 372 bp, Homo sapiens
agttcagtgtgaagtatagggaagaacaacaccaggctggggatcgatgcagtattgtggcacctcaacatttcagtgttttgctttttaaaaaatgccctattgtaagttgttggtttatactgtataagtaacactagtagctgttttgaataacataggtgctcttcctcatctcatctcctacaccgtggtgagcatacagagtgtcctgatttgtgttaagtgactgagaagatgttaattacttttgaaaaaggatcatggtttttgctctactttataatcaagacaagtgtttattaaaatactgttttggaatgttggctgtaatgtaacagcaattttcataataaaaggcattcatcttta

SEQ ID NO: 22997 - DNA, 273 bp, Homo sapiens
tgttgtgagtgtaaattagtgtgatgagtaggggaagggagcctactagggtgtagaataggaagtatgtgcctgcgttcaggcgttctggctggttgcctcatgggggagacggacctcgtggtttgtgattcttatatgtggtgctacgggccaggattaggaatttaggctctgaggtacacctcattgaggatctaatggacccctatcttcagcatggggaacagggtataatgttcaccaccttgaaggtgagtatagttattattt

SEQ ID NO: 22998 - DNA, 6530 bp, Homo sapiens
cgcggacccactgggttgccaagctcgcgccggatgcggagcgcggtgctgccggtggagcttcaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaagatggtgaggtctacagctttgggactcttccctggagaagtggaccagtggagatttgtccaagtagccccattctagaaaatgccctggttgggcaatatgttattactgtggcaacaggaagcttccatagtggagcagtgacagacaatggtgtcgcgtacatgtggggagagaattctgctggccagtgtgcagtagccaaccagcagtatgtgccggaaccaaatcctgtcagcattgctgattctgaggccagccctttgttagcagtcaggattttacagttggcgtgtggcgaggagcacactctggcattgtcaataagcagagagatttgggcatggggtaccggttgtcagttgggtctcattaccactgccttcccagtgacaaagccgcaaaaggtagaacatcttgctgggcgagtggtgcttcaagttgcctgtggtgctttccacagcttagcccttgtacaatgcctcccttcccaggatctgaagccagtcccagaacgatgcaaccagtgcagccagctcttgattactatgactgacaaagaagaccatgtgattatatcagacagtcattgttgcccattaggtgtgacactgacagaatctcaggcagaaaaccatgccagcactgctctcagcccctccactgaaacccttgacaggcaggaagaagtatttgagaacactcttgtagcaaatgatcagtctgttgctactgaactgaatgcagtaagtgctcagatcacaagcagcgatgccatgtcctctcaacaaaatgtcatgggaacaactgaaatttcctctgccagaaacataccatcataccctgacacccaagcagtcaatgaatacctacggaaactgtcagatcattcagtaagagaggactcagagcatggtgaaaagccagtgccatctcagcctcttttagaagaagcaattcctaatctccacagcccgcctaccacaagcacctcagccctaaacagcctggtggtctcttgtgcatctgctgttggtgtgagagtggctgctacttatgaagctggtgccttgtcactgaagaaagttatgaacttttatagtacaaccccttgtgaaactggagctcaggcaggcagtagtgccattggccccgaaggtttgaaagatagcagggaagaacaggttaaacaggaatcaatgcaaggaaagaaaagttcaagtcttgtggatatcagagaagaagaaacagagggaggcagtcgaagactctccctccctggattgttgtcacaagtttcccccaggctcttaagaaaggctgcacgggtgaaaacgaggacagtggttctgacccccacatacagtggagaagcagatgcgctcctgccttctctgagaacagaagtgtggacctgggggaaagggaaggaagggcagctggggcacggcgatgttctgcctaggcttcaaccgttgtgtgtaaaatgtctggatggcaaagaagtaatccatctggaggcaggtggttaccattctcttgcacttactgcgaaatcccaggtttactcatggggtagcaatacctttggtcaacttgggcattccgattttccaacaacagttcctcgtcttgcaaagataagcagtgaaaatggagtctggagcatagctgcaggcagggattattccctgtttttagtggatacagaagacttccagcctgggttatattacagtggccgacaggaccctacagaaggtgacaaccttccagagaatcacagtggttctaagactccagtacttctctcctgtagtaagcttggatatataagcagagtgacagcaggaaaagatagctatttagccttggtggataaaaacattatggggtatattgccagtctccacgagttagctactacagaaagacgattctattcaaaactaagtgatatcaaatctcagattctcaggcctcttctcagtttagaaaatttgggcactacaactacagtccagctgttgcaggaggtggctagccgattcagcaagctgtgttacctcattggtcagcatggagcctcattgagcagcttccttcatggggtaaaggaagccaggagtttggtcatcctgaagcattcaagtctcttcttggatagttatacagagtattgcacatctattacaaatttcctggttatgggaggattccagcttcttgctaagcctgccatgtaagcaaacccacaccttccagttatcattctctccgccaaagatgacattttatagtgctctgttttcgagtgctcagggaaagctttgacttcatcattttaccaaacaagtcaaaatataaactttcatgatttcctaaataaaaaccaagagctgttgcaagatttgtcagaagtgaatgacgaaaacactcagttgatggaaatactgaatactttgtttttcttgccaatcagacgacttcataattacgcaaaagttttgctaaagcttgctacttgttttgaagtggcatctccagaatatcagaaactgcaggattccagttcttgttatgagtgtcttgctctccatctcggcaggaaaaggaaggaagcagaatacacactgggcttctggaagaccttccccggaaaaatgacggattccttgaggaagccagagcgtcgactgctgtgtgagagtagtaaccgagccctgtctctgcagcatgctgggaggttttccgtgaattggttcattctctttaatgatgccctggtccatgcccagttctccacgcaccatgttttccctctggccacgctgtgggcagagccactgtctgaagaagctggtggtgtgaatggcttaaagataactacacctgaggagcagttcactctcatttcatctacaccccaggaaaagacaaagtggctacgagctataagccaagccgtagatcaggctttgagagggatgtctgatctccccccttatggaagtggtagcagtgttcagagacaggaaccacccatttcacgcagtgccaaatatactttctacaaggatcctcgcctaaaggatgccacctatgatggacgctggctttcagggaagcctcatggcagaggggttttgaagtggcctgatggaaagatgtattctggcatgttcaggaatggcttggaagatgggtatggagaatacagaatcccaaacaaggcaatgaacaaagaagaccattatgtgggccattggaaagaaggaaaaatgtgcggtcaaggagtctacagctatgcttctggtgaagtatttgagggctgttttcaagataatatgcgtcatggtcatggtcttctacgaagtgggaaattgacgtcctcttctcctagtatgttcattggccagtgggtaatggataagaaagcaggatatggtgtctttgatgatatcactaggggggaaaagtatatgggaatgtggcaagatgatgtgtgtcaagggaatggtgtggtggttacccagtttggattatactacgagggcaactttcaccttaataaaatgatgggaaatggggttttgctttccgaagatgatactatctatgaaggagaattttcagatgactggactcttagtggaaagggaacactgactatgccaaatggagactacattgaaggttattttagtggagaatggggatctgggataaaaatcactggaacctacttcaaacctagtctatatgagagtgataaagacagacctaaagttttcaggaagctaggaaacctggcagtgccagctgatgagaagtggaaagcggtgtttgacgaatgttggcgccaactgggctgtgagggcccaggccaaggggaagtttggaaagcatgggacaatattgctgtggccttgaccaccagtcggcgccagcacagagacagtccagaaatactgagtcgttcacagactcagacactagagagtttggaattcattccacagcatgttggtgccttctctgtggagaaatatgatgacatcaggaaatatttaataaaggcctgtgacactcctctgcaccccctgggcaggcttgtggagacactggttgcagtgtatagaatgacatacgtgggcgtaggagccaaccgcaggttattgcaggaggctgtaaaggagattaagtcctatcttaagcgaattttccagctggtgaggttcttatttcctgagctgcctgaagaaggcagcacaattcctctctctgctcctctgccaaccgaaaggaagtctttttgcactgggaagtcagattcccgatctgaatcaccagagccaggttatgtagtaacgagttctggattattgcttcctgtgctgctacctcggctctacccaccgctgtttatgctttatgctttggataatgatcgcgaggaagacatttactgggaatgtgtccttcgactaaataagcagccagatattgctctcctgggctttcttggggtgcagaggaaattttggccagcaaccttgtcaatccttggagagagtaaaaaggttttgccaaccacgaaagatgcttgttttgcctcagcagtagaatgtctgcagcagatcagcacaacatttaccccatcagacaaacttaaggtcatccagcagacttttgaggagatctctcagagtgtcctggcgtcactccacgaagacttcttgtggtccatggatgacttgtttcctgttttcttatatgtggtgctacgggccaggattaggaatttaggctctgaggtacacctcattgaggatctaatggacccctatcttcagcatggggaacagggtataatgttcaccaccttgaaggcatgttactaccagattcagcgtgagaagcttaactaggctgcataacagcttgaaaactggattatctactacagagtgttataacaccatctggagtcttcctgtagtggcaaaaaagaacagtgttgaaattggaaaggactttgtgttatttaggttgttagaatgagccttaccaataataagagccctgagcccagaaaaaaggactgtatagtttaaagggaggattgaaagggaggtaaaaaatcagattagaccagttcttggcctatgataagttccaaaaataccatttatctactatttgaaaaaagaagaggatatcccttcctacagtaaagggtatgtcagctacatgaagttgtaagaaaagcttccagtagagcttcttatattaaagaagttgatggatatttttgaatttctggtttgcctgaatccacctgcagttaccccgatccgtttgcaagaaccagatcgtacttgaaactatagtggccacactctgccttcctgagtcccttccagtcatgtgtgcatcatgtctctttgccaagggaggggagaaaggaacttttaaactgcagttttaactttttctaagctgtttcttgatgggagaggttctgtgcaaaactaccacattctgtccccaaaatgtggaatgcatccaaataggagtcttctgcctcttaacttaaaagaacataggaattttgtttttggtttctttatcatgctacagagagtgaatacactggaattcagacaccgactctgagctgctaggaacctcatttgtccatgtgcaaacgctgtattccaaggcctgtgaatggcagcctgaggaagttttgcatgcaggctgtgttttcgagcaggactaacaactgggaaataagcaaaaaactgcatcgatccccagcctggtgttgttcttccctatacttcacactgaactcaggatgggaagaaaaaggaaacaagctttggctttttccatctcaaaagtattgtggcacctcaacatttcagtgttttgctttttaaaaaatgccctattgtaagttgttggtttatactgtataagtaacactagtagctgttttgaataacataggtgctcttcctcatctcatctcctacaccgtggtgagcatacagagtgtcctgatttgtgttaagtgactgagaagatgttaattacttttgaaaaaggatcatggtttttgctctactttataatcaagacaagtgtttattaaaatactgttttggaatgttggctgtaatgtaacagcaattttcataataaaaggcattcatcttta

SEQ ID NO: 22999 - DNA, 2718 bp, Homo sapiens
atcaggataattctggcctcatagaacaagttgggaagtgttccctcctcccctattttctgaaagtttgcgaagctttggtattatttcttctttgaatgtttgggagaattcaccaatgaagtcttctgggcctaagcattactttggaacactgactatgccaaatggagactacattgaaggttattttagtggagaatggggatctgggataaaaatcactggaacctacttcaaacctagtctatatgagagtgataaagacagacctaaagttttcaggaagctaggaaacctggcagtgccagctgatgagaagtggaaagcggtgtttgacgaatgttggcgccaactgggctgtgagggcccaggccaaggggaagtttggaaagcatgggacaatattgctgtggccttgaccaccagtcggcgccagcacagagacagtccagaaatactgagtcgttcacagactcagacactagagagtttggaattcattccacagcatgttggtgccttctctgtggagaaatatgatgacatcaggaaatatttaataaaggcctgtgacactcctctgcaccccctgggcaggcttgtggagacactggttgcagtgtatagaatgacatacgtgggcgtaggagccaaccgcaggttattgcaggaggctgtaaaggagattaagtcctatcttaagcgaattttccagctggtgaggttcttatttcctgagctgcctgaagaaggcagcacaattcctctctctgctcctctgccaaccgaaaggaagtctttttgcactgggaagtcagattcccgatctgaatcaccagagccaggttatgtagtaacgagttctggattattgcttcctgtgctgctacctcggctctacccaccgctgtttatgctttatgctttggataatgatcgcgaggaagacatttactgggaatgtgtccttcgactaaataagcagccagatattgctctcctgggctttcttggggtgcagaggaaattttggccagcaaccttgtcaatccttggagagagtaaaaaggttttgccaaccacgaaagatgcttgttttgcctcagcagtagaatgtctgcagcagatcagcacaacatttaccccatcagacaaacttaaggtcatccagcagacttttgaggagatctctcagagtgtcctggcgtcactccacgaagacttcttgtggtccatggatgacttgtttcctgttttcttatatgtggtgctacgggccaggattaggaatttaggctctgaggtacacctcattgaggatctaatggacccctatcttcagcatggggaacagggtataatgttcaccaccttgaaggcatgttactaccagattcagcgtgagaagcttaactaggctgcataacagcttgaaaactggattatctactacagagtgttataacaccatctggagtcttcctgtagtggcaaaaaagaacagtgttgaaattggaaaggactttgtgttatttaggttgttagaatgagccttaccaataataagagccctgagcccagaaaaaaggactgtatagtttaaagggaggattgaaagggaggtaaaaaatcagattagaccagttcttggcctatgataagttccaaaaataccatttatctactatttgaaaaaagaagaggatatcccttcctacagtaaagggtatgtcagctacatgaagttgtaagaaaagcttccagtagagcttcttatattaaagaagttgatggatatttttgaatttctggtttgcctgaatccacctgcagttaccccgatccgtttgcaagaaccagatcgtacttgaaactatagtggccacactctgccttcctgagtcccttccagtcatgtgtgcatcatgtctctttgccaagggaggggagaaaggaacttttaaactgcagttttaactttttctaagctgtttcttgatgggagaggttctgtgcaaaactaccacattctgtccccaaaatgtggaatgcatccaaataggagtcttctgcctcttaacttaaaagaacataggaattttgtttttggtttctttatcatgctacagagagtgaatacactggaattcagacaccgactctgagctgctaggaacctcatttgtccatgtgcaaacgctgtattccaaggcctgtgaatggcagcctgaggaagttttgcatgcaggctgtgttttcgagcaggactaacaactgggaaataagcaaaaaactgcatcgatccccagcctggtgttgttcttccctatacttcacactgaactcaggatgggaagaaaaaggaaacaagctttggctttttccatctcaaaagtattgtggcacctcaacatttcagtgttttgctttttaaaaaatgccctattgtaagttgttggtttatactgtataagtaacactagtagctgttttgaataacataggtgctcttcctcatctcatctcctacaccgtggtgagcatacagagtgtcctgatttgtgttaagtgactgagaagatgttaattacttttgaaaaaggatcatggtttttgctctactttataatcaagacaagtgtttattaaaatactgttttggaatgttggctgtaatgtaacagcaattttcataataaaaggcattcatcttta

SEQ ID NO: 23000 - DNA, 1586 bp, Homo sapiens
aaaaaactttgttttagaataagacgggaaatgaaaaaattttgtctatactaattacaagtaggcaaaagacagccactagataggggaactagaaaggaacagggaaaagtgaaatcagttaaatctgttgggccatcagctgaatttgttcataagggattttgtttctttagtcccatatgcattgctctctttatgtaatttctttaaaagtgaatttgaaattattttgaacttttcttccaggcatgttactaccagattcagcgtgagaagcttaactaggctgcataacagcttgaaaactggattatctactacagagtgttataacaccatctggagtcttcctgtagtggcaaaaaagaacagtgttgaaattggaaaggactttgtgttatttaggttgttagaatgagccttaccaataataagagccctgagcccagaaaaaaggactgtatagtttaaagggaggattgaaagggaggtaaaaaatcagattagaccagttcttggcctatgataagttccaaaaataccatttatctactatttgaaaaaagaagaggatatcccttcctacagtaaagggtatgtcagctacatgaagttgtaagaaaagcttccagtagagcttcttatattaaagaagttgatggatatttttgaatttctggtttgcctgaatccacctgcagttaccccgatccgtttgcaagaaccagatcgtacttgaaactatagtggccacactctgccttcctgagtcccttccagtcatgtgtgcatcatgtctctttgccaagggaggggagaaaggaacttttaaactgcagttttaactttttctaagctgtttcttgatgggagaggttctgtgcaaaactaccacattctgtccccaaaatgtggaatgcatccaaataggagtcttctgcctcttaacttaaaagaacataggaattttgtttttggtttctttatcatgctacagagagtgaatacactggaattcagacaccgactctgagctgctaggaacctcatttgtccatgtgcaaacgctgtattccaaggcctgtgaatggcagcctgaggaagttttgcatgcaggctgtgttttcgagcaggactaacaactgggaaataagcaaaaaactgcatcgatccccagcctggtgttgttcttccctatacttcacactgaactcaggatgggaagaaaaaggaaacaagctttggctttttccatctcaaaagtattgtggcacctcaacatttcagtgttttgctttttaaaaaatgccctattgtaagttgttggtttatactgtataagtaacactagtagctgttttgaataacataggtgctcttcctcatctcatctcctacaccgtggtgagcatacagagtgtcctgatttgtgttaagtgactgagaagatgttaattacttttgaaaaaggatcatggtttttgctctactttataatcaagacaagtgtttattaaaatactgttttggaatgttggctgtaatgtaacagcaattttcataataaaaggcattcatcttta

SEQ ID NO: 23001 - DNA, 4403 bp, Homo sapiens
cgcggacccactgggttgccaagctcgcgccggatgcggagcgcggtgctgccggtggagcttcaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaagatggtgaggtctacagctttgggactcttccctggagaagtggaccagtggagatttgtccaagtagccccattctagaaaatgccctggttgggcaatatgttattactgtggcaacaggaagcttccatagtggagcagtgacagacaatggtgtcgcgtacatgtggggagagaattctgctggccagtgtgcagtagccaaccagcagtatgtgccggaaccaaatcctgtcagcattgctgattctgaggccagccctttgttagcagtcaggattttacagttggcgtgtggcgaggagcacactctggcattgtcaataagcagagagatttgggcatggggtaccggttgtcagttgggtctcattaccactgccttcccagtgacaaagccgcaaaaggtagaacatcttgctgggcgagtggtgcttcaagttgcctgtggtgctttccacagcttagcccttgtacaatgcctcccttcccaggatctgaagccagtcccagaacgatgcaaccagtgcagccagctcttgattactatgactgacaaagaagaccatgtgattatatcagacagtcattgttgcccattaggtgtgacactgacagaatctcaggcagaaaaccatgccagcactgctctcagcccctccactgaaacccttgacaggcaggaagaagtatttgagaacactcttgtagcaaatgatcagtctgttgctactgaactgaatgcagtaagtgctcagatcacaagcagcgatgccatgtcctctcaacaaaatgtcatgggaacaactgaaatttcctctgccagaaacataccatcataccctgacacccaagcagtcaatgaatacctacggaaactgtcagatcattcagtaagagaggactcagagcatggtgaaaagccagtgccatctcagcctcttttagaagaagcaattcctaatctccacagcccgcctaccacaagcacctcagccctaaacagcctggtggtctcttgtgcatctgctgttggtgtgagagtggctgctacttatgaagctggtgccttgtcactgaagaaagttatgaacttttatagtacaaccccttgtgaaactggagctcaggcaggcagtagtgccattggccccgaaggtttgaaagatagcagggaagaacaggttaaacaggaatcaatgcaaggaaagaaaagttcaagtcttgtggatatcagagaagaagaaacagagggaggcagtcgaagactctccctccctggattgttgtcacaagtttcccccaggctcttaagaaaggctgcacgggtgaaaacgaggacagtggttctgacccccacatacagtggagaagcagatgcgctcctgccttctctgagaacagaagtgtggacctgggggaaagggaaggaagggcagctggggcacggcgatgttctgcctaggcttcaaccgttgtgtgtaaaatgtctggatggcaaagaagtaatccatctggaggcaggtggttaccattctcttgcacttactgcgaaatcccaggtttactcatggggtagcaatacctttggtcaacttgggcattccgattttccaacaacagttcctcgtcttgcaaagataagcagtgaaaatggagtctggagcatagctgcaggcagggattattccctgtttttagtggatacagaagacttccagcctgggttatattacagtggccgacaggaccctacagaaggtgacaaccttccagagaatcacagtggttctaagactccagtacttctctcctgtagtaagcttggatatataagcagagtgacagcaggaaaagatagctatttagccttggtggataaaaacattatggggtatattgccagtctccacgagttagctactacagaaagacgattctattcaaaactaagtgatatcaaatctcagattctcaggcctcttctcagtttagaaaatttgggcactacaactacagtccagctgttgcaggaggtggctagccgattcagcaagctgtgttacctcattggtcagcatggagcctcattgagcagcttccttcatggggtaaaggaagccaggagtttggtcatcctgaagcattcaagtctcttcttggatagttatacagagtattgcacatctattacaaatttcctggttatgggaggattccagcttcttgctaagcctgccattgatttcctaaataaaaaccaagagctgttgcaagatttgtcagaagtgaatgacgaaaacactcagttgatggaaatactgaatactttgtttttcttgccaatcagacgacttcataattacgcaaaagttttgctaaagcttgctacttgttttgaagtggcatctccagaatatcagaaactgcaggattccagttcttgttatgagtgtcttgctctccatctcggcaggaaaaggaaggaagcagaatacacactgggcttctggaagaccttccccggaaaaatgacggattccttgaggaagccagagcgtcgactgctgtgtgagagtagtaaccgagccctgtctctgcagcatgctgggaggttttccgtgaattggttcattctctttaatgatgccctggtccatgcccagttctccacgcaccatgttttccctctggccacgctgtgggcagagccactgtctgaagaagctggtggtgtgaatggcttaaagataactacacctgaggagcagttcactctcatttcatctacaccccaggaaaagacaaagtggctacgagctataagccaagccgtagatcaggctttgagagggatgtctgatctccccccttatggaagtggtagcagtgttcagagacaggaaccacccatttcacgcagtgccaaatatactttctacaaggatcctcgcctaaaggatgccacctatgatggacgctggctttcagggaagcctcatggcagaggggttttgaagtggcctgatggaaagatgtattctggcatgttcaggaatggcttggaagatgggtatggagaatacagaatcccaaacaaggcaatgaacaaagaagaccattatgtgggccattggaaagaaggaaaaatgtgcggtcaaggagtctacagctatgcttctggtgaagtatttgagggctgttttcaagataatatgcgtcatggtcatggtcttctacgaagtgggaaattgacgtcctcttctcctagtatgttcattggccagtgggtaatggataagaaagcaggatatggtgtctttgatgatatcactaggggggaaaagtatatgggaatgtggcaagatgatgtgtgtcaagggaatggtgtggtggttacccagtttggattatactacgagggcaactttcaccttaataaaatgatgggaaatggggttttgctttccgaagatgatactatctatgaaggagaattttcagatgactggactcttagtggaaaggttggaaactagctttctttttttttctccctaataaattcttttactaatttttttttactttaaaaatagctgatttacatgccataaaattcacccctttcaagtgcacgtttcagtgatttttggtcaacatggctgtacaaaccaccaccacaatccagtttcagaacatttccatcgcccaagaaaatcccttctgctcattcagtgacttccatttccacctaaagtcccagccaaccactaatcacccttaatcactctatagatttgccttttttgggccttttgtataaatggaatcatacatgcaatctcctctatgtggcttcttacacttaggataatgtttttgttttttccatattgtggcatgtatagtatttgttcctttttatggctgaatagtgttccaaaactacattttgtttatccttttaccagttgatggacattgggttatttccaactttagactattgtaaataatgctgctataaacttttgaatgcagtttcttgtgtagacatatgttttcattttcatttctcaagtagatgcctggagtgtaa

SEQ ID NO: 23002 - DNA, 946 bp, Homo sapiens
ttctttccaaccacagctatgcttctggtgaagtatttgagggctgttttcaagataatatgcgtcatggtcatggtcttctacgaagtgggaaattgacgtcctcttctcctagtatgttcattggccagtgggtaatggataagaaagcaggatatggtgtctttgatgatatcactaggggggaaaagtatatgggaatgtggcaagatgatgtgtgtcaagggaatggtgtggtggttacccagtttggattatactacgagggcaactttcaccttaataaaatgatgggaaatggggttttgctttccgaagatgatactatctatgaaggagaattttcagatgactggactcttagtggaaaggttggaaactagctttctttttttttctccctaataaattcttttactaatttttttttactttaaaaatagctgatttacatgccataaaattcacccctttcaagtgcacgtttcagtgatttttggtcaacatggctgtacaaaccaccaccacaatccagtttcagaacatttccatcgcccaagaaaatcccttctgctcattcagtgacttccatttccacctaaagtcccagccaaccactaatcacccttaatcactctatagatttgccttttttgggccttttgtataaatggaatcatacatgcaatctcctctatgtggcttcttacacttaggataatgtttttgttttttccatattgtggcatgtatagtatttgttcctttttatggctgaatagtgttccaaaactacattttgtttatccttttaccagttgatggacattgggttatttccaactttagactattgtaaataatgctgctataaacttttgaatgcagtttcttgtgtagacatatgttttcattttcatttctcaagtagatgcctggagtgtaa

SEQ ID NO: 23003 - DNA, 6344 bp, Homo sapiens
cgcggacccactgggttgccaagctcgcgccggatgcggagcgcggtgctgccggtggagcttcaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaagatggtgaggtctacagctttgggactcttccctggagaagtggaccagtggagatttgtccaagtagccccattctagatggagcagtgacagacaatggtgtcgcgtacatgtggggagagaattctgctggccagtgtgcagtagccaaccagcagtatgtgccggaaccaaatcctgtcagcattgctgattctgaggccagccctttgttagcagtcaggattttacagttggcgtgtggcgaggagcacactctggcattgtcaataagcagagagatttgggcatggggtaccggttgtcagttgggtctcattaccactgccttcccagtgacaaagccgcaaaaggtagaacatcttgctgggcgagtggtgcttcaagttgcctgtggtgctttccacagcttagcccttgtacaatgcctcccttcccaggatctgaagccagtcccagaacgatgcaaccagtgcagccagctcttgattactatgactgacaaagaagaccatgtgattatatcagacagtcattgttgcccattaggtgtgacactgacagaatctcaggcagaaaaccatgccagcactgctctcagcccctccactgaaacccttgacaggcaggaagaagtatttgagaacactcttgtagcaaatgatcagtctgttgctactgaactgaatgcagtaagtgctcagatcacaagcagcgatgccatgtcctctcaacaaaatgtcatgggaacaactgaaatttcctctgccagaaacataccatcataccctgacacccaagcagtcaatgaatacctacggaaactgtcagatcattcagtaagagaggactcagagcatggtgaaaagccagtgccatctcagcctcttttagaagaagcaattcctaatctccacagcccgcctaccacaagcacctcagccctaaacagcctggtggtctcttgtgcatctgctgttggtgtgagagtggctgctacttatgaagctggtgccttgtcactgaagaaagttatgaacttttatagtacaaccccttgtgaaactggagctcaggcaggcagtagtgccattggccccgaaggtttgaaagatagcagggaagaacaggttaaacaggaatcaatgcaaggaaagaaaagttcaagtcttgtggatatcagagaagaagaaacagagggaggcagtcgaagactctccctccctggattgttgtcacaagtttcccccaggctcttaagaaaggctgcacgggtgaaaacgaggacagtggttctgacccccacatacagtggagaagcagatgcgctcctgccttctctgagaacagaagtgtggacctgggggaaagggaaggaagggcagctggggcacggcgatgttctgcctaggcttcaaccgttgtgtgtaaaatgtctggatggcaaagaagtaatccatctggaggcaggtggttaccattctcttgcacttactgcgaaatcccaggtttactcatggggtagcaatacctttggtcaacttgggcattccgattttccaacaacagttcctcgtcttgcaaagataagcagtgaaaatggagtctggagcatagctgcaggcagggattattccctgtttttagtggatacagaagacttccagcctgggttatattacagtggccgacaggaccctacagaaggtgacaaccttccagagaatcacagtggttctaagactccagtacttctctcctgtagtaagcttggatatataagcagagtgacagcaggaaaagatagctatttagccttggtggataaaaacattatggggtatattgccagtctccacgagttagctactacagaaagacgattctattcaaaactaagtgatatcaaatctcagattctcaggcctcttctcagtttagaaaatttgggcactacaactacagtccagctgttgcaggaggtggctagccgattcagcaagctgtgttacctcattggtcagcatggagcctcattgagcagcttccttcatggggtaaaggaagccaggagtttggtcatcctgaagcattcaagtctcttcttggatagttatacagagtattgcacatctattacaaatttcctggttatgggaggattccagcttcttgctaagcctgccattgatttcctaaataaaaaccaagagctgttgcaagatttgtcagaagtgaatgacgaaaacactcagttgatggaaatactgaatactttgtttttcttgccaatcagacgacttcataattacgcaaaagttttgctaaagcttgctacttgttttgaagtggcatctccagaatatcagaaactgcaggattccagttcttgttatgagtgtcttgctctccatctcggcaggaaaaggaaggaagcagaatacacactgggcttctggaagaccttccccggaaaaatgacggattccttgaggaagccagagcgtcgactgctgtgtgagagtagtaaccgagccctgtctctgcagcatgctgggaggttttccgtgaattggttcattctctttaatgatgccctggtccatgcccagttctccacgcaccatgttttccctctggccacgctgtgggcagagccactgtctgaagaagctggtggtgtgaatggcttaaagataactacacctgaggagcagttcactctcatttcatctacaccccaggaaaagacaaagtggctacgagctataagccaagccgtagatcaggctttgagagggatgtctgatctccccccttatggaagtggtagcagtgttcagagacaggaaccacccatttcacgcagtgccaaatatactttctacaaggatcctcgcctaaaggatgccacctatgatggacgctggctttcagggaagcctcatggcagaggggttttgaagtggcctgatggaaagatgtattctggcatgttcaggaatggcttggaagatgggtatggagaatacagaatcccaaacaaggcaatgaacaaagaagaccattatgtgggccattggaaagaaggaaaaatgtgcggtcaaggagtctacagctatgcttctggtgaagtatttgagggctgttttcaagataatatgcgtcatggtcatggtcttctacgaagtgggaaattgacgtcctcttctcctagtatgttcattggccagtgggtaatggataagaaagcaggatatggtgtctttgatgatatcactaggggggaaaagtatatgggaatgtggcaagatgatgtgtgtcaagggaatggtgtggtggttacccagtttggattatactacgagggcaactttcaccttaataaaatgatgggaaatggggttttgctttccgaagatgatactatctatgaaggagaattttcagatgactggactcttagtggaaagggaacactgactatgccaaatggagactacattgaaggttattttagtggagaatggggatctgggataaaaatcactggaacctacttcaaacctagtctatatgagagtgataaagacagacctaaagttttcaggaagctaggaaacctggcagtgccagctgatgagaagtggaaagcggtgtttgacgaatgttggcgccaactgggctgtgagggcccaggccaaggggaagtttggaaagcatgggacaatattgctgtggccttgaccaccagtcggcgccagcacagagacagtccagaaatactgagtcgttcacagactcagacactagagagtttggaattcattccacagcatgttggtgccttctctgtggagaaatatgatgacatcaggaaatatttaataaaggcctgtgacactcctctgcaccccctgggcaggcttgtggagacactggttgcagtgtatagaatgacatacgtgggcgtaggagccaaccgcaggttattgcaggaggctgtaaaggagattaagtcctatcttaagcgaattttccagctggtgaggttcttatttcctgagctgcctgaagaaggcagcacaattcctctctctgctcctctgccaaccgaaaggaagtctttttgcactgggaagtcagattcccgatctgaatcaccagagccaggttatgtagtaacgagttctggattattgcttcctgtgctgctacctcggctctacccaccgctgtttatgctttatgctttggataatgatcgcgaggaagacatttactgggaatgtgtccttcgactaaataagcagccagatattgctctcctgggctttcttggggtgcagaggaaattttggccagcaaccttgtcaatccttggagagagtaaaaaggttttgccaaccacgaaagatgcttgttttgcctcagcagtagaatgtctgcagcagatcagcacaacatttaccccatcagacaaacttaaggtcatccagcagacttttgaggagatctctcagagtgtcctggcgtcactccacgaagacttcttgtggtccatggatgacttgtttcctgttttcttatatgtggtgctacgggccaggattaggaatttaggctctgaggtacacctcattgaggatctaatggacccctatcttcagcatggggaacagggtataatgttcaccaccttgaaggcatgttactaccagattcagcgtgagaagcttaactaggctgcataacagcttgaaaactggattatctactacagagtgttataacaccatctggagtcttcctgtagtggcaaaaaagaacagtgttgaaattggaaaggactttgtgttatttaggttgttagaatgagccttaccaataataagagccctgagcccagaaaaaaggactgtatagtttaaagggaggattgaaagggaggtaaaaaatcagattagaccagttcttggcctatgataagttccaaaaataccatttatctactatttgaaaaaagaagaggatatcccttcctacagtaaagggtatgtcagctacatgaagttgtaagaaaagcttccagtagagcttcttatattaaagaagttgatggatatttttgaatttctggtttgcctgaatccacctgcagttaccccgatccgtttgcaagaaccagatcgtacttgaaactatagtggccacactctgccttcctgagtcccttccagtcatgtgtgcatcatgtctctttgccaagggaggggagaaaggaacttttaaactgcagttttaactttttctaagctgtttcttgatgggagaggttctgtgcaaaactaccacattctgtccccaaaatgtggaatgcatccaaataggagtcttctgcctcttaacttaaaagaacataggaattttgtttttggtttctttatcatgctacagagagtgaatacactggaattcagacaccgactctgagctgctaggaacctcatttgtccatgtgcaaacgctgtattccaaggcctgtgaatggcagcctgaggaagttttgcatgcaggctgtgttttcgagcaggactaacaactgggaaataagcaaaaaactgcatcgatccccagcctggtgttgttcttccctatacttcacactgaactcaggatgggaagaaaaaggaaacaagctttggctttttccatctcaaaagtattgtggcacctcaacatttcagtgttttgctttttaaaaaatgccctattgtaagttgttggtttatactgtataagtaacactagtagctgttttgaataacataggtgctcttcctcatctcatctcctacaccgtggtgagcatacagagtgtcctgatttgtgttaagtgactgagaagatgttaattacttttgaaaaaggatcatggtttttgctctactttataatcaagacaagtgtttattaaaatactgttttggaatgttggctgtaatgtaacagcaattttcataataaaaggcattcatcttta

SEQ ID NO: 23004 - DNA, 2811 bp, Homo sapiens
cgcgaccacttctacccacggcaggatatggtgtcttgatgatatcactaggggggaaaagtatatgggaatgtggcaagatgatgtgtgtcaagggaatggtgtggtggttacccagtttggattatactacgagggcaactttcaccttaataaaatgatgggaaatggggttttgctttccgaagatgatactatctatgaaggagaattttcagatgactggactcttagtggaaagggaacactgactatgccaaatggagactacattgaaggttattttagtggagaatggggatctgggataaaaatcactggaacctacttcaaacctagtctatatgagagtgataaagacagacctaaagttttcaggaagctaggaaacctggcagtgccagctgatgagaagtggaaagcggtgtttgacgaatgttggcgccaactgggctgtgagggcccaggccaaggggaagtttggaaagcatgggacaatattgctgtggccttgaccaccagtcggcgccagcacagagacagtccagaaatactgagtcgttcacagactcagacactagagagtttggaattcattccacagcatgttggtgccttctctgtggagaaatatgatgacatcaggaaatatttaataaaggcctgtgacactcctctgcaccccctgggcaggcttgtggagacactggttgcagtgtatagaatgacatacgtgggcgtaggagccaaccgcaggttattgcaggaggctgtaaaggagattaagtcctatcttaagcgaattttccagctggtgaggttcttatttcctgagctgcctgaagaaggcagcacaattcctctctctgctcctctgccaaccgaaaggaagtctttttgcactgggaagtcagattcccgatctgaatcaccagagccaggttatgtagtaacgagttctggattattgcttcctgtgctgctacctcggctctacccaccgctgtttatgctttatgctttggataatgatcgcgaggaagacatttactgggaatgtgtccttcgactaaataagcagccagatattgctctcctgggctttcttggggtgcagaggaaattttggccagcaaccttgtcaatccttggagagagtaaaaaggttttgccaaccacgaaagatgcttgttttgcctcagcagtagaatgtctgcagcagatcagcacaacatttaccccatcagacaaacttaaggtcatccagcagacttttgaggagatctctcagagtgtcctggcgtcactccacgaagacttcttgtggtccatggatgacttgtttcctgttttcttatatgtggtgctacgggccaggattaggaatttaggctctgaggtacacctcattgaggatctaatggacccctatcttcagcatggggaacagggtataatgttcaccaccttgaaggcatgttactaccagattcagcgtgagaagcttaactaggctgcataacagcttgaaaactggattatctactacagagtgttataacaccatctggagtcttcctgtagtggcaaaaaagaacagtgttgaaattggaaaggactttgtgttatttaggttgttagaatgagccttaccaataataagagccctgagcccagaaaaaaggactgtatagtttaaagggaggattgaaagggaggtaaaaaatcagattagaccagttcttggcctatgataagttccaaaaataccatttatctactatttgaaaaaagaagaggatatcccttcctacagtaaagggtatgtcagctacatgaagttgtaagaaaagcttccagtagagcttcttatattaaagaagttgatggatatttttgaatttctggtttgcctgaatccacctgcagttaccccgatccgtttgcaagaaccagatcgtacttgaaactatagtggccacactctgccttcctgagtcccttccagtcatgtgtgcatcatgtctctttgccaagggaggggagaaaggaacttttaaactgcagttttaactttttctaagctgtttcttgatgggagaggttctgtgcaaaactaccacattctgtccccaaaatgtggaatgcatccaaataggagtcttctgcctcttaacttaaaagaacataggaattttgtttttggtttctttatcatgctacagagagtgaatacactggaattcagacaccgactctgagctgctaggaacctcatttgtccatgtgcaaacgctgtattccaaggcctgtgaatggcagcctgaggaagttttgcatgcaggctgtgttttcgagcaggactaacaactgggaaataagcaaaaaactgcatcgatccccagcctggtgttgttcttccctatacttcacactgaactcaggatgggaagaaaaaggaaacaagctttggctttttccatctcaaaagtattgtggcacctcaacatttcagtgttttgctttttaaaaaatgccctattgtaagttgttggtttatactgtataagtaacactagtagctgttttgaataacataggtgctcttcctcatctcatctcctacaccgtggtgagcatacagagtgtcctgatttgtgttaagtgactgagaagatgttaattacttttgaaaaaggatcatggtttttgctctactttataatcaagacaagtgtttattaaaatactgttttggaatgttggctgtaatgtaacagcaattttcataataaaaggcattcatcttta

SEQ ID NO: 23005 - DNA, 2663 bp, Homo sapiens
cgcggacccactgggttgccaagctcgcgccggatgcggagcgcggtgctgccggtggagcttcaggtcttgatagactttctgtaaagaaggaatgatttggtgatggagtgttcccactgaccgatggactcaaagaagagaagctcaacagaggcagaaggatccaaggaaagaggcctggtccatatctggcaggcaggatcctttcccataacaccagagagattgccaggctggggaggaaagactgttttgcaggcagccctcggagtgaaacatggagttcttctgactgaagatggtgaggtctacagctttgggactcttccctggagaagtggaccagtggagatttgtccaagtagccccattctagaaaatgccctggttgggcaatatgttattactgtggcaacaggaagcttccatagtggagcagtgacagacaatggtgtcgcgtacatgtggggagagaattctgctggccagtgtgcagtagccaaccagcagtatgtgccggaaccaaatcctgtcagcattgctgattctgaggccagccctttgttagcagtcaggattttacagttggcgtgtggcgaggagcacactctggcattgtcaataagcagagagatttgggcatggggtaccggttgtcagttgggtctcattaccactgccttcccagtgacaaagccgcaaaaggtagaacatcttgctgggcgagtggtgcttcaagttgcctgtggtgctttccacagcttagcccttgtacaatgcctcccttcccaggatctgaagccagtcccagaacgatgcaaccagtgcagccagctcttgattactatgactgacaaagaagaccatgtgattatatcagacagtcattgttgcccattaggtgtgacactgacagaatctcaggcagaaaaccatgccagcactgctctcagcccctccactgaaacccttgacaggcaggaagaagtatttgagaacactcttgtagcaaatgatcagtctgttgctactgaactgaatgcagtaagtgctcagatcacaagcagcgatgccatgtcctctcaacaaaatgtcatgggaacaactgaaatttcctctgccagaaacataccatcataccctgacacccaagcagtcaatgaatacctacggaaactgtcagatcattcagtaagagaggactcagagcatggtgaaaagccagtgccatctcagcctcttttagaagaagcaattcctaatctccacagcccgcctaccacaagcacctcagccctaaacagcctggtggtctcttgtgcatctgctgttggtgtgagagtggctgctacttatgaagctggtgccttgtcactgaagaaagttatgaacttttatagtacaaccccttgtgaaactggagctcaggcaggcagtagtgccattggccccgaaggtttgaaagatagcagggaagaacaggttaaacaggaatcaatgcaaggaaagaaaagttcaagtcttgtggatatcagagaagaagaaacagagggaggcagtcgaagactctccctccctggattgttgtcacaagtttcccccaggctcttaagaaaggctgcacgggtgaaaacgaggacagtggttctgacccccacatacagtggagaagcagatgcgctcctgccttctctgagaacagaagtgtggacctgggggaaagggaaggaagggcagctggggcacggcgatgttctgcctaggcttcaaccgttgtgtgtaaaatgtctggatggcaaagaagtaatccatctggaggcaggtggttaccattctcttgcacttactgcgaaatcccaggtttactcatggggtagcaatacctttggtcaacttgggcattccgattttccaacaacagttcctcgtcttgcaaagataagcagtgaaaatggagtctggagcatagctgcaggcagggattattccctgtttttagtggatacagaagacttccagcctgggttatattacagtggccgacaggaccctacagaaggtgacaaccttccagagaatcacagtggttctaagactccagtacttctctcctgtagtaagcttggatatataagcagagtgacagcaggaaaagatagctatttagccttggtggataaaaacattatggggtatattgccagtctccacgagttagctactacagaaagacgattctattcaaaactaagtgatatcaaatctcagattctcaggcctcttctcagtttagaaaatttgggcactacaactacagtccagctgttgcaggaggtggctagccgattcagcaagctgtgttacctcattggtcagcatggagcctcattgagcagcttccttcatggggtaaaggaagccaggagtttggtcatcctgaagcattcaagtctcttcttggatagttatacagagcaagtatccagtcccgtgtcatgttcaatctctgcagggttattctgccaaggagaacagctccttaatcagaagagactagattagggagagtgatataaggtaatagaaattgcaaagcagtattttaatcttaagccaactatagttctggattgctaaaatttagtcttctctaaatgaaa

SEQ ID NO: 23006 - DNA, 318 bp, Homo sapiens
atagtcttgtttttactgtgatcggtagaagtatgttgtaaaatctcaaaagctatgtaaatatgtacagcaagcagtatgatttatggaaagattactcagattcatgagacctctttgttcttgtctcatttctactaataacaacctgagtgatttttttgaacaaatgccttaaccttctggttaaggttctctgatctgtctaatctggaagttgatgtttacgatctgtctgtttgggccagatgagggaatctggggctctcaaatgtgttgcttaaaccacagaaaatatatatatatatatatatatat

SEQ ID NO: 23007 - DNA, 223 bp, Homo sapiens
agaggcaccactaatgtctatctgttctacccaaagaaaggcaatgcatacaaacgcaattaataaaagagaatttgtaattcgtaggtataaatttattgccaaggtttgcataagaatgcaacatctgccgatttcctgaagtagctacttcagctcagataagtcccaacatacattttctaattcgaacaattcccagttactgtaaaaggcacatctc

SEQ ID NO: 23008 - DNA, 446 bp, Homo sapiens
cagctagatacagagtgtcgattggtgcattcacaaaccttgagctaaacgcagggtgctgattggtgtgtttacaaaccttgagctagatacagagtgccgactggtgtatttacaatccctgagctagacgtaaagattctccaaggccccaccagagtagctagatacagagtgtcgattggtgcactccctccttccaggaattactggaaggagggagtgctagaatgggggtaaaccacaggaactaatttcttctctctgtaactatcagacatcaaagatgcatgttttgttgatattgtgtccggaattggtgggttcttggtctcactgacttcaagaatgaagccacggaccctcgcggtgagtgctacagctcttaaggtggcatgtctggagtttgttccttctgatgttcggatgtgttcggagtttcttcc

SEQ ID NO: 23009 - DNA, 440 bp, Homo sapiens
tctctttgtacacacccattccctagtctgttttgaagcaaattctagacatttctttttcttttaattattttggagatggagtctcgctctgtcgtccaggttagagtgcagttgtgcagtcttggctcactgcaacctctacctccctggttcaagccattctccttcctcagcctcccaagtagctgggattataggcacccaccatcacgcctggctaattttgtatttttgtaagatgacatttcaccattttggccaggctggtttcaaacttctggcctctagtgatccgtctgcttcggcttcccaaagtgctgggattacaggcgtgagccacgatccccggcctctggacatttcagaataatcaaagattcagtcagtgttcagattgccctgataaaatttctccttaatcatctcttgctaactta

SEQ ID NO: 23010 - DNA, 459 bp, Homo sapiens
ccatttttaataagactatatcaagtatcttttgtgtataaaggattttgtgcctttaaatttgctttttaatgataaggtctcaggggtgaaatggaattaaaatgtataacatttgaatttgttggtagatatttttgataaattgattttgctaatgaattatactcccttatatgtcattatcaccatttcatccagtccttagaaacatggtgtgtattctttaaaaaaaaagttgcatttctttcacacataggctactttacatagtctacacagtattgatctattttactgctgtttacctctaaaatatttgtttaaaaaatgaattaactagaaggtggtggttgcacagcattatgaatgtacaaaacgccactgaattgttccctttaaaatggttaattttatgttatgcaaatttcacctcaataaagtgtgtacatgtgtgta

SEQ ID NO: 23011 - DNA, 433 bp, Homo sapiens
tgttgctgtgaacattggtgtacaaagagtgttttaagttcctgctttcactacttttggatgtatgcccgtaagaggaattgctggatcatatggtgattctatctttaatatatttgagaaatctctatacagttttccataccagctgcaaagcagttccagtttctccacatgatcacccacactttacctttttctcttggtttgatcatagccattctagtggcagtgaagtggtaatttgtggttttgatttgcatatccctaatgattggtgatattgaacatctttccatgtgcttattggatttatttatttatttgtttcggtttttttgaaatagggtctcactctgtcacccagactggagtgcagtagcatgatcacagcacactgcagcctgacctcctgagctcaagtgattcttct

SEQ ID NO: 23012 - DNA, 415 bp, Homo sapiens
cctctaggctgtgggacttcctgacctgggggcaggtgctacgagacccctggggctgcaccccactgttctgtggactcaccccactcaccccattcacccctgggcagccggttgttcacggtcacaggtctggacccaggatgggggacagagtaataaaaagtaagaagacattctgggctgggcgtggtggctcaggcctgtaatcccagcactttgggaggccgagggaggtggatcacctgaggtcaggagttcaagaccagcctgaccaacatggtgaaaccctgtctctactaaaaatacaaaattggccgggcgcggtggctcatgcctgtaatcccagctactcgggaggctgaggcaggagaatggcgtgaacccaggaggcggagctttcagtgagctgaga

SEQ ID NO: 23013 - DNA, 862 bp, Homo sapiens
tgcactcccgcctgggccacagagcaagactccgtctcaaaaaaaaaaagtatctttaatttttggagtgtattgaagctcttgtgggttgaagaggtggagctgaaggatgtgggatggaggcagcctggcttagttgttgggtggttagggggttgcgaagcgaagagagggtctgggaggctggttggctccacagctgtttcacagacattttgtttaattcttagagcaattttgtaaaatcagtgtcatcattcccctttaaccgttggaagacatgagtctgagttgaagttaaagagaagcttctgattctaagtcaagtctctctctgttgccttcctccgggcaggagggctgtgatgtatcctggcgagcctgggggcgatccagtcttaggaggtgggaggcctgcattgcagagagcagaggtgaatgggcctcccaggttgagcttgtgatgggcaagtagactggcacgggatgaggttggcagtggggagaggtaggatgcagtgcggggaaatgggcctttccacctgagaaaggcgagtgtgtctgcgtttgataatcctttgatatttgcgtatctgttattttcaagaatcacatttcacatagaaagccatgtgacagtttttaaattaaaaaaaaaaaaggtagaaattccagagatcttgtcttaggtatttactgccagctacaaacaaaccccttttgaatttacttaacaaggaatttaataaaagtagctctggcattcagccgcagccctgcccacattcctgttagctgaggtcacctgactctgcttgtcgtttttgcacaggcagacgtgtgcattctggagagcagggag

SEQ ID NO: 23014 - DNA, 399 bp, Homo sapiens
gaaatcggaaacaactaagatgccttctaccatggggggaagataataaatctgatatttaatattgataaattaagaaatatcaatataaacattttatttagaaagatggaaacaggctgggtgtagtggatcacacctgtaatcccagcattttgggaggccaaggtgggtggatcacctgagatcaggagttggagaccagcctggccaacatggtgaaactccatctctactaacaatacaaaaattagctgggcatggtggcgggcgccagtaatcctagctactcaggaggctgaggcaggagaatcgcttgaacctggaaagtggaggtttcagtgagccgagatcgcaccattgcactccagcctggaagacgagtgaaaccctatctca

SEQ ID NO: 23015 - DNA, 421 bp, Homo sapiens
gcaaactccatatgaaaggctgagggtggttgccatgaacacaattttagattatctccttcttcattcaagctttcagaaagagcttgccaccagatttgttaaaaggatcccagctcacgtgagtgatttcttggcacaaaaagccttcctttcctgttatattacagcttgtgtgccgcatttcttcaacaggcaagttctccttcacaaacagaaagcaagctcgtgcaaccgatggcaatcctaaagctacatttagatagcccaattcctcagctttagctttaaaacgattagaatcattttccctcaaacatctttattgcttcacctgaactggccaatattttgtaagggttttttctattctttctttttttttctttttgctaataaggctaataagaaaacaatcttc

SEQ ID NO: 23016 - DNA, 483 bp, Homo sapiens
attttcagagacttacttgttttaaataattttcaccactgaaatggttgtttcactgtggaaaaaatccatcgatttccctatcctgccactctagaagccccagcaagcaatactttccacatttatttgagattgatacagttattatttcaaattttagttgaagaaacaaagttgagagagaatacgtaatttgcttgtcactgtgtttcttaatttagtataattctcaagcctatggtattaaattcaataagtacttagggggaaaatagatgaatgaacaaatgtttctgaacattttttagaaacgctttaagtccactaattagaatcaaatatctttaagtatttttaccaaaagaaaaaaaaacagatgaaatatatgccaatgtcatgagttgagtcatgatactataattataagccagagattagtgagcagatatgggttcttttggtcctcttttagaatatagt

SEQ ID NO: 23017 - DNA, 2321 bp, Homo sapiens
gaaaaggtttgacatgaccagattagcagtcaagaaaggtgccccactcactgggacagagaatgcgtgggaaggggtcaagactggcagcaagatgagctatgaattgttggtggtcatcgaggagggagatgagggtgactggactagggaacttcctgtggtgatggagaggagtcagtgtcaaggtctcacttagaaaaacttgggaggtctaactggccaggctcggtcaactgtgggggtggtaagaggcagcaatcaaggatggctttcaagatctttggcccaagctgctgggtagagggtggtgcctgtcactgagtcaggcagcacaggaggaggggcaggcgtgctgagtggggatgggtgcgttcactttgggacatgctgagcagtacttgctatgggactcaacgacttatgacttgaagacttcgcagagctgacctaacctccctgtgcttaccgtgcctcatctgtaataggagaataagaataattagaaaaaataactaattagtttcatttgttgagtctaggagaatgttctccttttatactgcagagtggtattttcttgtcaggtcttcccaagtaaaatgggaatgtctcgacttgcccatacagtggcttgattttacctgtctgctttgggtatcaccaccattcggcatgtattgccaatactaaacaaataagtaaatacataaattcaaagtaacaggtgtttattatcacgtgtgtgctgtaatagcccatcagcctgtccctcagacaaataaactctctttaaatcttctaaacttcctcttgaagcccacctctccctccaggggctggacagggcatttgggacccaggatctctaacactctcttctctgggaagccatctcccactgcccaggatgctggatgggaggtgagtgcaacgggcctgtggggttgtcagttggcggaagaaatctgtagatccagggagagaatcgagccacatgtgtggatttggaaatgacagtgtatggctgcacagcacgaaggggatgaagtcacagacacctggatttaaatcgagactccaccatttatttcttgtacgactttggggaggttacttaatctctttgtggctcagttacttcatttgtaaaatgaaatgataatattctgggagaatggttcatgtttccttccttcataaactgctgttcacgaggcggcttcttccagggttaaaaaggaatctactatccatgtatctgctaggacagacattgttgcgtgtcacttgactcctgaaatacgccacggtaaagaaatctctgtacactttcgtgttctgggaagtcactgaccacacaggaccaattattctccatgagacttagataagggatgctgtctgcccactctgtgccgtgactcccagatggcagacaccaccagtccttgttcttttgtctcatgaatgtgttgtaaccaagcgagttatagagaaacgccacacttttgagacaaattaaggggacctttattagctggcgacctacaggcagctaacgctcaaaattctctcggccccaaggaaggggctagttttgtttttataccgtggtctaaacaggggaggggggagtttagctgaagcaattttacagaagcagaataggcaaaaagttaaaaaaaattaattggttatagaagcagttacaaaaaataaacagttccaggtgcaggggcttaaactatgattaagagataaatgcaggggcttttaggtaccttccaccgagcacattcccgagctgttggtacagcctgcctcaatatcttaccagcaggtgtattcttggatgtgcttggactcagcttgcactagttattcccttaagggggataaagggggctgcaagtgaagaaactaaaatggagtctgtccggctctctctgctaggaaagagtcactcaggttaaaacaaggtagggtatcacaaatgattcacttagacgggaagtctgtcctcctaaaagtagctaggcacagagagaaacattccctgttcagctggctgagacttccgctgattaaaaaaaaaacaaaaaaccctgccccataaatctccccactgaaaccggtgtactccttcctatgaaagtaaaagacacccccgccccgccccggttaccccaacagtgtgatttccacttctggggcgctctccctaaggcagtagcctgaataatttcaatgtattggattgtttggtttctgtctttaccaaggtgcatttatcattcatgcaaaaacagtaaaaaaaa

SEQ ID NO: 23018 - DNA, 366 bp, Homo sapiens
tggaaaggagaacgctcagaggaaagtgagcaaccatgccctgtaaggcacgattgaatgtgaagagcccggtacagtgcctggcacgaagaggcacttgatacatatttttgaatgaattaatgaactaatgctctctgaattatctatttgtgggtttttctagactcccatctccacatcaggagatgtcctatacttagctggtgtcagaggatttccaatagaaaaattttttcagtgtatttaaagatgtcaccactggtgtcaaatgaagctatggccggccatccatatgaagggacaagggctggatcgggagccctgaacgaaggagcatctgctggcttgtcctgagatacctgt

SEQ ID NO: 23019 - DNA, 405 bp, Homo sapiens
attgatgacacgtaccttcttttattactgggtcctcagtttgtattactggggtcctcaagttacagttgctgtggctggttgtcagcaggatgtgcctatgcaactagtcccccaagaaagcctcagaccccaagacccaaacaggcttccctgagcagagatatttcacacatgtccctgcagtttgctgccggaagacacatcctgtgtggccttggacaagacttgtgccagacctccctgaacttgccgatgtacatctttttcctgctgcttttgtgttctttactgtaacaaactttagccacaagtataatttgctcttgggagtcctagcaaaatcaccaaacttggggtggtcatgggaataccaaaacaggagagtatatgtttgacaaatta

SEQ ID NO: 23020 - DNA, 353 bp, Homo sapiens
ctccaggctctcagggcattggagcctgttcctggtacatccttctactccaaataccaagtacagtgcttggaacatggtggcagatctttaaaattgtgtttcttttcttttttctttttttttttttttttgagactgaatctcgctctgttgcctgggctggagtgcagtggcatgatctcggctcactgcaacctctgcctcctgggttcaagtgattctcctgcctcagcctcccgagtagctgggactaccggtgtgtaccaccaagcccagctaatttttgtatttttagtagtgacggggtttcaggcctgatagggaccctcagaattgtcctgctgcagggc

SEQ ID NO: 23021 - DNA, 262 bp, Homo sapiens
aatctcctcttcccctaacttggaaagcacctcttggtcctctgaaattctaccttacttgatagagagtgaatatctcacatggactgcatttatgcaccaaatgccttatctccttttttcactgcactttctttttctctaaatacaagctctggcttcttctatctttggattgcctaaagtcccttacagtttgaagatgctaaatatttattgtgtgggataaatttatctcgcaaagagcaatgtgttgatggca

SEQ ID NO: 23022 - DNA, 481 bp, Homo sapiens
aatagggtatcactatgttgtcctggctgctctcgaactcttggctttaagtgatcctcctaccttagcctcccaaagtgttgggattacaggcatgagccacgcaccaggccagtgtgttctttaccatctttaaatgaaaccttccctcaaccttccattcctctacggctaccactaatggtataaacttgccttttatttatcacatcatttgcttttctgttatccttccacatatactgctctgcagaaatcacgctcagtaggaccaccagtgacctcttcattgttaaacacagtggtgccaatcagccctggccatcctctcaactgacttgaatcagctgatagcatttgatactgttgatcatttccttctccttaaaattcccacttttcctggtctttggcagctttactccctcccacattttcttcagtctttctggatgcttctcatcaggctccttttcctgcc

SEQ ID NO: 23023 - DNA, 648 bp, Homo sapiens
attgagaagttgccgtgggactagggtgccaagactgctgagattctggcagaggcactgccattggcacccctggcccagacagtgtctgctgtgctgtccctggaagctggagctccaacagggaatattggtgtagctgtgcataggccataagccacacttgagccagtgggcagggagaaggaatgtcattctcccttcaccactggggaaggaaaggggaaagggctcaagttatcataggggcttacatgctgagcagctataacctaggtgttcagaacacctggaagatgcatttatttaggggtcacaaatagtgaaattaatatttgaggaatatcagtcacgtgttgtgggcttttatccttaacgtttaatttttacaatcttgtgtaaaaatttatccatgataataacataacttctttaaggttggagtggctggcaagagcagagccttaatttgactttagctctggctggtctggaagcttttacttttttgttaatcccacttcctcactctgtcattcagcattatcatgatcgtgaacaaaattgtactgagaaagtttgtataagtgatatgaacggtattgtattgaacatccattaaagggttgctacactttaaaaaaaaaa

SEQ ID NO: 23024 - DNA, 3622 bp, Homo sapiens
  misc_feature (386)..(386): n is a, c, g, or t
gcgagccttccatggtgcagcgcatgtgggccgaggcggccgggcctgctggcggcgccgagccgctgtttccgggctcccggcggagccgcagcgtgtgggacgccgtgcgcctggaggtgggcgtccccgacagctgcccggtggtgctgcacagcttcacgcagctagaccccgacctgccgcgcccggagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtngagcacctggtgccagccttccagggcagcgacctctcctacgtcaccatcttcctgtgtacctatagagccttcaccaccacccaacaggtcctggacctgctgttcaaaaggtacggtagatgtgacgccctcacggcctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcaccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctactgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctactat

SEQ ID NO: 23025 - DNA, 1189 bp, Homo sapiens
taactaacggctaggtacgaggctgggtggcggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctactgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctactat

SEQ ID NO: 23026 - DNA, 1184 bp, Homo sapiens
aagatagtcatagtgcgaggccgggttgtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctactgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctactat

SEQ ID NO: 23027 - DNA, 3576 bp, Homo sapiens
  misc_feature (1360)..(1360): n is a, c, g, or t
  misc_feature (1507)..(1507): n is a, c, g, or t
ttggggaggggcaatatttatttgttgtaaatagcaaatgctagacttgaatattatattaaaatcctgtttctactataaaaaaaaaaaaaaatgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaaggtgactgcctgcccttctccccaatatcctttcccatctccccactccaaatccatgcatggggccaggaagccctggatcctgaacacagcttctagaaggttccccatctggcagctggcctggggtgcccccacagggcagtgggatctgctgatcttaccgtctccctcagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtaagccggcgggggtggcctgggtgcctccctccactggcggcaaatgcaccctgaacacagtgcaccatccctgccctnccggggtctaccttgtagttggcggggaaggacagatgtcagccaggtacagaaatgaagaaggtagtgatcagggacaaggctggcctgagggcagagggggaggaaaggagcagccgtgcaaagcccccaggagctgaaggggcngtgctgtaggggaggtgaggtcagggaagtatccagggcctggccacataggccctgagccctgccaggacctcgactttctcggggaggaagacaggagcaatgatggctggcttctctgtctggcgtgggctggtaccagagccgcaggggtgttggttaggaggccgctgtggcaaccaggctgggagccctggaaggggccagcagggtcagagtctagacaggatttggagacagcagatgggaattgctcacagaatgggtttgcctgggggctctttcttcatcctccaggtgtcctgcgacagatgaaccatttgtaacccccaccctctgtaccccagccctgggtcaggtgccccattattcacacacgctcctgacccctcattgccaggagctagcatggttgtcattaagcagtcacctgtggccctatgtccgagttccgcctgtgctctggccctcagggtcaaggtagcaggggcctggcctatgctgaccacactgagcatcctggccggcccctcctttcttacctccagggcttggactagggactgtctgttccccaggctcagtgatgctgttatcctggaggggcaagtgcttctcaaggaagtgtgggaggagggaacagtctcttacaggagaagcagggtaggcactgctgggacagacccctcctcattccatggaggcctcacatggggaacagaaggacggaggcctcacttggggagtaggagaatgtgacaaggccctctccggacccagcacctggccagaggctgtgagtgcctgtgcttggtgctgaggggactccagagggtccttggccactgcactctgggggagccgctccagggtcttttccctgatggtccatcccccgccgcgatgcaggtggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctactgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctactat

SEQ ID NO: 23028 - DNA, 2261 bp, Homo sapiens
ttggggaggggcaatatttatttgttgtaaatagcaaatgctagacttgaatattatattaaaatcctgtttctactataaaaaaaaaaaaaaatgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctactgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctactat

SEQ ID NO: 23029 - DNA, 6422 bp, Homo sapiens
  misc_feature (386)..(386): n is a, c, g, or t
  misc_feature (2721)..(2721): n is a, c, g, or t
  misc_feature (2868)..(2868): n is a, c, g, or t
gcgagccttccatggtgcagcgcatgtgggccgaggcggccgggcctgctggcggcgccgagccgctgtttccgggctcccggcggagccgcagcgtgtgggacgccgtgcgcctggaggtgggcgtccccgacagctgcccggtggtgctgcacagcttcacgcagctagaccccgacctgccgcgcccggagagctccacgcaggagatcggtgaggagctgatcaacggagtcatctactccatctccctgcgcaaggtgcagctgcaccacggaggcaacaaggggcagcgctggctcgggtatgagaatgagtcggccctgaacctttatgagacttgcaaggtgcggaccgtgaaggctggcacgctggagaagctggtngagcacctggtgccagccttccagggcagcgacctctcctacgtcaccatcttcctgtgtacctatagagccttcaccaccacccaacaggtcctggacctgctgttcaaaaggtacggtagatgtgacgccctcacggcctcctctagatacggctgcatcctcccctattccgacgaggatggtggaccccaggaccaacttaaaaatgccatctcctccatcctgggcacctggctggaccagtactcggaggatttctgtcaacctccggactttccctgcctcaagcagctggtggcctacgtgcagctcaacatgccaggctcagacctggagcgccgtgcccaccttctcctggcccagctggagcactcggaacccattgaggcagagcctgaggctctgtcaccagtgccagctctaaaaccaactccagagctcgagctagctctaacaccagctcgagcacccagcccagtgccggctccagccccggagccagagccagctccaacaccagctccaggttcagagctagaagtagctccagcaccagctccggagctccagcaggctccagagccagctgtgggactagaatcggctccagcgccagctctggaactagagccagctccagaacaggatccagctccctcacaaactctagagctggagccagctccagcaccagttccatcattacagccttcctggccttcacctgtggttgcagagaacgggctgagtgaggagaagcctcacctcttggtgttccctccagatctggtggcagagcagtttacactgatggatgcggaactgttcaagaaggtggtgccctaccactgcctgggctccatctggtcccagcgggacaagaagggcaaggagcacctggcgcccaccatccgcgccactgtcacccagttcaacagtgtggccaactgtgtcatcaccacctgcctcgggaaccgaagcacgaaagccccagacagggccagggtggtggagcactggatcgaggtggccagggagtgccggatcctcaagaacttctcgtcactgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaaggtgactgcctgcccttctccccaatatcctttcccatctccccactccaaatccatgcatggggccaggaagccctggatcctgaacacagcttctagaaggttccccatctggcagctggcctggggtgcccccacagggcagtgggatctgctgatcttaccgtctccctcagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtaagccggcgggggtggcctgggtgcctccctccactggcggcaaatgcaccctgaacacagtgcaccatccctgccctnccggggtctaccttgtagttggcggggaaggacagatgtcagccaggtacagaaatgaagaaggtagtgatcagggacaaggctggcctgagggcagagggggaggaaaggagcagccgtgcaaagcccccaggagctgaaggggcngtgctgtaggggaggtgaggtcagggaagtatccagggcctggccacataggccctgagccctgccaggacctcgactttctcggggaggaagacaggagcaatgatggctggcttctctgtctggcgtgggctggtaccagagccgcaggggtgttggttaggaggccgctgtggcaaccaggctgggagccctggaaggggccagcagggtcagagtctagacaggatttggagacagcagatgggaattgctcacagaatgggtttgcctgggggctctttcttcatcctccaggtgtcctgcgacagatgaaccatttgtaacccccaccctctgtaccccagccctgggtcaggtgccccattattcacacacgctcctgacccctcattgccaggagctagcatggttgtcattaagcagtcacctgtggccctatgtccgagttccgcctgtgctctggccctcagggtcaaggtagcaggggcctggcctatgctgaccacactgagcatcctggccggcccctcctttcttacctccagggcttggactagggactgtctgttccccaggctcagtgatgctgttatcctggaggggcaagtgcttctcaaggaagtgtgggaggagggaacagtctcttacaggagaagcagggtaggcactgctgggacagacccctcctcattccatggaggcctcacatggggaacagaaggacggaggcctcacttggggagtaggagaatgtgacaaggccctctccggacccagcacctggccagaggctgtgagtgcctgtgcttggtgctgaggggactccagagggtccttggccactgcactctgggggagccgctccagggtcttttccctgatggtccatcccccgccgcgatgcaggtggtgaccagccaagataaggctccggctgtaatccgcaaggccatggacaaacacaacctggaggaggaggagccggaggactatgagctgctgcagattctctcagatgaccggagtaagtcagaagaccagagggcgatggcagagggggcaggtccacaccactccccagccccaggttggaagcctttggccccagaaaattcaccagcagagtgtgggtagacactgtggacagggcagccctggctgcccccattgtctgcttgctgtccccagcaaccactggacctccccagtgtgtgcccttccctaggcgtgaacaggcagttcaaagctcacatcagtgaggagcaaagagaaaaggcatttttcactgggacaggttagccacgtggcccactggaagggacgctttctggctaagacaagaaaacatgtgctctacaaagaatggtgacagctgtggaccaaagtgtcaagtgttaaaatccatgagtgtgtgattctaaaagcagaacaggctactaggaggccaactcagtattctagaaactgggaaagtgtcaagaaccagtgcaggctcagagtggggtatcctgggcctggagacgctgggcaagctccttaagccctctgtgcttgtcttctcatcccccaaatggaaatgaaagtagccagtgtgttcatcatatatgtaaaaatctatatgtatgtatatatgtgtatatatatgcatgtatatgtgtgtgtatatatatgcatgtatatgtgtgtgtatatatatgcatgtatatataaagcatctatgtgcaccataaaagttaactataaatactatcatcgctgttttctttccagtgagctgaacaccacctcccaccattagcccagacagtaagcaatgactcctgtgatccctagaagttacagtctaaatcctctggcagcttcttgcaccatttcggttaggtgggcagggtaggcgggacccccatcttacagaaaaggaagactgaggcctagagaggttaaagatgacgaaaagccacacgatgtcggcaggagcacaaatcgagcccagctctggtttatagcaggctgtgggccagaggagatggtgggaaatggagccaaaaggaagtgcttgccgggtgccagggttcaaggagtacaggcctccctggaacgggcgccagagccctggggcaggcctgtcctttcctggtccttggatcccttgtcctgagtagggcaggattctgggaggtgacctggattctagaaagcctgttccaggtgggcagccagcactgcagtatgggcaggacggggtgaccctctgccagctcaggccaagccggggggttctggagtcagtccctgtttaaacaagagtcatcaggttttgtgaggacctcagcagagtctgtcctcaggcaggagtcattgagaggggtccttggagttctggagctgtattggaggggatctgaggtctgtggctcaagacagtccttgtatgggctctcaagcggtaggggtatcctgcagggcccccaggagcatccctgatcacccctctgcccctccccaccagagctgaagatccctgaaaacgccaacgtcttctatgccatgaactctactgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctactat

SEQ ID NO: 23030 - DNA, 3460 bp, Homo sapiens
  misc_feature (1360)..(1360): n is a, c, g, or t
  misc_feature (1507)..(1507): n is a, c, g, or t
ttggggaggggcaatatttatttgttgtaaatagcaaatgctagacttgaatattatattaaaatcctgtttctactataaaaaaaaaaaaaaatgtatgccatcctctctgccctgcagagcaactccatccaccgtctgaagaagacgtgggaagacgtttccagggacagtttccggatctttcagaagctgtcagagatcttctcagatgagaacaactactcattgagccgggagctgctcatcaaggagggcacctccaagtttgccaccctggagatgaaccccaagagagcccagaaacggccgaaggagacgggcatcatccagggcaccgttccctacctgggcacgttcctcaccgacctggtgatgctggacactgccatgaaggactatctgtatggcagactcatcaactttgagaagaggaggaaggagttcgaggtgatcgcccagatcaagctgctgcagtcggcctgcaacaactacagcatcgcgccagatgagcaatttggggcctggttccgggccgtggagcggctcagcgagactgagagctacaacctgtcgtgcgagctggagcccccatccgagtcagccagcaacaccctcaggaccaagaagaacacagccattgtcaagcgctggagcgaccgccaggcccccagcactgagctcagtaccagtggcagctcccactccaagtcctgtgaccagctcaggtgtggcccctacctcagcagcggggacatcgctgacgcgctcagcgtgcactcggccggctcctctagctccgacgtggaggagatcaacatcagcttcgtcccggagtctcctgatggccaggaaaagaaggtgactgcctgcccttctccccaatatcctttcccatctccccactccaaatccatgcatggggccaggaagccctggatcctgaacacagcttctagaaggttccccatctggcagctggcctggggtgcccccacagggcagtgggatctgctgatcttaccgtctccctcagttctgggaatcagcctcacagtcatccccggagacctccggcatcagctcagcctccagcagcacctcgtcctcctcagcctccaccacgcccgtggctgccacacgcacccacaagcgctctgtctcagggctctgcaactccagctccgcgctgccgctctacaaccagcaggtgggcgactgctgtatcatccgcgtcagcctggacgtggacaatggcaacatgtacaagagcatcctggtaagccggcgggggtggcctgggtgcctccctccactggcggcaaatgcaccctgaacacagtgcaccatccctgccctnccggggtctaccttgtagttggcggggaaggacagatgtcagccaggtacagaaatgaagaaggtagtgatcagggacaaggctggcctgagggcagagggggaggaaaggagcagccgtgcaaagcccccaggagctgaaggggcngtgctgtaggggaggtgaggtcagggaagtatccagggcctggccacataggccctgagccctgccaggacctcgactttctcggggaggaagacaggagcaatgatggctggcttctctgtctggcgtgggctggtaccagagccgcaggggtgttggttaggaggccgctgtggcaaccaggctgggagccctggaaggggccagcagggtcagagtctagacaggatttggagacagcagatgggaattgctcacagaatgggtttgcctgggggctctttcttcatcctccaggtgtcctgcgacagatgaaccatttgtaacccccaccctctgtaccccagccctgggtcaggtgccccattattcacacacgctcctgacccctcattgccaggagctagcatggttgtcattaagcagtcacctgtggccctatgtccgagttccgcctgtgctctggccctcagggtcaaggtagcaggggcctggcctatgctgaccacactgagcatcctggccggcccctcctttcttacctccagggcttggactagggactgtctgttccccaggctcagtgatgctgttatcctggaggggcaagtgcttctcaaggaagtgtgggaggagggaacagtctcttacaggagaagcagggtaggcactgctgggacagacccctcctcattccatggaggcctcacatggggaacagaaggacggaggcctcacttggggagtaggagaatgtgacaaggccctctccggacccagcacctggccagaggctgtgaccagccaagataaggctccggctgtaatccgcaaggccatggacaaacacaacctggaggaggaggagccggaggactatgagctgctgcagattctctcagatgaccggaagctgaagatccctgaaaacgccaacgtcttctatgccatgaactctactgccaactatgactttgtcctgaagaagcggaccttcaccaagggagtgaaggtcaagcacggagccagctccaccctccctcgcatgaagcagaaaggactcaagattgccaagggcatcttctgagggcatcctcccagggtctggctggctggtagccaagcacttatggaccagagtggcccaggccagctgggcgccttcctcccacctgccagcccagggtaccccagactccagtttcatcctgaacctctcccgctgctgggattgacgcctgccattggtcaggctgacctggcctcccgtggaccactcgctgccttaggtgccttctgctctctggaaccagaggactagctgacttttgccaaggagcagtgccaacgggcatggcatggtgccctgcctgcccccgggcgccacctctgtacacttccctgacaccttcccaggtgtgggtcactgccacctgtgcccatgggcaccccagagcacccactgtgaccactgcagttctctcatgcccacaggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaatatttgtataaaaagcaaaaagaaaaaaaaaatgtttgtttactgattggggaggggcaatatttatttgttgtaaatagcaaatgctagacttgaatattatattaaaatcctgtttctactat

SEQ ID NO: 23031 - DNA, 488 bp, Homo sapiens
aaagtgcagttaaatggtggtgctgttgttaaaaggtggaagatctcataggcttctagccagggccgagttatctccccagaagagctctgtgcctctgtggacccacttagtaagccattgtactggagttgctttaaggctccctacagccctgatgacctgtgctcagcattctttcagctttctgcctctttgtatatctttcaagcttgagaaagatcctctatagatcaggaagatgtgtccagtaagagatttgacctttgctggtttcttgacatgggctttgatgaaacccttttagcatgctcactttagatgattcttctcaagggggatgtcagccccaggaccccccagacctccatccctaaacccgggcttgcgtgtctggcaacccagggccagcacttcgttcttacactcagctgagtggtagtcctgccaccattgctgtggctctgggactatagcctctgccttag

SEQ ID NO: 23032 - DNA, 272 bp, Homo sapiens
caaacccagcttctcagagggaaacatttcatagggacttatgaacagaagtgatgtctaggcagccataagaatcgtagatccccgcatccgccctttataaatagcaagcttttagggtaaagacgtgcagctagtcatgtcttcagactttcttccaagattcatgaccactggggaggttaggtaagcatctttatgagggtttatctgtgtacagcgttgcttcaagaccttactgcagaatacctttgtgtgtggagatcaaacat

SEQ ID NO: 23033 - DNA, 402 bp, Homo sapiens
gaccagtcctggtaccaattcttcctagtcaggagacaggagaaacctacttataacaaggagatctaatagaaagtatttaaaaacacgtactggagaactagaagggcaaagaggggatactgacatattacacaggtagtaactggaagatgcagtgaccatctctatggctggtggtgaaaaagggaaagcattaggattattcaaattttaagcttggagagagtctaaagatgtggaatttaatttagggaggagccctttcttggctgatactggagccttgaactcagaatgaacctcagagagctgggaatagactttttgttttttttgagacggaatctcgctctgtcaccaggctggagtgcagtggtgcgatctctgctcgctgcaacc

SEQ ID NO: 23034 - DNA, 172 bp, Homo sapiens
catcactctgttctcctgctgcactccccgtgctgagatagtgaaaatagtagtcaacaaatactgagggaactcagagaccagtgccggtgcaggtcctcgcatgctgagtgtgccagtcccctgggcccactgttctttctctatactttgtctttgtgtcttatttctt

SEQ ID NO: 23035 - DNA, 448 bp, Homo sapiens
agagggatgctggaggcaggagaagggagaagagctgtggagcttcctgttttgcttgttgcccctgtaagtggtctggcctgagatcccagtctcttgggaccttacagtttctatgatgtggtcaccgtttggtccagctgcccagacttgctaaacatcccttgggctggtcctccaggccctgagataccctccaaaggattaggggtgccctcttctcccacagcagcttggaaagtaccataaattcacttgttctcttaatttgtgaaacctcctggacttgtctatgaagagctcctcagaaacaccctcttcattacaatgttaaattaaaatttagtagacgaggcacatagcagaataaactttcaattaaaatatacacactgcgatggtgaagggagactggagagaacttgccggcatctttgccgtgaatgtg

SEQ ID NO: 23036 - DNA, 390 bp, Homo sapiens
gaaaatcttcacaattctttgtacagaaatctcttctgtacaaaaatatattttaaaagtgtctggagtttctgttgttattatgcttacacgtcattgtttgaatcaatctgataaagtattttttaggcacactaacattattttcaagattaaaatcaggtcaagacttttttactatatttccttttatgcaaacatttaaataaaatttctaatgtttcccttttttggcagatgctgacaatataaattataaacttttagaatagaataaaatcctggaattactcagatatatttgtaagtttcatccaaacatttataaatttatgtcagatagcagaagaggattgtgaaaatattttaactttcaccaaaagttaaagc

SEQ ID NO: 23037 - DNA, 633 bp, Homo sapiens
ggagaaggtggggagctgcttggggagtcagggaatctggcagttgggctcagagctctgattttatcaagatgtgattcttctctccatgcctcagtttcttcgtctgtgaagagaggaccctgactcctgctctgccgtcctcctggggcatggtgctgaggagtgccaggccacctgacagcccactgattcatctctttgcatcttagtttcttttaagatgtaaaatggggatagtaagaatagttacctcttagcattgctgggcagagtgagtaagataatgatgcacattgagtttagctcagtgccaggcacataataaggataaaggttattggtgattaaaaagacaaagcagcagtcagccttttcaggttgtgaagaaaataccttttttttcccccttctttttactctcacttgctgaaaagctctcaagtgtttgaagtggggtttggaatcctgcatcaccaactcactgactggtactgaggcctgagacaggttagttttgctttaaacattctgaagcctctattttctcatctgcaagatggggagctaataatgatagtctcccaaggtggtgcagagtcagagagctagcatatagaaatcatctggcat

SEQ ID NO: 23038 - DNA, 659 bp, Homo sapiens
agaaaggtcttgaacttctacttcagtgcaggcttcatgtaccagatgcacaaatgagcattagtaaatggagctggttcttagtagaaaatttccattaatccaacaccgagtgtagaagaatctctgtagtcttgtaaatagacttaagaataattattaagaattaagaattattgtgattaattaattaattaaaatgatactggttttgccaccatttcttcaggtatttctcttaagatgaaactgttttgtttttctgtttctaccagtcctgacttttgatatcaatggaaatcagcttagcaaaaacaaacaaaacaaaacaaaacaaaacacccctttgagctatctctctccatataccacttaggggtgagttcaaaatgcagggaccccttctgtgtattttacaatccaagactgaaaatacaaatgaagaggaacacagagcaatcataaaacaggcataccacttgacaatgcagctagctgccccaccgactggagcacctcacgtgtgtgcctgctaccttcacttccaaatatctaaatagtgccctgcaaaaaactagaaacttggggaacatttgtggaataaataaatgcttttgataatgatggagagtaaaagtggaggaaggaggagaacaggc

SEQ ID NO: 23039 - DNA, 744 bp, Homo sapiens
attggatagagatcctattgaatgcagtaaaccaagtgtgatatagaacattaaattaaaaagcaagacataactatgggaaaataattttttgtttttgttttattatggagattgaattttattggtgtttctgtatctgataaaatcataagtttttaaaaaaataataatttgcctgtcagtaattgattttctattgttgaacctattctgggctaaatgagcaggcatgatacaacagcctaggcatgatacaaggatgactaggaagaactagaatgatgatgatgacagtaatagtggaaaattgagagttataatggtagatagaagggagaacgtgtttaaaaagggcattaactttgatattaaatgctttaaatcagaagttttgtgattgcattaccctatcagtgaaagaattgagtatgtacccccagtgtttgtgtttatttaaaactgcatagtactggctgggggcggtggctcatgtctgtaatccctgtactttgggaggccatggtgggtgggtcacttgaggtcaggaccagctgggccaacatggtgaaaccctgtctctactaaaaatacaaaaattagccaggcatggtggcatggccgatagacccagctactcgggaggctgaggcacgagaatcacttgaacccaggaggaggagtttgcaattagccgcgatcgcgccgctgcactccagcctgggagacaagagtgagactgtc

SEQ ID NO: 23040 - DNA, 361 bp, Homo sapiens
taaaagaaagcacagtttgtgccaacatttattaactcgataaagttaaaaaagctatgatatgtatttcttggttattgaacaatggaacagacacattatcaacactgaataatttatagacattttacactgagaaaccatttgttggaaaaagagtttcaaagtggaatttttttaagatgtaaaggcattttttgggggtggggtggggagacaggatcttatgctgttgcccaagctggagtgcagtggcatgatcttggctcactgcattcttgaccccaggaggcggaggttgcagtgaacggagattgcgccattgcactccagcctgggtgacagaaaaagactctgtatg

SEQ ID NO: 23041 - DNA, 1961 bp, Homo sapiens
  misc_feature (512)..(512): n is a, c, g, or t
tggcttctcactcggctccttacacaagaggcatttttttaactgtctctgcttaaaacaaggtgtttttgagtcagcagccctttgggtgggtctcgtcctcttgggcacccgacacccaccccacggcgggagccccaggtggccccggaggccaccgggaagcgtgaactacatctcccagggttccccggggcggaggacgcccacccggattggccagggttcgctgacgctcagtgttttggcccggacggtcacatgtttcctttgttgtgagctgcggcagagactggtggctggaggagacgccggcgctggagagtgcgctgcgccgcccgccgctgagggaccgcggggttagccactgctggctgcttccagtgttcgccgagaggtaccgggggtgacagctccgggaccggccgaaaggcgaggaaccggtgtggaaattaaaagaacacacatattttgactggggctttgatcaaccaaatgctaaaaagccacanaaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagctgaagctatggaatgttttttgcagtatgtttatactggaaaggtgaagatcactacagagaatgtacagtatctctttgagacatcaagcctctttcagattagtgttctccgtgatgcatgtgccaagttcttggaggagcaacttgatccttgtaattgcttaggaatccagcgctttgctgatacccattcactcaaaacactcttcacaaaatgcaaaaattttgcgttacagacttttgaggatgtatcccagcacgaagaatttcttgagcttgacaaagatgaagtatatgttgtcggtggctatgatgggcaaaacagacttagcagcgtagaatgttatgattccttttcaaatcgatggactgaagttgctccccttaaggaagccgtgagttctcctgcagtgactagctgtgtaggcaaactgtttgtgattggtggaggacctgatgataatacttgttctgataaggttcaatcttatgatccagaaaccaattcttggctacttcgtgcagctatcccaattgccaaaaggtgtataacagctgtatccctaaacaacctgatctatgttgccggtggactgaccaaggcaatatactgttacgatccagttgaagattactggatgcacgtacagaatacattcagccgtcaggaaaactgtggtatgtctgtgtgtaatggtaaaatatatatcctgggcggaagacgggaaaatggagaagccacagacactattctctgttatgatcctgcaacaagtatcatcacaggggtagctgcaatgcccaggccagtgtcctatcatggctgtgtgactattcatagatacaatgagaaatgctttaaactctgaagacaggatacctcaccgaagaagccacactgatccaagatgggaggttttaaaaactctacagtgggaacttcacatatctcctttgtgccatatgcaaaaaatagtaaaaataataatttggtgcctttctcctcaaaatatcaatctttcaaactataataaagcctttcctataattg

SEQ ID NO: 23042 - DNA, 966 bp, Homo sapiens
gtgggcggtacccgagggagagttcgagcttttattggcgagtttttatggtcactaggtgggcctgcccgtgggccattcttcccgtccccggggagccggggcgggcgggggagcgggcgttccgccggcgcagtccccgcctaacctccccaccttcttaccactccaggactcagtttcttaatttagttcctaatggacccgccctcaagttctggacaccccgggtgaagactgttaacgcggcgggtgcgggaggcgcgcgctcccgcccctgctgcgggcggctggtagcctcggtggccgccgccgccgctgctgctgcctgatcctgcaggcagttctgggcacgcagagatcggctaccgtggcctgccctccgaggaccggaaaattaacaccctttaactagtgtcgcgttatctgccgggtggttcgcaggaagtcctgcgaacacgttgttgccagttctgtaaacgtgtttagatagctaaatatagatcacagtgccacatcttagggggccccacggtcacccctgaggcagtggctgttcacaattgattttagtggattttaatgattaatcacttgctcttgtgggcagcttttcaaaaatcacgtctttgtatttgcagctacagactgggtccaccagctaagaggttggtttttattagggttgtaaaatagatttaaaatctgcttgttgttggctgagatttaaaagcagatttctactatttaaaaaagatagtttgaagatactcccctaaaaagtaaagattcttccatactcggctcggatgagttgttttccttgtttgagggattctaggtcacacacttctatgttttaattcccgtggtaattcaaaatgtttgagaagtgggttgcgactgtgtcgttttaaaattgtacattaagctgacggtaataaaatcttcaagaccaatcatttt

SEQ ID NO: 23043 - DNA, 642 bp, Homo sapiens
ccgggcccggggaattccccggggaattccatgttttctttacctatgccttggtggcacagatctcttggtgacagctatatcatgataaattatcgtgtgtgcattgttttgcatttcaaggtggaagaatcaacagccgtgatgtctggatttataactcacagttaaatatttggatcagagttgcctctctcaataaaggcagatggcgtcacaaaatggctgtcctccttggtaaagtaagagaaaccactttttattactattgctggtacctttccaaagtaaataccacagctgaatctttcattttactcaccctctgggtattttggattcaaattgtatttccttccatttctaacctcaatagataaaccaaagatataaacaatatgacactgtacttttgaatggatattttgttctcctaatttggaattcatggcagtgtagcacatttctcttctcatgcatcactgaagtccaaatgcctaagaagcattggaaaataaggagttacatcaaatacagacaggccaatgtctaacccacgcagttggtttttttttactaactttgcaagtccggcagagatatattgtccaaggcatgtattttatcttttttattttaaat

SEQ ID NO: 23044 - DNA, 442 bp, Homo sapiens
tgttaccaaatcctttatcttcaatggttaattttttgtttatatatttggttaaacaggaaaactgtggtatgtctgtgtgtaatggtaaaatatatatcctgggcggaagacgggaaaatggagaagccacagacactattctctgttatgatcctgcaacaagtatcatcacaggggtagctgcaatgcccaggccagtgtcctatcatggctgtgtgactattcatagatacaatgagaaatgctttaaactctgaagacaggatacctcaccgaagaagccacactgatccaagatgggaggttttaaaaactctacagtgggaacttcacatatctcctttgtgccatatgcaaaaaatagtaaaaataataatttggtgcctttctcctcaaaatatcaatctttcaaactataataaagcctttcctataattg

SEQ ID NO: 23045 - DNA, 591 bp, Homo sapiens
tggcttctcactcggctccttacacaagaggcatttttttaactgtctctgcttaaaacaaggtgtttttgagtcagcagccctttgggtgggtctcgtcctcttgggcacccgacacccaccccacggcgggagccccaggtggccccggaggccaccgggaagcgtgaactacatctcccagggttccccggggcggaggacgcccacccggattggccagggttcgctgacgctcagtgttttggcccggacggtcacatgtttcctttgttgtgagctgcggcagagactggtggctggaggagacgccggcgctggagagtgcgctgcgccgcccgccgctgagggaccgcggggttagccactgctggctgcttccagtgttcgccgagaggtaccgggggtgacagctccgggaccggccgaaaggcgaggaaccggaagcccgggggagtgcgaccgcctcaaatccagccttcttgtttggtgggacgaccgtcggttctgtccgggaggaatgacggggtcaaggtggggtccccagggccgcgggcccgtgaagccccattaaagcgattgcgaaatgca

SEQ ID NO: 23046 - DNA, 4489 bp, Homo sapiens
  misc_feature (512)..(512): n is a, c, g, or t
tggcttctcactcggctccttacacaagaggcatttttttaactgtctctgcttaaaacaaggtgtttttgagtcagcagccctttgggtgggtctcgtcctcttgggcacccgacacccaccccacggcgggagccccaggtggccccggaggccaccgggaagcgtgaactacatctcccagggttccccggggcggaggacgcccacccggattggccagggttcgctgacgctcagtgttttggcccggacggtcacatgtttcctttgttgtgagctgcggcagagactggtggctggaggagacgccggcgctggagagtgcgctgcgccgcccgccgctgagggaccgcggggttagccactgctggctgcttccagtgttcgccgagaggtaccgggggtgacagctccgggaccggccgaaaggcgaggaaccggtgtggaaattaaaagaacacacatattttgactggggctttgatcaaccaaatgctaaaaagccacanaaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagctgaagctatggaatgttttttgcagtatgtttatactggaaaggtgaagatcactacagagaatgtacagtatctctttgagacatcaagcctctttcagattagtgttctccgtgatgcatgtgccaagttcttggaggagcaacttgatccttgtaattgcttaggaatccagcgctttgctgatacccattcactcaaaacactcttcacaaaatgcaaaaattttgcgttacagacttttgaggatgtatcccagcacgaagaatttcttgagcttgacaaagatgaacttattgattatatttgtagtgatgaacttgttattggtaaagaggagatggtttttgaagccgtcatgcgttgggtctatcgtgccgttgatctgagaagaccactgttacacgagctcctgacacatgtgagactccctctgttgcatcccaactactttgttcaaacagttgaagtggaccaattgatccagaattctcctgagtgttatcagttgttgcatgaagcaagacggtaccacatacttgggaatgaaatgatgtccccaaggactaggccacgcaggtccactggctattctgaggtgatagttgtcgttggaggatgtgagcgagttggaggatttaatcttccatacactgagtgctacgatcctgtaacaggagaatggaagtctttggctaagcttccagaatttaccaaatcagagtatgcagtctgtgctctaaggaatgacattcttgtttcaggtggaagaatcaacagccgtgatgtctggatttataactcacagttaaatatttggatcagagttgcctctctcaataaaggcagatggcgtcacaaaatggctgtcctccttggtaaagtatatgttgtcggtggctatgatgggcaaaacagacttagcagcgtagaatgttatgattccttttcaaatcgatggactgaagttgctccccttaaggaagccgtgagttctcctgcagtgactagctgtgtaggcaaactgtttgtgattggtggaggacctgatgataatacttgttctgataaggttcaatcttatgatccagaaaccaattcttggctacttcgtgcagctatcccaattgccaaaaggtgtataacagctgtatccctaaacaacctgatctatgttgccggtggactgaccaaggcaatatactgttacgatccagttgaagattactggatgcacgtacagaatacattcagccgtcaggaaaactgtggtatgtctgtgtgtaatggtaaaatatatatcctgggcggaagacgggaaaatggagaagccacagacactattctctgttatgatcctgcaacaagtatcatcacaggggtagctgcaatgcccaggccagtgtcctatcatggctgtgtgactattcatagatacaatgagaaatgctttaaactctgaagacaggatacctcaccgaagaagccacactgatccaagatgggaggttttaaaaactctacagtgggaacttcacatatctcctttgtgccatatgcaaaaaatagtaaaaataataatttggtgcctttctcctcaaaatatcaatctttcaaactataataaagcctttcctataattgaaaaaaaaaacttttttgttaaaggtaatggtggttgttacttggcctttgaagagtgtacctttgtaagtatttgtaagaagtctatgtgaattaggaaatgtctgtctgcataccttttaggagcgtgtgaatggtgtcttcacttattatgtatgtttatctgtatgtatattccttattttgtcatatatgtagagaaaattgcatgacttgaggcatcatttaggttgaagaagttaatgcttaggatgcattctaggagaaaaaatcagttttaaaaacctttgttgttaacaaagtatatccagattggttaattttattgaagggtttttttctgtaattgataaaaatgtaatgacaacaattcaggcatcataaaatactgaactattgtgactttattcttagaattgctgtcttacattaaacatgtttttagggggaagttaggtaggagatagaaaaataagtgcccctacaagggggattaaaattacaagttaattcctaagagaaaaatggaatggcctttgaggggaaaagacccactatggctctcaaagtttttatgcatcatctcttcaatcctctaagaaagcctcttttcttaacttgataaagcagtggaaacccattttgcaatattgttttgtgaaaaacagggacagacagccaggtacagagactcacacctgtactcccaactactcagcaggctggggcaggaggattgcttgagcccaggagtctgaggctacagtgagctatgaacgcacacggcaccctagcctgggcaacaggttgcgacactgtctcaagagaaaagaaaaagaaaaatagggataggttttccttcctagcccagtagagtttgacctcattagtatggtgctttgggtgaggacctcttccttgattatcccactttctagtgaacagctaaaattcctgagagtctctactgttaaggtacctttaataggataaagcagggaccacctatctcagtgggtccatttttcttttaaaattagttatctgaaaaaacttagcagtagttcccatctttaaggtaagtctttcatttggtccccattgtgtaaaatactaatcaacattttcaagcttctgtacaacagactgcttttgtctagatttctcaactccactttataaagcttatcagttttcagagaggaatgtgaattttttttctaatgcaaataaatggatatggcaggaactacagcataagtgattattgtgattctgggtggacggatataatttacaacatttagggatgttctaggtagcctgctgtagtttgacttccagtcactgttgtctttcacattataatttgtatatttcttgtgatagaagggatgatgcaaatatgtaattaaagtgtcaccagatttctgttaaaaccaaggttgaaataaaaagcctaacattggtaagctacattgttttctcattttagaatgattcagagatttcagatagacattttttaaactttaatgcttagctagaatctacattctgaggaaaactctaaaaaacttaaaaatttttagggaatttttatttttcaaatcataattttaaaatgatagataccattttgtgataacaacaattcagaaaacaattttctatcctcttagttgaaagaatgtaggtacagtttggatacttgtactttaattttagagtaaacatctgcattatactcttatagataatagaattatttagttaagaaattctttacagtaaatgagataatgtgtgaaaaagtattttgtaaatgctgaggattctacaaatgatagttgttattttcatgtgtatttgtaagatcatgtccatttcatgaatataggacttcacataaaaaaagactttctcaagacaaatta

SEQ ID NO: 23047 - DNA, 2876 bp, Homo sapiens
tgattgaggatcctctctaattatcaggagctgtgctctaggatgacatactgtttcaggtggaagaatcaacagccgtgatgtctggatttataactcacagttaaatatttggatcagagttgcctctctcaataaaggcagatggcgtcacaaaatggctgtcctccttggtaaagtatatgttgtcggtggctatgatgggcaaaacagacttagcagcgtagaatgttatgattccttttcaaatcgatggactgaagttgctccccttaaggaagccgtgagttctcctgcagtgactagctgtgtaggcaaactgtttgtgattggtggaggacctgatgataatacttgttctgataaggttcaatcttatgatccagaaaccaattcttggctacttcgtgcagctatcccaattgccaaaaggtgtataacagctgtatccctaaacaacctgatctatgttgccggtggactgaccaaggcaatatactgttacgatccagttgaagattactggatgcacgtacagaatacattcagccgtcaggaaaactgtggtatgtctgtgtgtaatggtaaaatatatatcctgggcggaagacgggaaaatggagaagccacagacactattctctgttatgatcctgcaacaagtatcatcacaggggtagctgcaatgcccaggccagtgtcctatcatggctgtgtgactattcatagatacaatgagaaatgctttaaactctgaagacaggatacctcaccgaagaagccacactgatccaagatgggaggttttaaaaactctacagtgggaacttcacatatctcctttgtgccatatgcaaaaaatagtaaaaataataatttggtgcctttctcctcaaaatatcaatctttcaaactataataaagcctttcctataattgaaaaaaaaaacttttttgttaaaggtaatggtggttgttacttggcctttgaagagtgtacctttgtaagtatttgtaagaagtctatgtgaattaggaaatgtctgtctgcataccttttaggagcgtgtgaatggtgtcttcacttattatgtatgtttatctgtatgtatattccttattttgtcatatatgtagagaaaattgcatgacttgaggcatcatttaggttgaagaagttaatgcttaggatgcattctaggagaaaaaatcagttttaaaaacctttgttgttaacaaagtatatccagattggttaattttattgaagggtttttttctgtaattgataaaaatgtaatgacaacaattcaggcatcataaaatactgaactattgtgactttattcttagaattgctgtcttacattaaacatgtttttagggggaagttaggtaggagatagaaaaataagtgcccctacaagggggattaaaattacaagttaattcctaagagaaaaatggaatggcctttgaggggaaaagacccactatggctctcaaagtttttatgcatcatctcttcaatcctctaagaaagcctcttttcttaacttgataaagcagtggaaacccattttgcaatattgttttgtgaaaaacagggacagacagccaggtacagagactcacacctgtactcccaactactcagcaggctggggcaggaggattgcttgagcccaggagtctgaggctacagtgagctatgaacgcacacggcaccctagcctgggcaacaggttgcgacactgtctcaagagaaaagaaaaagaaaaatagggataggttttccttcctagcccagtagagtttgacctcattagtatggtgctttgggtgaggacctcttccttgattatcccactttctagtgaacagctaaaattcctgagagtctctactgttaaggtacctttaataggataaagcagggaccacctatctcagtgggtccatttttcttttaaaattagttatctgaaaaaacttagcagtagttcccatctttaaggtaagtctttcatttggtccccattgtgtaaaatactaatcaacattttcaagcttctgtacaacagactgcttttgtctagatttctcaactccactttataaagcttatcagttttcagagaggaatgtgaattttttttctaatgcaaataaatggatatggcaggaactacagcataagtgattattgtgattctgggtggacggatataatttacaacatttagggatgttctaggtagcctgctgtagtttgacttccagtcactgttgtctttcacattataatttgtatatttcttgtgatagaagggatgatgcaaatatgtaattaaagtgtcaccagatttctgttaaaaccaaggttgaaataaaaagcctaacattggtaagctacattgttttctcattttagaatgattcagagatttcagatagacattttttaaactttaatgcttagctagaatctacattctgaggaaaactctaaaaaacttaaaaatttttagggaatttttatttttcaaatcataattttaaaatgatagataccattttgtgataacaacaattcagaaaacaattttctatcctcttagttgaaagaatgtaggtacagtttggatacttgtactttaattttagagtaaacatctgcattatactcttatagataatagaattatttagttaagaaattctttacagtaaatgagataatgtgtgaaaaagtattttgtaaatgctgaggattctacaaatgatagttgttattttcatgtgtatttgtaagatcatgtccatttcatgaatataggacttcacataaaaaaagactttctcaagacaaatta

SEQ ID NO: 23048 - DNA, 2680 bp, Homo sapiens
  misc_feature (512)..(512): n is a, c, g, or t
tggcttctcactcggctccttacacaagaggcatttttttaactgtctctgcttaaaacaaggtgtttttgagtcagcagccctttgggtgggtctcgtcctcttgggcacccgacacccaccccacggcgggagccccaggtggccccggaggccaccgggaagcgtgaactacatctcccagggttccccggggcggaggacgcccacccggattggccagggttcgctgacgctcagtgttttggcccggacggtcacatgtttcctttgttgtgagctgcggcagagactggtggctggaggagacgccggcgctggagagtgcgctgcgccgcccgccgctgagggaccgcggggttagccactgctggctgcttccagtgttcgccgagaggtaccgggggtgacagctccgggaccggccgaaaggcgaggaaccggtgtggaaattaaaagaacacacatattttgactggggctttgatcaaccaaatgctaaaaagccacanaaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagctgaagctatggaatgttttttgcagtatgtttatactggaaaggtgaagatcactacagagaatgtacagtatctctttgagacatcaagcctctttcagattagtgttctccgtgatgcatgtgccaagttcttggaggagcaacttgatccttgtaattgcttaggaatccagcgctttgctgatacccattcactcaaaacactcttcacaaaatgcaaaaattttgcgttacagacttttgaggatgtatcccagcacgaagaatttcttgagcttgacaaagatgaacttattgattatatttgtagtgatgaacttgttattggtaaagaggagatggtttttgaagccgtcatgcgttgggtctatcgtgccgttgatctgagaagaccactgttacacgagctcctgacacatgtgagactccctctgttgcatcccaactactttgttcaaacagttgaagtggaccaattgatccagaattctcctgagtgttatcagttgttgcatgaagcaagacggtaccacatacttgggaatgaaatgatgtccccaaggactaggccacgcaggtccactggctattctgaggtgatagttgtcgttggaggatgtgagcgagttggaggatttaatcttccatacactgagtgctacgatcctgtaacaggagaatggaagtctttggctaagcttccagaatttaccaaatcagagtatgcagtctgtgctctaaggaatgacattcttgtttcaggtggaagaatcaacagccgtgatgtctggatttataactcacagttaaatatttggatcagagttgcctctctcaataaaggcagatggcgtcacaaaatggctgtcctccttggtaaagtatatgttgtcggtggctatgatgggcaaaacagacttagcagcgtagaatgttatgattccttttcaaatcgatggactgaagttgctccccttaaggaagccgtgagttctcctgcagtgactagctgtgtaggcaaactgtttgtgattggtggaggacctgatgataatacttgttctgataaggttcaatcttatgatccagaaaccaattcttggctacttcgtgcagctatcccaattgccaaaaggtgtataacagctgtatccctaaacaacctgatctatgttgccggtggactgaccaaggcaatatactgttacgatccagttgaagattactggatgcacgtacagaatacattcagccgtcaggtaataacatgaagcagtacaaaagaaaaataaatctaagagggaccaagtacataatcattattaatacactggaatttcaattttaaaatatttcaggctgggcgtggtggctcacgcctgtggtcccagcactttgggaggccgaggtggatagatcacttgaggtcaggagttcaagaccagcctggctaatatggtgaaaccccgtctctactaaaaaattatggccaggcgtggtggttcatgcctgtaatcccagcactttgggaggctgaggcaggccaatcacctgaggtcgggagttcgagaccagcctgaccaacatggagaaaccccgtctctgctaaaaatacaaaattagctgggcgtggtggcgcattgcctgtaatcccagctactagggaggctgcggcaggagaattgcttgaacccgggaggtggaggtcgcggtgagccgagatcgagccattgcactccagcctggacagcaggagcgaaactccgtctc

SEQ ID NO: 23049 - DNA, 2379 bp, Homo sapiens
tgttaccaaatcctttatcttcaatggttaattttttgtttatatatttggttaaacaggaaaactgtggtatgtctgtgtgtaatggtaaaatatatatcctgggcggaagacgggaaaatggagaagccacagacactattctctgttatgatcctgcaacaagtatcatcacaggggtagctgcaatgcccaggccagtgtcctatcatggctgtgtgactattcatagatacaatgagaaatgctttaaactctgaagacaggatacctcaccgaagaagccacactgatccaagatgggaggttttaaaaactctacagtgggaacttcacatatctcctttgtgccatatgcaaaaaatagtaaaaataataatttggtgcctttctcctcaaaatatcaatctttcaaactataataaagcctttcctataattgaaaaaaaaaacttttttgttaaaggtaatggtggttgttacttggcctttgaagagtgtacctttgtaagtatttgtaagaagtctatgtgaattaggaaatgtctgtctgcataccttttaggagcgtgtgaatggtgtcttcacttattatgtatgtttatctgtatgtatattccttattttgtcatatatgtagagaaaattgcatgacttgaggcatcatttaggttgaagaagttaatgcttaggatgcattctaggagaaaaaatcagttttaaaaacctttgttgttaacaaagtatatccagattggttaattttattgaagggtttttttctgtaattgataaaaatgtaatgacaacaattcaggcatcataaaatactgaactattgtgactttattcttagaattgctgtcttacattaaacatgtttttagggggaagttaggtaggagatagaaaaataagtgcccctacaagggggattaaaattacaagttaattcctaagagaaaaatggaatggcctttgaggggaaaagacccactatggctctcaaagtttttatgcatcatctcttcaatcctctaagaaagcctcttttcttaacttgataaagcagtggaaacccattttgcaatattgttttgtgaaaaacagggacagacagccaggtacagagactcacacctgtactcccaactactcagcaggctggggcaggaggattgcttgagcccaggagtctgaggctacagtgagctatgaacgcacacggcaccctagcctgggcaacaggttgcgacactgtctcaagagaaaagaaaaagaaaaatagggataggttttccttcctagcccagtagagtttgacctcattagtatggtgctttgggtgaggacctcttccttgattatcccactttctagtgaacagctaaaattcctgagagtctctactgttaaggtacctttaataggataaagcagggaccacctatctcagtgggtccatttttcttttaaaattagttatctgaaaaaacttagcagtagttcccatctttaaggtaagtctttcatttggtccccattgtgtaaaatactaatcaacattttcaagcttctgtacaacagactgcttttgtctagatttctcaactccactttataaagcttatcagttttcagagaggaatgtgaattttttttctaatgcaaataaatggatatggcaggaactacagcataagtgattattgtgattctgggtggacggatataatttacaacatttagggatgttctaggtagcctgctgtagtttgacttccagtcactgttgtctttcacattataatttgtatatttcttgtgatagaagggatgatgcaaatatgtaattaaagtgtcaccagatttctgttaaaaccaaggttgaaataaaaagcctaacattggtaagctacattgttttctcattttagaatgattcagagatttcagatagacattttttaaactttaatgcttagctagaatctacattctgaggaaaactctaaaaaacttaaaaatttttagggaatttttatttttcaaatcataattttaaaatgatagataccattttgtgataacaacaattcagaaaacaattttctatcctcttagttgaaagaatgtaggtacagtttggatacttgtactttaattttagagtaaacatctgcattatactcttatagataatagaattatttagttaagaaattctttacagtaaatgagataatgtgtgaaaaagtattttgtaaatgctgaggattctacaaatgatagttgttattttcatgtgtatttgtaagatcatgtccatttcatgaatataggacttcacataaaaaaagactttctcaagacaaatta

SEQ ID NO: 23050 - DNA, 3126 bp, Homo sapiens
  misc_feature (512)..(512): n is a, c, g, or t
tggcttctcactcggctccttacacaagaggcatttttttaactgtctctgcttaaaacaaggtgtttttgagtcagcagccctttgggtgggtctcgtcctcttgggcacccgacacccaccccacggcgggagccccaggtggccccggaggccaccgggaagcgtgaactacatctcccagggttccccggggcggaggacgcccacccggattggccagggttcgctgacgctcagtgttttggcccggacggtcacatgtttcctttgttgtgagctgcggcagagactggtggctggaggagacgccggcgctggagagtgcgctgcgccgcccgccgctgagggaccgcggggttagccactgctggctgcttccagtgttcgccgagaggtaccgggggtgacagctccgggaccggccgaaaggcgaggaaccggtgtggaaattaaaagaacacacatattttgactggggctttgatcaaccaaatgctaaaaagccacanaaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagctgaagctatggaatgttttttgcagtatgtttatactggaaaggtgaagatcactacagagaatgtacagtatctctttgagacatcaagcctctttcagattagtgttctccgtgatgcatgtgccaagttcttggaggagcaacttgatccttgtaattgcttaggaatccagcgctttgctgatacccattcactcaaaacactcttcacaaaatgcaaaaattttgcgttacagacttttgaggatgtatcccagcacgaagaatttcttgagcttgacaaagatgaacttattgattatatttgtagtgatgaacttgttattggtaaagaggagatggtttttgaagccgtcatgcgttgggtctatcgtgccgttgatctgagaagaccactgttacacgagctcctgacacatgtgagactccctctgttgcatcccaactactttgttcaaacagttgaagtggaccaattgatccagaattctcctgagtgttatcagttgttgcatgaagcaagacggtaccacatacttgggaatgaaatgatgtccccaaggactaggccacgcaggtccactggctattctgaggtgatagttgtcgttggaggatgtgagcgagttggaggatttaatcttccatacactgagtgctacgatcctgtaacaggagaatggaagtctttggctaagcttccagaatttaccaaatcagagtatgcagtctgtgctctaaggaatgacattcttgtttcaggtggaagaatcaacagccgtgatgtctggatttataactcacagttaaatatttggatcagagttgcctctctcaataaaggcagatggcgtcacaaaatggctgtcctccttggtaaagtatatgttgtcggtggctatgatgggcaaaacagacttagcagcgtagaatgttatgattccttttcaaatcgatggactgaagttgctccccttaaggaagccgtgagttctcctgcagtgactagctgtgtaggcaaactgtttgtgattggtggaggacctgatgataatacttgttctgataaggttcaatcttatgatccagaaaccaattcttggctacttcgtgcagctatcccaattgccaaaaggtgtataacagctgtatccctaaacaacctgatctatgttgccggtggactgaccaaggcaatatactgttacgatccagttgaagattactggatgcacgtacagaatacattcagccgtcaggaaaactgtggtatgtctgtgtgtaatggtaaaatatatatcctgggcggaagacgggaaaatggagaagccacagacactattctctgttatgatcctgcaacaagtatcatcacaggggtagctgcaatgcccaggccagtgtcctatcatggctgtgtgactattcatagatacaatgagaaatgctttaaactctgaagacaggatacctcaccgaagaagccacactgatccaagatgggaggttttaaaaactctacagtgggaacttcacatatctcctttgtgccatatgcaaaaaatagtaaaaataataatttggtgcctttctcctcaaaatatcaatctttcaaactataataaagcctttcctataattgaaaaaaaaaacttttttgttaaaggtaatggtggttgttacttggcctttgaagagtgtacctttgtaagtatttgtaagaagtctatgtgaattaggaaatgtctgtctgcataccttttaggagcgtgtgaatggtgtcttcacttattatgtatgtttatctgtatgtatattccttattttgtcatatatgtagagaaaattgcatgacttgaggcatcatttaggttgaagaagttaatgcttaggatgcattctaggagaaaaaatcagttttaaaaacctttgttgttaacaaagtatatccagattggttaattttattgaagggtttttttctgtaattgataaaaatgtaatgacaacaattcaggcatcataaaatactgaactattgtgactttattcttagaattgctgtcttacattaaacatgtttttagggggaagttaggtaggagatagaaaaataagtgcccctacaagggggattaaaattacaagttaattcctaagagaaaaatggaatggcctttgaggggaaaagacctgtaatcctcgagatcgactca

SEQ ID NO: 23051 - DNA, 2358 bp, Homo sapiens
agagaccaagaagaaagcgcgtagccgcggacatttcagaaaactgtggtatgtctgtgtgtaatggtaaaatatatatcctgggcggaagacgggaaaatggagaagccacagacactattctctgttatgatcctgcaacaagtatcatcacaggggtagctgcaatgcccaggccagtgtcctatcatggctgtgtgactattcatagatacaatgagaaatgctttaaactctgaagacaggatacctcaccgaagaagccacactgatccaagatgggaggttttaaaaactctacagtgggaacttcacatatctcctttgtgccatatgcaaaaaatagtaaaaataataatttggtgcctttctcctcaaaatatcaatctttcaaactataataaagcctttcctataattgaaaaaaaaaacttttttgttaaaggtaatggtggttgttacttggcctttgaagagtgtacctttgtaagtatttgtaagaagtctatgtgaattaggaaatgtctgtctgcataccttttaggagcgtgtgaatggtgtcttcacttattatgtatgtttatctgtatgtatattccttattttgtcatatatgtagagaaaattgcatgacttgaggcatcatttaggttgaagaagttaatgcttaggatgcattctaggagaaaaaatcagttttaaaaacctttgttgttaacaaagtatatccagattggttaattttattgaagggtttttttctgtaattgataaaaatgtaatgacaacaattcaggcatcataaaatactgaactattgtgactttattcttagaattgctgtcttacattaaacatgtttttagggggaagttaggtaggagatagaaaaataagtgcccctacaagggggattaaaattacaagttaattcctaagagaaaaatggaatggcctttgaggggaaaagacccactatggctctcaaagtttttatgcatcatctcttcaatcctctaagaaagcctcttttcttaacttgataaagcagtggaaacccattttgcaatattgttttgtgaaaaacagggacagacagccaggtacagagactcacacctgtactcccaactactcagcaggctggggcaggaggattgcttgagcccaggagtctgaggctacagtgagctatgaacgcacacggcaccctagcctgggcaacaggttgcgacactgtctcaagagaaaagaaaaagaaaaatagggataggttttccttcctagcccagtagagtttgacctcattagtatggtgctttgggtgaggacctcttccttgattatcccactttctagtgaacagctaaaattcctgagagtctctactgttaaggtacctttaataggataaagcagggaccacctatctcagtgggtccatttttcttttaaaattagttatctgaaaaaacttagcagtagttcccatctttaaggtaagtctttcatttggtccccattgtgtaaaatactaatcaacattttcaagcttctgtacaacagactgcttttgtctagatttctcaactccactttataaagcttatcagttttcagagaggaatgtgaattttttttctaatgcaaataaatggatatggcaggaactacagcataagtgattattgtgattctgggtggacggatataatttacaacatttagggatgttctaggtagcctgctgtagtttgacttccagtcactgttgtctttcacattataatttgtatatttcttgtgatagaagggatgatgcaaatatgtaattaaagtgtcaccagatttctgttaaaaccaaggttgaaataaaaagcctaacattggtaagctacattgttttctcattttagaatgattcagagatttcagatagacattttttaaactttaatgcttagctagaatctacattctgaggaaaactctaaaaaacttaaaaatttttagggaatttttatttttcaaatcataattttaaaatgatagataccattttgtgataacaacaattcagaaaacaattttctatcctcttagttgaaagaatgtaggtacagtttggatacttgtactttaattttagagtaaacatctgcattatactcttatagataatagaattatttagttaagaaattctttacagtaaatgagataatgtgtgaaaaagtattttgtaaatgctgaggattctacaaatgatagttgttattttcatgtgtatttgtaagatcatgtccatttcatgaatataggacttcacataaaaaaagactttctcaagacaaatta

SEQ ID NO: 23052 - DNA, 1654 bp, Homo sapiens
tggcttctcactcggctccttacacaagaggcatttttttaactgtctctgcttaaaacaaggtgtttttgagtcagcagccctttgggtgggtctcgtcctcttgggcacccgacacccaccccacggcgggagccccaggtggccccggaggccaccgggaagcgtgaactacatctcccagggttccccggggcggaggacgcccacccggattggccagggttcgctgacgctcagtgttttggcccggacggtcacatgtttcctttgttgtgagctgcggcagagactggtggctggaggagacgccggcgctggagagtgcgctgcgccgcccgccgctgagggaccgcggggttagccactgctggctgcttccagtgttcgccgagaggtaccgggggtgacagctccgggaccggccgaaaggcgaggaaccggtcagagtctgagtcctcgggggcggaggggcgacggcggtcctgaccaccggggtgtctgcgggagggcagccagcggcggccggcctctcagagccagactggcggtctgcggagaggctgcagctgggctacagggcccctttctgaggcgaggggcctccagggttcacctggggggtcttcctcccccgcttggtagctacagccctgagggagggcgcgcgcgcctcctggcactacggcccggaaccgcggcgcggctggtgcggcctggctagggcggggtggttgccgggactgggggtagccgcaggtgcggtaggctagtcgccgcggggagccggggcgggcgggggagcgggcgttccgccggcgcagtccccgcctaacctccccaccttcttaccactccaggactcagtttcttaatttagttcctaatggacccgccctcaagttctggacaccccgggtgaagactgttaacgcggcgggtgcgggaggcgcgcgctcccgcccctgctgcgggcggctggtagcctcggtggccgccgccgccgctgctgctgcctgatcctgcaggcagttctgggcacgcagagatcggctaccgtggcctgccctccgaggaccggaaaattaacaccctttaactagtgtcgcgttatctgccgggtggttcgcaggaagtcctgcgaacacgttgttgccagttctgtaaacgtgtttagatagctaaatatagatcacagtgccacatcttagggggccccacggtcacccctgaggcagtggctgttcacaattgattttagtggattttaatgattaatcacttgctcttgtgggcagcttttcaaaaatcacgtctttgtatttgcagctacagactgggtccaccagctaagaggttggtttttattagggttgtaaaatagatttaaaatctgcttgttgttggctgagatttaaaagcagatttctactatttaaaaaagatagtttgaagatactcccctaaaaagtaaagattcttccatactcggctcggatgagttgttttccttgtttgagggattctaggtcacacacttctatgttttaattcccgtggtaattcaaaatgtttgagaagtgggttgcgactgtgtcgttttaaaattgtacattaagctgacggtaataaaatcttcaagaccaatcatttt

SEQ ID NO: 23053 - DNA, 1364 bp, Homo sapiens
  misc_feature (512)..(512): n is a, c, g, or t
tggcttctcactcggctccttacacaagaggcatttttttaactgtctctgcttaaaacaaggtgtttttgagtcagcagccctttgggtgggtctcgtcctcttgggcacccgacacccaccccacggcgggagccccaggtggccccggaggccaccgggaagcgtgaactacatctcccagggttccccggggcggaggacgcccacccggattggccagggttcgctgacgctcagtgttttggcccggacggtcacatgtttcctttgttgtgagctgcggcagagactggtggctggaggagacgccggcgctggagagtgcgctgcgccgcccgccgctgagggaccgcggggttagccactgctggctgcttccagtgttcgccgagaggtaccgggggtgacagctccgggaccggccgaaaggcgaggaaccggtgtggaaattaaaagaacacacatattttgactggggctttgatcaaccaaatgctaaaaagccacanaaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagctgaagctatggaatgttttttgcagtatgtttatactggaaaggtgaagatcactacagagaatgtacagtatctctttgagacatcaagcctctttcagattagtgttctccgtgatgcatgtgccaagttcttggaggagcaacttgatccttgtaattgcttaggaatccagcgctttgctgatacccattcactcaaaacactcttcacaaaatgcaaaaattttgcgttacagacttttgaggatgtatcccagcacgaagaatttcttgagcttgacaaagatgaacttattgattatatttgtagtgatgaagggttttcttcttgctacttttaatactgattttctcatcgaggaatatattagtactttctgctgttctctccattggtttcaagacttaatattatatcctcttctcactccctcagtttctgtgtcctgcccgt

SEQ ID NO: 23054 - DNA, 408 bp, Homo sapiens
catgaagcaagacggtaccacatacttgggaatgaaatgatgtccccaaggactaggccacgcaggtgagaagactgttttcaaatatagttaacaaaagtttttaatatatctttaaacctcctgaatgcaatctcagtgttgtcatttatatgcactgtctacctgtggctgtatataattttagatttattttggattatatgtcactagaatgtctttcctagtgaattctagattcaacagtagcattttttgttattgttgttttgtgctatcaaacagtgtagcaaagggtctttgcaactgtgcatatctcaacatatttctactaatttctcttaacctttgtagggccccaaaccattccacttttctttccaaagagtctttggatacagggtagct

SEQ ID NO: 23055 - DNA, 441 bp, Homo sapiens
ctgaccaccggggtgtctgcgggagggcagccagcggcggccggcctctcagagccagactggcggtctgcggagaggctgcagctgggctacagggcccctttctgaggcgaggggcctccagggttcacctggggggtcttcctcccccgcttggtagctacagccctgagggagggcgcgcgcgcctcctggcactacggcccggaaccgcggcgcggctggtgcggcctggctagggcggggtggttgccgggactgggggtagccgcaggtgcggtaggctagtcgccgcggggccgggcgccgccgggggaggcggctgggcagacgggtgctgcttgttgccgatgggctgcgaacggggcgctgctttttatttcaggaagcccgggggagtgcgaccgcctcaaatccagccttcttgtttggtgggacgac

SEQ ID NO: 23056 - DNA, 320 bp, Homo sapiens
tctttacgactagctcaaataaatcaaaattttgctcttgaattgagtagaggatcaaactcccagaaatattaccactacttgatatgatcacgaaataagttttgttatcaaaagataaagaatggatgcagctttagtcttcatttgcttcattccaagtgctgttgcaatatttcccgtacctgaggaaactcaaagggatggctttaatgctatcagaaatctgagtccttagagtaagaaaataaatacaaaatattcaaaaattgcttgtactaaatagcgcatattgacaacaatagtcaaacataatatgc

SEQ ID NO: 23057 - DNA, 392 bp, Homo sapiens
agaccccactcttgccctcctgtgtccctcagcccctaagatgcccgccttgctctgtcgcatccaatgactataagacttaactgttcaagaggaagaaagggaagctcaagggctctactttttttttttaaacaaaataaaaacagtcattactgttgctacccatcttcctgaaaagttaggagaataaatgactgtttgtggggaaaacatactaagcaattaaagttttactttttgctcatcagaaataatgtattgattaatagtttccaaatgttttctttacaaacttttttaatttttgaaaacactgttttgcataaggaatattcaaaggaaaaaacccatgccctagtatgattaaaataaatgttacatcttccagt

SEQ ID NO: 23058 - DNA, 373 bp, Homo sapiens
gcttcagcccttcgaggagcccagacctgggagatctttgagccagggctgtgacttcctctttggggacctgtggtgtttggggtctccaagcctttgggcaacaccgcattctccagtgccagccatggaagctgcttgtggtgtccctagtccagccgcagcctcacagagagctggcacccctgctggcacctggagctgcctgccccacagcagcagccagtgtgtcggtgcagtggctgaatcccatgcttgctcacacaccccttgctgctccacacctgactctcagtctcccttagaggtgtgggatctgggctggtagtgtgagctgagaacagcatgctaggccaagggggcagaatgagcc

SEQ ID NO: 23059 - DNA, 452 bp, Homo sapiens
gatgcacaagacattttagttttaatgagtcaaatttatctcttttctttgttattgcttgtgctttggtgttgtagttaagaaaccatggcctaatccaaggtcataaagatttgcatctattttttccttcgaagagttttatcactttcattgaggtctttgattcattttagttatttttttatatgatgttgaggaaggggctcaaattcattcttttctatgtggatattcagttgtcctagaaccattgttgaaaagaatagtctttcctcatgaaatgacttttgtatccttgttggaaatcacatgatgtatgggtttatttctggattcttgattttatcccattgatacatatgtttatcctcatgccagtaacacatttttgtttaccgtatctttgtagtaagttttgaagccagaaagtatgagtcctccaactttat

SEQ ID NO: 23060 - DNA, 427 bp, Homo sapiens
tgcctgccatttagagtcttacattttgaaataaatcagatacagtaagtggttttccttaattcaaaataatggccctgtccatgatataaacactaactttgagtgttatcttacatagcaatagccagttgtgtatagctttttctctgaaagaatcttgtatcctcttctgtaagtatctttctctactctttgaaatgtaactatcattaacacccaacaaacatcttttggtaaatgactttaatagttacttaaggcatagtgttccatattattttcttgacttttgccaagaaatttccttccataaagttccctctgttttttcctctccttctcacccctcgacacatgcacacagatgtaattttatgtcccttcttagtctcagttgttctttttgtttttttttctcacttta

SEQ ID NO: 23061 - DNA, 168 bp, Homo sapiens
tcatatatctgtgaataacagaatttcaaggttagaggtctattcaaaaaaggtgggttcttgcccataaggaaggaagagatcactttaggcagttactgataatttaaaacttttgtctttcagttggtgcaagcattcatttattcacaattttaaatcttatac

SEQ ID NO: 23062 - DNA, 698 bp, Homo sapiens
gacacaggtcttgctcacagggttcttgccataaagtagacaagttatgtctgctgatcaatctctttaagagaggaattggtgtcaacatggtgcaaaacaaaattttacgttcaaatgttcctgcaagttctcaagtagataactgatggccaaaattgttaagcttcaattttcagctttcgtttgatttttctcttttttttactcagtcgtttataagcatactgatatttttgtctgacccaaaaaggtcagaaaatggaattatcagaaaaaagttctaaatgtagatatacgtgttggtaggggtgaatttctctaccccgtaacctcatccccaattcagataaatgctaggttttatatccattttagttgtgaaggaaaatataaaaatgtggattgtagtgacacaagattgattaatcagcgggtttttttaaaagaagacatggtagacagtgatttatttgtatgtaactattgaagttttttcttaaatgttagtgatattcatcgttcccattaactagttattcagatttttgaaaatcctttttctgtgaaagctatcctaacctggaggatgtctcttttctttcctctgtacttaagaagcttttcttgttagggaaataatttagaattagatttaggctatgttctgttcttctaaaaggcttagttgtcaaaaa

SEQ ID NO: 23063 - DNA, 606 bp, Homo sapiens
tagggaaaggatctatctacctctttgctctactgcagccagaagtttcctagcatgcgtcattttgggattcttttttattttccctaccctctttcctaagcaaggaaaagaagtacttacctttattctcccagaattgtgtgtccccatagattgaagaatcaatagagtgagaactagtgaacagataaaaatagctcagtccttcacagcttcctttgtaataatagaaataggagacaaataggagaaaaaggaagtgctctttataaattgtatgaagtattaagtatggtacttgctacctgcacaacccaggcatgagattagcacttggtgttagtcacacccccttaggccactactcattgccaccatttcaaagcctgtgggttgagtagattcttatataaaggtgactttcctaacctaaagagattgggcccaaaagcacaagtttcttctgattcttcctagacactacatactggaaaagacaagggaatagagacgcttccttttcacatgtcatccctctttcccttatgtgtccagccttgaaggggaatgttatttctactcatcccctaccccaacccttaa

SEQ ID NO: 23064 - DNA, 529 bp, Homo sapiens
ctgcaaattagccaaccctaagatgttgctataaacagctggtaggcgattgacataagtcatgtatctgaaagctcaattagatggagaattattaactagtttagtccactgactggatatcgctgattgaaatcctgcatctcctccaggagaatggagtgagtggctgatcctttatgcaaattagcccttttctgtatcttcttaagaccagtgttaaagccaattattatatagcatggcagaaaagagaggggctcatcattctgagacaagcttaaaggtgtgaaaatcaaggaagataggctggtagatggcattagattaggtagtacaagttttcatccctatttgtttgggttaaaatatgtggggagttgtgcctatataaattcttatgtgtgatgattactgctagttattatcttatgattgtttacaatctgtattagctattgatctaaaccattttattgttttctttcaagagattttaactaataaactttcattcacaaatcaaaaa

SEQ ID NO: 23065 - DNA, 773 bp, Homo sapiens
agcacatttaaaatatccccaggcagaaccaggtgattttataaaaccagtctatttctccccaacctcaggggcaggtgggccaggagaaacactttcctggtggaaggcacaggatctgcccaacccaccggctctcagccctgtttgcagggaagctaagaaggacttctggaggcagtctgacgtagtggtgaagagttagcctgcctaggttcaaatcctgcctctggcattcaccggctgtgtgtgaccttgggtgagtgacctaacctttctaggtctcggtccttcatttgaaaatggtggtaatcgcatcatcttacttattagaaggtgtgttaatacgcacctagtgttataaactgcacctggtacacacctgatcagcgtggcggggatggcctaattattgtaattatgggatggccttcctcttcacttattgatctgtgtatgaaacgtaagctccacggggccactggtttttgcctgttttgttcacttgtgtgtccccagcacctaagaccctctgcacctgtctgtgtctccttcctcagtgccaacccaaggagggatttccagaccttagggatttttgcggcccctaaaattgtagtgacaacaatctattttcatatccaatgttggtccgcactgtatgtgaaggagtgaagctggtgggtgggggctggtgcaagtattgaggaaggacgatgctcacagcctcagcccaggggacagcggcagtggggcctgggggaccgggagag

SEQ ID NO: 23066 - DNA, 345 bp, Homo sapiens
tggaattttgattttgtgtaactaatttttggggttgagcacagtacattaatcattgaattaggaaactatctagtaaaactagtgtattttgtgagttgtatgaggatcattgctttagtagataaacatttcccaaagaggtcactggtgaaaagacattaaaatagggagtctgaaattgtaacaatttatggaacttgttagattacttacctaaaaaatgttttctatgatagcttttgtgtgtgtatatgtcttctggtgtgacatttcagagtgttactgaattttcccctccacaacttattttgttggctttttattgtagctattttatctaga

SEQ ID NO: 23067 - DNA, 534 bp, Homo sapiens
gcagtgatcagagatgctgtaggacatgttgggagctagtctggaaatacctgtgaggaacttgggttggctggtggcctctatcctgagccagcaagtgtgcacatacatggttactgataatcaggagtgtgcactttgatcctgggcaagtgacacgatccctgctttggcactaaatttaccaatatctaagtgccagagatagctggtgagagcctgcagtgttctcagaaataaagtacacctggaaaaaaatagttattttttcccttgttaaagtaatatacaaaagaaaatacagaaaactggaaaaacagaatgaaccttagaagaaactaataataatagccaagacctatagagactcaggggctagacatggttctaagctctttaccatataaatatacttactcctcactatagctctgggaggtagataactatttctaactctattttacagagaagtaagggggcctggagctgttaggtgacttgcccgaggttgcctagcttgtaaaggcagag

SEQ ID NO: 23068 - DNA, 259 bp, Homo sapiens
ggtcgacccggaccaacacaaaaggtggcggaaagtacgttggatcaatagcaaagattgttatttagataacgaattaatctccctgttatagtactttttgtagtgaactttgcacccctttcataagaaaaaggaatttagagagagaagaaagtctcaaacaggattaaggttttaattacaattccctatcgaaatagtatgtttgatgagctgatcttatcaattaatagtaacattaaagcacaagaaacag

SEQ ID NO: 23069 - DNA, 474 bp, Homo sapiens
aaaaatcaacatagtgtctgaactaatgtgccagagatatgaaatgaaagcaatttataatttttaaaaaagtatttcaatatgcaaatgctgaggttacacacaagaagaacaaagacaagtcacacatatttctaaaacgttccgaagggggtatcccctcctaacctcactcccgttgtagcctcactttgcccctcacaccctctgacgtttgaacccttgggccagagagtagaacctgcaataggacccatcctttttcaaatttgttcccatgcagtgggactgtcacgaatatgtttataaatgttatgccataatatatacatgaaagtatagactacttaaatgctagtttggaattttagagcagtttgcattaattcctcttacaaatttatattcactttcttatttaagctgtttttgaactagagtgaattagagagccaagacttatctttataaatt

SEQ ID NO: 23070 - DNA, 513 bp, Homo sapiens
attttttgtagagacggggctcttgctgtttcccaggctggtctcgaatttctgggctcaagcaatcctctagccttggcctcccacttcattagcactaggattacaggcgtgagtcaccttgcctggtcttaaaatgtttgtttttaaattaccactactggtgatagaagtgtatgtacaggtaggtagatggtgaatgaatatttgacttaggacagcaaactggcatggcagctgtacagatgacctggcatttaatcccagggtgtgtttgagcccaccatctggaagccattcctgaaaacaaacacgatttctctaccttttgttttcattttcaactgtgaggtttgtatttcagtttagaaaatactcaagttgggccgggtgcagtggctcacacttgtaatcccagcactttgggaggccgaggtgggcggatcatgaggtcaggagtttgagaccaacctgtccagcatggtgaaaccccgtctctagtaaaaatacaaa

SEQ ID NO: 23071 - DNA, 1208 bp, Homo sapiens
ctgaaatattaactgtttcttaataaaaagttacctgaaataacaacaaaatacaactcctcagctagcttgctgttaaaccacatgaagtctgttaaaagctatttcatttattcagaataataaggaacttgggactggattatcacaaaagaggaaagctcctacagaaaaaaataaaatcaaacgacctagagtacactaatcgcatctaccctttagttaccaaacattaaatgtttttaaaaattgaaagcctgaatgtgactgtgatagatttgggtagtaatttaaagatgagtacctgaagaattctgcttcagagtataatgatgacccttcttgagttttgaacacctgaaattgtaatcactgaaatattaactgtttcttaataaaaagttacctgaaataacaacaaaatacaactcctcagctagcttgctgttaaaccacattgaagtctgttaaaagatatttatttttcttgtaaatatctgaagctgtagcttagtggaaattttagcaaggtaatggattttgctttaaaatgtctgccttacaaattcataacaacaagatttgtcagtcagcatttattcatgttttccctgatttttatcttctcaccattttacctcttttaacaggagcctgagcacaaggtttaatgaggaagctggggctataaatatgtgtgtatatatgtatatgtatgtttgtacaaatctccatgatgtttgccaagtttgaatgcgcaaaacttggaaaatgtgacaataaagaataaaagtagtaactcaaaaaaaaaaaaaaaaagaattgcaggccaggcacggtggctcatgcttgtaatcccaccactttgggaggccaaggtgggtggactgcttgaacccagaagttcaagaccagcctggacaacatggcgaaaccccatctctgcaaaaaatagcaaaaaattagccgggcatgctgtttgatgcttgtagtcccagctacttgggaggctgaggcatgagaattacttgaactcaggaggcagaggttgcagtgagctgaaatcatgccactgcaactccagcctgggtgacagaatgagaccctgtctcaaaaaaaataaatgaattgcttaacatttctgatatttgttatttagaatattgccctattagattaaaacatactgttattggaactctgtattg

SEQ ID NO: 23072 - DNA, 6103 bp, Homo sapiens
tggggtaggggcggcgccgagtcgggggagggggctgtgcgccgggctggcgcccgaccccagccaccgccctgcggccagcgcgtcccccgactcgccgcccggagaccccgaggctccaacgagttcagaaatgtccagaaatgacaaagaaccgttttttgtgaagtttttaaagtcttcagacaattccaaatgtttttttaaagctctcgagtccataaaagaattccaatcagaagaatatcttcagattattacagaagaagaggcattgaagataaaggagaatgatagatcactttatatctgtgacccttttagtggcgttgtctttgatcacctcaaaaagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacatcagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacaggctgtctgtgatcctggaaacatacgtgtgactgaagctcccaaacacccaatctctgaagaactggaaactcccataaaagacagccacctgatccctacgcctcaagcccccagtattgcctttccactcgccaacccccctgtggctccgcaccctagagaaaagattataacgatagaggagactcatgaagaattaaaaaaacagtacatatttcagttatcatctctgaatcctcaagaacgtattgactattgtcatctgattgagaaactaggtggattggtgatagaaaagcagtgctttgatcccacctgtacacacattgttgtgggacatccacttcgaaacgagaagtatttagcctcagtggcagctgggaagtgggtgcttcatcgctcctaccttgaagcctgcaggactgctggacacttcgtgcaggaagaagactatgaatggggaagtagttccatacttgatgttttgactggaatcaatgtacagcaacgaagactagcacttgcagcaatgagatggagaaaaaaaatccagcaaagacaagaatctggcattgttgagggagcatttagtgggtggaaggttattttacatgtggatcagtctcgagaagcaggcttcaaacgccttcttcagtcaggaggagcaaaggtgctacctggtcattctgtacctttatttaaagaggccacacatcttttttctgacttgaataaactgaaaccagatgactcaggagttaatatagcagaagctgctgcccagaacgtgtactgcttgagaacagaatacattgctgattatctcatgcaggaatcacctcctcatgtagaaaattactgtctaccagaagctatttcatttattcagaataataaggaacttgggactggattatcacaaaagaggaaagctcctacagaaaaaaataaaatcaaacgacctagagtacactaatcgcatctaccctttagttaccaaacattaaatgtttttaaaaattgaaagcctgaatgtgactgtgatagatttgggtagtaatttaaagatgagtacctgaagaattctgcttcagagtataatgatgacccttcttgagttttgaacacctgaaattgtaatcactgaaatattaactgtttcttaataaaaagttacctgaaataacaacaaaatacaactcctcagctagcttgctgttaaaccacattgaagtctgttaaaagatatttatttttcttgtaaatatctgaagctgtagcttagtggaaattttagcaaggtaatggattttgctttaaaatgtctgccttacaaattcataacaacaagatttgtcagtcagcatttattcatgttttccctgatttttatcttctcaccattttacctcttttaacaggagcctgagcacaaggtttaatgaggaagctggggctataaatatgtgtgtatatatgtatatgtatgtttgtacaaatctccatgatgtttgccaagtttgaatgcgcaaaacttggaaaatgtgacaataaagaataaaagtagtaactcaaattagtattaagatgtgtttacatagataaattttttaaaagagcaccctggcatctgttcttctgttgaagcaacaaaacatttatgtaacgtaaaaaatgaattgcaggggcctgggtgcggtggctcgtgcctgtaatcccagcactttgggaggctgaggcaggcggatcgtctgaggtcgggagtttgagaccagcctgaccaacatggagaaacctcatctgtactaaaaatacaaaaaattagcccagtgtggtggcacatgcctgtaatcccagctactcaggaggctgaggcaggagaatcgcttgaacccgggaggcggaggttgcggtgagctgagatcgcgccattgcactccagcctgggcaacaagagcgaaactccatctcaaaaaaaaaaaaaaaaagaattgcaggccaggcacggtggctcatgcttgtaatcccaccactttgggaggccaaggtgggtggactgcttgaacccagaagttcaagaccagcctggacaacatggcgaaaccccatctctgcaaaaaatagcaaaaaattagccgggcatgctgtttgatgcttgtagtcccagctacttgggaggctgaggcatgagaattacttgaactcaggaggcagaggttgcagtgagctgaaatcatgccactgcaactccagcctgggtgacagaatgagaccctgtctcaaaaaaaataaatgaattgcttaacatttctgatatttgttatttagaatattgccctattagattaaaacatactgttattggaactctgtattg

SEQ ID NO: 23073 - DNA, 6989 bp, Homo sapiens
tggggtaggggcggcgccgagtcgggggagggggctgtgcgccgggctggcgcccgaccccagccaccgccctgcggccagcgcgtcccccgactcgccgcccggagaccccgaggctccaacgagttcagaaatgtccagaaatgacaaagaaccgttttttgtgaagtttttaaagtcttcagacaattccaaatgtttttttaaagctctcgagtccataaaagaattccaatcagaagaatatcttcagattattacagaagaagaggcattgaagataaaggagaatgatagatcactttatatctgtgacccttttagtggcgttgtctttgatcacctcaaaaagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacatcagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacagggtaacaagaaagaaatctttgcatttgtttgtattaagtacatgttgacctcttaaaaataaacagatgagcatgttgtagttctctgatctgaatgtgcaaacaaaaaaaacttcgtagatatttctggttttggtttaaacttgagccagaaaaataatttgtaaattgaggtacttcatcagtaaattgaaaaacattttcataaatttggaaatttagaattgggcgtttttttctagacatggtgtctaccattgttcttttattctagctaaccctttttgtgtttgtggagttaatgcttggtttttcttcctatcatcttattttcatttaagtcttttgaattctgcctagcacatacctacatttgttctttggattgtatgagtttctttctgaattctcctattttttttcttccttgagctttaccttaaaaacaaaattttcctatctctcatcttttttcttccttttcttctttttcacattgcatgatgacctcccattagatatatagatttatctctgcttctgcttttctccaagtgtagaattgctctcatgttacaaatttgggttacacttaacaatgaaaacttggtatttaaggaaaatgttgggagaagcccacagataacacacttgctctgtttaatgctaataaattgcattttttctttattgttattattgtcacatgcagatgggatgcatttatttataagttctggggataggatacttttttgcctgtactttttacattccagagtttgtgcttgacttcatcttgactaagacagatgagaatatttcctagaatttgtttttagtcttatttggatcctgtcacactgcagcattttattgtcctcagctgtctgtgatcctggaaacatacgtgtgactgaagctcccaaacacccaatctctgaagaactggaaactcccataaaagacagccacctgatccctacgcctcaagcccccagtattgcctttccactcgccaacccccctgtggctccgcaccctagagaaaagattataacgatagaggagactcatgaagaattaaaaaaacagtacatatttcagttatcatctctgaatcctcaagaacgtattgactattgtcatctgattgagaaactaggtggattggtgatagaaaagcagtgctttgatcccacctgtacacacattgttgtgggacatccacttcgaaacgagaagtatttagcctcagtggcagctgggaagtgggtgcttcatcgctcctaccttgaagcctgcaggactgctggacacttcgtgcaggaagaagactatgaatggggaagtagttccatacttgatgttttgactggaatcaatgtacagcaacgaagactagcacttgcagcaatgagatggagaaaaaaaatccagcaaagacaagaatctggcattgttgagggagcatttagtgggtggaaggttattttacatgtggatcagtctcgagaagcaggcttcaaacgccttcttcagtcaggaggagcaaaggtgctacctggtcattctgtacctttatttaaagaggccacacatcttttttctgacttgaataaactgaaaccagatgactcaggagttaatatagcagaagctgctgcccagaacgtgtactgcttgagaacagaatacattgctgattatctcatgcaggaatcacctcctcatgtagaaaattactgtctaccagaagctatttcatttattcagaataataaggaacttgggactggattatcacaaaagaggaaagctcctacagaaaaaaataaaatcaaacgacctagagtacactaatcgcatctaccctttagttaccaaacattaaatgtttttaaaaattgaaagcctgaatgtgactgtgatagatttgggtagtaatttaaagatgagtacctgaagaattctgcttcagagtataatgatgacccttcttgagttttgaacacctgaaattgtaatcactgaaatattaactgtttcttaataaaaagttacctgaaataacaacaaaatacaactcctcagctagcttgctgttaaaccacattgaagtctgttaaaagatatttatttttcttgtaaatatctgaagctgtagcttagtggaaattttagcaaggtaatggattttgctttaaaatgtctgccttacaaattcataacaacaagatttgtcagtcagcatttattcatgttttccctgatttttatcttctcaccattttacctcttttaacaggagcctgagcacaaggtttaatgaggaagctggggctataaatatgtgtgtatatatgtatatgtatgtttgtacaaatctccatgatgtttgccaagtttgaatgcgcaaaacttggaaaatgtgacaataaagaataaaagtagtaactcaaattagtattaagatgtgtttacatagataaattttttaaaagagcaccctggcatctgttcttctgttgaagcaacaaaacatttatgtaacgtaaaaaatgaattgcaggggcctgggtgcggtggctcgtgcctgtaatcccagcactttgggaggctgaggcaggcggatcgtctgaggtcgggagtttgagaccagcctgaccaacatggagaaacctcatctgtactaaaaatacaaaaaattagcccagtgtggtggcacatgcctgtaatcccagctactcaggaggctgaggcaggagaatcgcttgaacccgggaggcggaggttgcggtgagctgagatcgcgccattgcactccagcctgggcaacaagagcgaaactccatctcaaaaaaaaaaaaaaaaagaattgcaggccaggcacggtggctcatgcttgtaatcccaccactttgggaggccaaggtgggtggactgcttgaacccagaagttcaagaccagcctggacaacatggcgaaaccccatctctgcaaaaaatagcaaaaaattagccgggcatgctgtttgatgcttgtagtcccagctacttgggaggctgaggcatgagaattacttgaactcaggaggcagaggttgcagtgagctgaaatcatgccactgcaactccagcctgggtgacagaatgagaccctgtctcaaaaaaaataaatgaattgcttaacatttctgatatttgttatttagaatattgccctattagattaaaacatactgttattggaactctgtattg

SEQ ID NO: 23074 - DNA, 6804 bp, Homo sapiens
ctgagaaattatatagtcatctttatttttttcttgtaatgatttgctgatttctctacagtggtcatcaactttggtaaagaattggtgaatgttacaaaatgtaattttgtaagactggtggtcttttccttcttaactcatttaaacttttctcttttttgtagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacatcagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacagggtaacaagaaagaaatctttgcatttgtttgtattaagtacatgttgacctcttaaaaataaacagatgagcatgttgtagttctctgatctgaatgtgcaaacaaaaaaaacttcgtagatatttctggttttggtttaaacttgagccagaaaaataatttgtaaattgaggtacttcatcagtaaattgaaaaacattttcataaatttggaaatttagaattgggcgtttttttctagacatggtgtctaccattgttcttttattctagctaaccctttttgtgtttgtggagttaatgcttggtttttcttcctatcatcttattttcatttaagtcttttgaattctgcctagcacatacctacatttgttctttggattgtatgagtttctttctgaattctcctattttttttcttccttgagctttaccttaaaaacaaaattttcctatctctcatcttttttcttccttttcttctttttcacattgcatgatgacctcccattagatatatagatttatctctgcttctgcttttctccaagtgtagaattgctctcatgttacaaatttgggttacacttaacaatgaaaacttggtatttaaggaaaatgttgggagaagcccacagataacacacttgctctgtttaatgctaataaattgcattttttctttattgttattattgtcacatgcagatgggatgcatttatttataagttctggggataggatacttttttgcctgtactttttacattccagagtttgtgcttgacttcatcttgactaagacagatgagaatatttcctagaatttgtttttagtcttatttggatcctgtcacactgcagcattttattgtcctcagctgtctgtgatcctggaaacatacgtgtgactgaagctcccaaacacccaatctctgaagaactggaaactcccataaaagacagccacctgatccctacgcctcaagcccccagtattgcctttccactcgccaacccccctgtggctccgcaccctagagaaaagattataacgatagaggagactcatgaagaattaaaaaaacagtacatatttcagttatcatctctgaatcctcaagaacgtattgactattgtcatctgattgagaaactaggtggattggtgatagaaaagcagtgctttgatcccacctgtacacacattgttgtgggacatccacttcgaaacgagaagtatttagcctcagtggcagctgggaagtgggtgcttcatcgctcctaccttgaagcctgcaggactgctggacacttcgtgcaggaagaagactatgaatggggaagtagttccatacttgatgttttgactggaatcaatgtacagcaacgaagactagcacttgcagcaatgagatggagaaaaaaaatccagcaaagacaagaatctggcattgttgagggagcatttagtgggtggaaggttattttacatgtggatcagtctcgagaagcaggcttcaaacgccttcttcagtcaggaggagcaaaggtgctacctggtcattctgtacctttatttaaagaggccacacatcttttttctgacttgaataaactgaaaccagatgactcaggagttaatatagcagaagctgctgcccagaacgtgtactgcttgagaacagaatacattgctgattatctcatgcaggaatcacctcctcatgtagaaaattactgtctaccagaagctatttcatttattcagaataataaggaacttgggactggattatcacaaaagaggaaagctcctacagaaaaaaataaaatcaaacgacctagagtacactaatcgcatctaccctttagttaccaaacattaaatgtttttaaaaattgaaagcctgaatgtgactgtgatagatttgggtagtaatttaaagatgagtacctgaagaattctgcttcagagtataatgatgacccttcttgagttttgaacacctgaaattgtaatcactgaaatattaactgtttcttaataaaaagttacctgaaataacaacaaaatacaactcctcagctagcttgctgttaaaccacattgaagtctgttaaaagatatttatttttcttgtaaatatctgaagctgtagcttagtggaaattttagcaaggtaatggattttgctttaaaatgtctgccttacaaattcataacaacaagatttgtcagtcagcatttattcatgttttccctgatttttatcttctcaccattttacctcttttaacaggagcctgagcacaaggtttaatgaggaagctggggctataaatatgtgtgtatatatgtatatgtatgtttgtacaaatctccatgatgtttgccaagtttgaatgcgcaaaacttggaaaatgtgacaataaagaataaaagtagtaactcaaattagtattaagatgtgtttacatagataaattttttaaaagagcaccctggcatctgttcttctgttgaagcaacaaaacatttatgtaacgtaaaaaatgaattgcaggggcctgggtgcggtggctcgtgcctgtaatcccagcactttgggaggctgaggcaggcggatcgtctgaggtcgggagtttgagaccagcctgaccaacatggagaaacctcatctgtactaaaaatacaaaaaattagcccagtgtggtggcacatgcctgtaatcccagctactcaggaggctgaggcaggagaatcgcttgaacccgggaggcggaggttgcggtgagctgagatcgcgccattgcactccagcctgggcaacaagagcgaaactccatctcaaaaaaaaaaaaaaaaagaattgcaggccaggcacggtggctcatgcttgtaatcccaccactttgggaggccaaggtgggtggactgcttgaacccagaagttcaagaccagcctggacaacatggcgaaaccccatctctgcaaaaaatagcaaaaaattagccgggcatgctgtttgatgcttgtagtcccagctacttgggaggctgaggcatgagaattacttgaactcaggaggcagaggttgcagtgagctgaaatcatgccactgcaactccagcctgggtgacagaatgagaccctgtctcaaaaaaaataaatgaattgcttaacatttctgatatttgttatttagaatattgccctattagattaaaacatactgttattggaactctgtattg

SEQ ID NO: 23075 - DNA, 6676 bp, Homo sapiens
ctatagatagccaggaaaataagtatgtatcttcacagaaataattgtatgagaatattcatagttacttatgcacagtagttaccaagtaaacctgtctcccatcagaaaaatggatatcaaattgtgtgataatcatacaatcaataggatattacttggccaaaacaaaatgaaacaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacatcagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacagggtaacaagaaagaaatctttgcatttgtttgtattaagtacatgttgacctcttaaaaataaacagatgagcatgttgtagttctctgatctgaatgtgcaaacaaaaaaaacttcgtagatatttctggttttggtttaaacttgagccagaaaaataatttgtaaattgaggtacttcatcagtaaattgaaaaacattttcataaatttggaaatttagaattgggcgtttttttctagacatggtgtctaccattgttcttttattctagctaaccctttttgtgtttgtggagttaatgcttggtttttcttcctatcatcttattttcatttaagtcttttgaattctgcctagcacatacctacatttgttctttggattgtatgagtttctttctgaattctcctattttttttcttccttgagctttaccttaaaaacaaaattttcctatctctcatcttttttcttccttttcttctttttcacattgcatgatgacctcccattagatatatagatttatctctgcttctgcttttctccaagtgtagaattgctctcatgttacaaatttgggttacacttaacaatgaaaacttggtatttaaggaaaatgttgggagaagcccacagataacacacttgctctgtttaatgctaataaattgcattttttctttattgttattattgtcacatgcagatgggatgcatttatttataagttctggggataggatacttttttgcctgtactttttacattccagagtttgtgcttgacttcatcttgactaagacagatgagaatatttcctagaatttgtttttagtcttatttggatcctgtcacactgcagcattttattgtcctcagctgtctgtgatcctggaaacatacgtgtgactgaagctcccaaacacccaatctctgaagaactggaaactcccataaaagacagccacctgatccctacgcctcaagcccccagtattgcctttccactcgccaacccccctgtggctccgcaccctagagaaaagattataacgatagaggagactcatgaagaattaaaaaaacagtacatatttcagttatcatctctgaatcctcaagaacgtattgactattgtcatctgattgagaaactaggtggattggtgatagaaaagcagtgctttgatcccacctgtacacacattgttgtgggacatccacttcgaaacgagaagtatttagcctcagtggcagctgggaagtgggtgcttcatcgctcctaccttgaagcctgcaggactgctggacacttcgtgcaggaagaagactatgaatggggaagtagttccatacttgatgttttgactggaatcaatgtacagcaacgaagactagcacttgcagcaatgagatggagaaaaaaaatccagcaaagacaagaatctggcattgttgagggagcatttagtgggtggaaggttattttacatgtggatcagtctcgagaagcaggcttcaaacgccttcttcagtcaggaggagcaaaggtgctacctggtcattctgtacctttatttaaagaggccacacatcttttttctgacttgaataaactgaaaccagatgactcaggagttaatatagcagaagctgctgcccagaacgtgtactgcttgagaacagaatacattgctgattatctcatgcaggaatcacctcctcatgtagaaaattactgtctaccagaagctatttcatttattcagaataataaggaacttgggactggattatcacaaaagaggaaagctcctacagaaaaaaataaaatcaaacgacctagagtacactaatcgcatctaccctttagttaccaaacattaaatgtttttaaaaattgaaagcctgaatgtgactgtgatagatttgggtagtaatttaaagatgagtacctgaagaattctgcttcagagtataatgatgacccttcttgagttttgaacacctgaaattgtaatcactgaaatattaactgtttcttaataaaaagttacctgaaataacaacaaaatacaactcctcagctagcttgctgttaaaccacattgaagtctgttaaaagatatttatttttcttgtaaatatctgaagctgtagcttagtggaaattttagcaaggtaatggattttgctttaaaatgtctgccttacaaattcataacaacaagatttgtcagtcagcatttattcatgttttccctgatttttatcttctcaccattttacctcttttaacaggagcctgagcacaaggtttaatgaggaagctggggctataaatatgtgtgtatatatgtatatgtatgtttgtacaaatctccatgatgtttgccaagtttgaatgcgcaaaacttggaaaatgtgacaataaagaataaaagtagtaactcaaattagtattaagatgtgtttacatagataaattttttaaaagagcaccctggcatctgttcttctgttgaagcaacaaaacatttatgtaacgtaaaaaatgaattgcaggggcctgggtgcggtggctcgtgcctgtaatcccagcactttgggaggctgaggcaggcggatcgtctgaggtcgggagtttgagaccagcctgaccaacatggagaaacctcatctgtactaaaaatacaaaaaattagcccagtgtggtggcacatgcctgtaatcccagctactcaggaggctgaggcaggagaatcgcttgaacccgggaggcggaggttgcggtgagctgagatcgcgccattgcactccagcctgggcaacaagagcgaaactccatctcaaaaaaaaaaaaaaaaagaattgcaggccaggcacggtggctcatgcttgtaatcccaccactttgggaggccaaggtgggtggactgcttgaacccagaagttcaagaccagcctggacaacatggcgaaaccccatctctgcaaaaaatagcaaaaaattagccgggcatgctgtttgatgcttgtagtcccagctacttgggaggctgaggcatgagaattacttgaactcaggaggcagaggttgcagtgagctgaaatcatgccactgcaactccagcctgggtgacagaatgagaccctgtctcaaaaaaaataaatgaattgcttaacatttctgatatttgttatttagaatattgccctattagattaaaacatactgttattggaactctgtattg

SEQ ID NO: 23076 - DNA, 5701 bp, Homo sapiens
tttttatgggctttggtgagggaggtagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacatcagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacagggtaacaagaaagaaatctttgcatttgtttgtattaagtacatgttgacctcttaaaaataaacagatgagcatgttgtagttctctgatctgaatgtgcaaacaaaaaaaacttcgtagatatttctggttttggtttaaacttgagccagaaaaataatttgtaaattgaggtacttcatcagtaaattgaaaaacattttcataaatttggaaatttagaattgggcgtttttttctagacatggtgtctaccattgttcttttattctagctaaccctttttgtgtttgtggagttaatgcttggtttttcttcctatcatcttattttcatttaagtcttttgaattctgcctagcacatacctacatttgttctttggattgtatgagtttctttctgaattctcctattttttttcttccttgagctttaccttaaaaacaaaattttcctatctctcatcttttttcttccttttcttctttttcacattgcatgatgacctcccattagatatatagatttatctctgcttctgcttttctccaagtgtagaattgctctcatgttacaaatttgggttacacttaacaatgaaaacttggtatttaaggaaaatgttgggagaagcccacagataacacacttgctctgtttaatgctaataaattgcattttttctttattgttattattgtcacatgcagatgggatgcatttatttataagttctggggataggatacttttttgcctgtactttttacattccagagtttgtgcttgacttcatcttgactaagacagatgagaatatttcctagaatttgtttttagtcttatttggatcctgtcacactgcagcattttattgtcctcagctgtctgtgatcctggaaacatacgtgtgactgaagctcccaaacacccaatctctgaagaactggaaactcccataaaagacagccacctgatccctacgcctcaagcccccagtattgcctttccactcgccaacccccctgtggctccgcaccctagagaaaagattataacgatagaggagactcatgaagaattaaaaaaacagtacatatttcagttatcatctctgaatcctcaagaacgtattgactattgtcatctgattgagaaactaggtggattggtgatagaaaagcagtgctttgatcccacctgtacacacattgttgtgggacatccacttcgaaacgagaagtatttagcctcagtggcagctgggaagtgggtgcttcatcgctcctaccttgaagcctgcaggactgctggacacttcgtgcaggaagaagactatgaatggggaagtagttccatacttgatgttttgactggaatcaatgtacagcaacgaagactagcacttgcagcaatgagatggagaaaaaaaatccagcaaagacaagaatctggcattgttgagggagcatttagtgggtggaaggttattttacatgtggatcagtctcgagaagcaggcttcaaacgccttcttcagtcaggaggagcaaaggtgctacctggtcattctgtacctttatttaaagaggccacacatcttttttctgacttgaataaactgaaaccagatgactcaggagttaatatagcagaagctgctgcccagaacgtgtactgcttgagaacagaatacattgctgattatctcatgcaggaatcacctcctcatgtagaaaattactgtctaccagaagctatttcatttattcagaataataaggaacttgggactggattatcacaaaagaggaaagctcctacagaaaaaaataaaatcaaacgacctagagtacactaatcgcatctaccctttagttaccaaacattaaatgtttttaaaaattgaaagcctgaatgtgactgtgatagatttgggtagtaatttaaagatgagtacctgaagaattctgcttcagagtataatgatgacccttcttgagttttgaacacctgaaattgtaatcactgaaatattaactgtttcttaataaaaagttacctgaaataacaacaaaatacaactcctcagctagcttgctgttaaaccacattgaagtctgttaaaagatatttatttttcttgtaaatatctgaagctgtagcttagtggaaattttagcaaggtaatggattttgctttaaaatgtctgccttacaaattcataacaacaagatttgtcagtcagcatttattcatgttttccctgatttttatcttctcaccattttacctcttttaacaggagcctgagcacaaggtttaatgaggaagctggggctataaatatgtgtgtatatatgtatatgtatgtttgtacaaatctccatgatgtttgccaagtttgaatgcgcaaaacttggaaaatgtgacaataaagaataaaagtagtaactcaaattagtattaagatgtgtttacatagataaattttttaaaagagcaccctggcatctgttcttctgttgaagcaacaaaacatttatgtaacgtaaaaaatgaattgcaggggcctgggtgcggtggctcgtgcctgtaatcccagcactttgggaggctgaggcaggcggatcgtctgaggtcgggagtttgagaccagcctgaccaacatggagaaacctcatctgtactaaaaatacaaaaaattagcccagtgtggtggcacatgcctgtaatcccagctactcaggaggctgaggcaggagaatcgcttgaacccgggaggcggaggttgcggtgagctgagatcgcgccattgcactccagcctgggcaacaagagcgaaactccatctcaaaaaaaaaaaaaaaaagaattgcaggccaggcacggtggctcatgcttgtaatcccaccactttgggaggccaaggtgggtggactgcttgaacccagaagttcaagaccagcctggacaacatggcgaaaccccatctctgcaaaaaatagcaaaaaattagccgggcatgctgtttgatgcttgtagtcccagctacttgggaggctgaggcatgagaattacttgaactcaggaggcagaggttgcagtgagctgaaatcatgccactgcaactccagcctgggtgacagaatgagaccctgtctcaaaaaaaataaatgaattgcttaacatttctgatatttgttatttagaatattgccctattagattaaaacatactgttattggaactctgtattg

SEQ ID NO: 23077 - DNA, 6082 bp, Homo sapiens
tggggtaggggcggcgccgagtcgggggagggggctgtgcgccgggctggcgcccgaccccagccaccgccctgcggccagcgcgtcccccgactcgccgcccggagaccccgaggctccaacgagttcagaaatgtccagaaatgacaaagaaccgttttttgtgaagtttttaaagtcttcagacaattccaaatgtttttttaaagctctcgagtccataaaagaattccaatcagaagaatatcttcagattattacagaagaagaggcattgaagataaaggagaatgatagatcactttatatctgtgacccttttagtggcgttgtctttgatcacctcaaaaagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacatcagcctgaaagtaaagcagctcttttaaaaaagaagaacagcagcttctctaagaaagactttgctcctagtgaaaagcatgagcaagctgatgaagatctgctctctcaatatgaaaatggtagctccacagtagctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacagggtaacaagaaagaaatctttgcatttgtttgtattaagtacatgttgacctcttaaaaataaacagatgagcatgttgtagttctctgatctgaatgtgcaaacaaaaaaaacttcgtagatatttctggttttggtttaaacttgagccagaaaaataatttgtaaattgaggtacttcatcagtaaattgaaaaacattttcataaatttggaaatttagaattgggcgtttttttctagacatggtgtctaccattgttcttttattctagctaaccctttttgtgtttgtggagttaatgcttggtttttcttcctatcatcttattttcatttaagtcttttgaattctgcctagcacatacctacatttgttctttggattgtatgagtttctttctgaattctcctattttttttcttccttgagctttaccttaaaaacaaaattttcctatctctcatcttttttcttccttttcttctttttcacattgcatgatgacctcccattagatatatagatttatctctgcttctgcttttctccaagtgtagaattgctctcatgttacaaatttgggttacacttaacaatgaaaacttggtatttaaggaaaatgttgggagaagcccacagataacacacttgctctgtttaatgctaataaattgcattttttctttattgttattattgtcacatgcagatgggatgcatttatttataagttctggggataggatacttttttgcctgtactttttacattccagagtttgtgcttgacttcatcttgactaagacagatgagaatatttcctagaatttgtttttagtcttatttggatcctgtcacactgcagcattttattgtcctcagctgtctgtgatcctggaaacatacgtgtgactgaagctcccaaacacccaatctctgaagaactggaaactcccataaaagacagccacctgatccctacgcctcaagcccccagtattgcctttccactcgccaacccccctgtggctccgcaccctagagaaaagattataacgatagaggagactcatgaagaattaaaaaaacagtacatatttcagttatcatctctgaatcctcaagaacgtattgactattgtcatctgattgagaaactaggtggattggtgatagaaaagcagtgctttgatcccacctgtacacacattgttgtgggacatccacttcgaaacgagaagtatttagcctcagtggcagctgggaagtgggtgcttcatcgctcctaccttgaagcctgcaggactgctggacacttcgtgcaggaagaagactatgaatggggaagtagttccatacttgatgttttgactggaatcaatgtacagcaacgaagactagcacttgcagcaatgagatggagaaaaaaaatccagcaaagacaagaatctggcattgttgagggagcatttagtgggtggaaggttattttacatgtggatcagtctcgagaagcaggcttcaaacgccttcttcagtcaggaggagcaaaggtgctacctggtcattctgtacctttatttaaagaggccacacatcttttttctgacttgaataaactgaaaccagatgactcaggagttaatatagcagaagctgctgcccagaacgtgtactgcttgagaacagaatacattgctgattatctcatgcaggaatcacctcctcatgtagaaaattactgtctaccagaagctatttcatttattcagaataataaggaacttgggactggattatcacaaaagaggaaagctcctacagaaaaaaataaaatcaaacgacctagagtacactaatcgcatctaccctttagttaccaaacattaaatgtttttaaaaattgaaagcctgaatgtgactgtgatagatttgggtagtaatttaaagatgagtacctgaagaattctgcttcagagtataatgatgacccttcttgagttttgaacacctgaaattgtaatcactgaaatattaactgtttcttaataaaaagttacctgaaataacaacaaaatacaactcctcagctagcttgctgttaaaccacattgaagtctgttaaaagatatttatttttcttgtaaatatctgaagctgtagcttagtggaaattttagcaaggtaatggattttgctttaaaatgtctgccttacaaattcataacaacaagatttgtcagtcagcatttattcatgttttccctgatttttatcttctcaccattttacctcttttaacaggagcctgagcacaaggtttaatgaggaagctggggctataaatatgtgtgtatatatgtatatgtatgtttgtacaaatctccatgatgtttgccaagtttgaatgcgcaaaacttggaaaatgtgacaataaagaataaaagtagtaactcaaattagtattaagatgtgtttacatagataaattttttaaaagagcaccctggcatctgttcttctgttgaagcaacaaaacatttatgtaacgtaaaaaatgaattgcaggggcctgggtgcggtggctcgtgcctgtaatcccagcactttgggaggctgaggcaggcggatcgtctgaggtcgggagtttgagaccagcctgaccaacatggagaaacctcatctgtactaaaaatacaaaaaattagcccagtgtggtggcacatgcctgtaatcccagctactcaggaggctgaggcaggagaatcgcttgaacccgggaggcggaggttgcggtgagctgagatcgcgccattgcactccagcctgggcaacaagagcgaaactccatctcaaaaaaaaaaaaaaaaagaattgcaggccaggcacggtggctcatgcttgtaatcccaccactttgggaggccaaggtgggtggactgcttgaacccagaagttcaagaccagcctggacaacatggcgaaaccccatctctgcaaaaaatagcaaaaaattagccgggcatgctgtttgatgcttgtagtcccagctacttgggaggctgaggcatgagaattacttgaactcaggaggcagaggttgcagtgagctgaaatcatgccactgcaactccagcctgggtgacagaatgagaccctgtctcaaaaaaaataaatgaattgcttaacatttctgatatttgttatttagaatattgccctattagattaaaacatactgttattggaactctgtattg

SEQ ID NO: 23078 - DNA, 3218 bp, Homo sapiens
ggtcgactgtaggaggtctagagtatccacgccgcgctgtcgctgattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacaggctgtctgtgatcctggaaacatacgtgtgactgaagctcccaaacacccaatctctgaagaactggaaactcccataaaagacagccacctgatccctacgcctcaagcccccagtattgcctttccactcgccaacccccctgtggctccgcaccctagagaaaagattataacgatagaggagactcatgaagaattaaaaaaacagtacatatttcagttatcatctctgaatcctcaagaacgtattgactattgtcatctgattgagaaactaggtggattggtgatagaaaagcagtgctttgatcccacctgtacacacattgttgtgggacatccacttcgaaacgagaagtatttagcctcagtggcagctgggaagtgggtgcttcatcgctcctaccttgaagcctgcaggactgctggacacttcgtgcaggaagaagactatgaatggggaagtagttccatacttgatgttttgactggaatcaatgtacagcaacgaagactagcacttgcagcaatgagatggagaaaaaaaatccagcaaagacaagaatctggcattgttgagggagcatttagtgggtggaaggttattttacatgtggatcagtctcgagaagcaggcttcaaacgccttcttcagtcaggaggagcaaaggtgctacctggtcattctgtacctttatttaaagaggccacacatcttttttctgacttgaataaactgaaaccagatgactcaggagttaatatagcagaagctgctgcccagaacgtgtactgcttgagaacagaatacattgctgattatctcatgcaggaatcacctcctcatgtagaaaattactgtctaccagaagctatttcatttattcagaataataaggaacttgggactggattatcacaaaagaggaaagctcctacagaaaaaaataaaatcaaacgacctagagtacactaatcgcatctaccctttagttaccaaacattaaatgtttttaaaaattgaaagcctgaatgtgactgtgatagatttgggtagtaatttaaagatgagtacctgaagaattctgcttcagagtataatgatgacccttcttgagttttgaacacctgaaattgtaatcactgaaatattaactgtttcttaataaaaagttacctgaaataacaacaaaatacaactcctcagctagcttgctgttaaaccacattgaagtctgttaaaagatatttatttttcttgtaaatatctgaagctgtagcttagtggaaattttagcaaggtaatggattttgctttaaaatgtctgccttacaaattcataacaacaagatttgtcagtcagcatttattcatgttttccctgatttttatcttctcaccattttacctcttttaacaggagcctgagcacaaggtttaatgaggaagctggggctataaatatgtgtgtatatatgtatatgtatgtttgtacaaatctccatgatgtttgccaagtttgaatgcgcaaaacttggaaaatgtgacaataaagaataaaagtagtaactcaaattagtattaagatgtgtttacatagataaattttttaaaagagcaccctggcatctgttcttctgttgaagcaacaaaacatttatgtaacgtaaaaaatgaattgcaggggcctgggtgcggtggctcgtgcctgtaatcccagcactttgggaggctgaggcaggcggatcgtctgaggtcgggagtttgagaccagcctgaccaacatggagaaacctcatctgtactaaaaatacaaaaaattagcccagtgtggtggcacatgcctgtaatcccagctactcaggaggctgaggcaggagaatcgcttgaacccgggaggcggaggttgcggtgagctgagatcgcgccattgcactccagcctgggcaacaagagcgaaactccatctcaaaaaaaaaaaaaaaaagaattgcaggccaggcacggtggctcatgcttgtaatcccaccactttgggaggccaaggtgggtggactgcttgaacccagaagttcaagaccagcctggacaacatggcgaaaccccatctctgcaaaaaatagcaaaaaattagccgggcatgctgtttgatgcttgtagtcccagctacttgggaggctgaggcatgagaattacttgaactcaggaggcagaggttgcagtgagctgaaatcatgccactgcaactccagcctgggtgacagaatgagaccctgtctcaaaaaaaataaatgaattgcttaacatttctgatatttgttatttagaatattgccctattagattaaaacatactgttattggaactctgtattg

SEQ ID NO: 23079 - DNA, 6591 bp, Homo sapiens
tggggtaggggcggcgccgagtcgggggagggggctgtgcgccgggctggcgcccgaccccagccaccgccctgcggccagcgcgtcccccgactcgccgcccggagaccccgaggctccaacgagttcagaaatgtccagaaatgacaaagaaccgttttttgtgaagtttttaaagtcttcagacaattccaaatgtttttttaaagctctcgagtccataaaagaattccaatcagaagaatatcttcagattattacagaagaagaggcattgaagataaaggagaatgatagatcactttatatctgtgacccttttagtggcgttgtctttgatcacctcaaaaagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacatcagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacagggtaacaagaaagaaatctttgcatttgtttgtattaagtacatgttgacctcttaaaaataaacagatgagcatgttgtagttctctgatctgaatgtgcaaacaaaaaaaacttcgtagatatttctggttttggtttaaacttgagccagaaaaataatttgtaaattgaggtacttcatcagtaaattgaaaaacattttcataaatttggaaatttagaattgggcgtttttttctagacatggtgtctaccattgttcttttattctagctaaccctttttgtgtttgtggagttaatgcttggtttttcttcctatcatcttattttcatttaagtcttttgaattctgcctagcacatacctacatttgttctttggattgtatgagtttctttctgaattctcctattttttttcttccttgagctttaccttaaaaacaaaattttcctatctctcatcttttttcttccttttcttctttttcacattgcatgatgacctcccattagatatatagatttatctctgcttctgcttttctccaagtgtagaattgctctcatgttacaaatttgggttacacttaacaatgaaaacttggtatttaaggaaaatgttgggagaagcccacagataacacacttgctctgtttaatgctaataaattgcattttttctttattgttattattgtcacatgcagatgggatgcatttatttataagttctggggataggatacttttttgcctgtactttttacattccagagtttgtgcttgacttcatcttgactaagacagatgagaatatttcctagaatttgtttttagtcttatttggatcctgtcacactgcagcattttattgtcctcagctgtctgtgatcctggaaacatacgtgtgactgaagctcccaaacacccaatctctgaagaactggaaactcccataaaagacagccacctgatccctacgcctcaagcccccagtattgcctttccactcgccaacccccctgtggctccgcaccctagagaaaagattataacgatagaggagactcatgaagaattaaaaaaacagtacatatttcagttatcatctctgaatcctcaagaacgtattgactattgtcatctgattgagaaactaggtggattggtgatagaaaagcagtgctttgatcccacctgtacacacattgttgtgggacatccacttcgaaacgagaagtatttagcctcagtggcagctgggaagtgggtgcttcatcgctcctaccttgaagcctgcaggactgctggacacttcgtgcaggaagaagactatgaatggggaagtagttccatacttgatgttttgactggaatcaatgtacagcaacgaagactagcacttgcagcaatgagatggagaaaaaaaatccagcaaagacaagaatctggcattgttgagggagcatttagtgggtggaaggttattttacatgtggatcagtctcgagaagcaggcttcaaacgccttcttcagtcaggaggagcaaaggtgctacctggtcattctgtacctttatttaaagaggccacacatcttttttctgacttgaataaactgaaaccagatgactcaggagttaatatagcagaagctgctgcccagaacgtgtactgcttgagaacagaatacattgctgattatctcatgcaggaatcacctcctcatgtagaaaattactgtctaccagaagctatttcatttattcagaataataaggaacttgggactggattatcacaaaagaggaaagctcctacagaaaaaaataaaatcaaacgacctagagtacactaatcgcatctaccctttagttaccaaacattaaatgtttttaaaaattgaaagcctgaatgtgactgtgatagatttgggtagtaatttaaagatgagtacctgaagaattctgcttcagagtataatgatgacccttcttgagttttgaacacctgaaattgtaatcactgaaatattaactgtttcttaataaaaagttacctgaaataacaacaaaatacaactcctcagctagcttgctgttaaaccacattgaagtctgttaaaagatatttatttttcttgtaaatatctgaagctgtagcttagtggaaattttagcaaggtaatggattttgctttaaaatgtctgccttacaaattcataacaacaagatttgtcagtcagcatttattcatgttttccctgatttttatcttctcaccattttacctcttttaacaggagcctgagcacaaggtttaatgaggaagctggggctataaatatgtgtgtatatatgtatatgtatgtttgtacaaatctccatgatgtttgccaagtttgaatgcgcaaaacttggaaaatgtgacaataaagaataaaagtagtaactcaaaaaaaaaaaaaaaaagaattgcaggccaggcacggtggctcatgcttgtaatcccaccactttgggaggccaaggtgggtggactgcttgaacccagaagttcaagaccagcctggacaacatggcgaaaccccatctctgcaaaaaatagcaaaaaattagccgggcatgctgtttgatgcttgtagtcccagctacttgggaggctgaggcatgagaattacttgaactcaggaggcagaggttgcagtgagctgaaatcatgccactgcaactccagcctgggtgacagaatgagaccctgtctcaaaaaaaataaatgaattgcttaacatttctgatatttgttatttagaatattgccctattagattaaaacatactgttattggaactctgtattg

SEQ ID NO: 23080 - DNA, 6091 bp, Homo sapiens
tggggtaggggcggcgccgagtcgggggagggggctgtgcgccgggctggcgcccgaccccagccaccgccctgcggccagcgcgtcccccgactcgccgcccggagaccccgaggctccaacgagttcagaaatgtccagaaatgacaaagaaccgttttttgtgaagtttttaaagtcttcagacaattccaaatgtttttttaaagctctcgagtccataaaagaattccaatcagaagaatatcttcagattattacagaagaagaggcattgaagataaaggagaatgatagatcactttatatctgtgacccttttagtggcgttgtctttgatcacctcaaaaagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacatcagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacagggtaacaagaaagaaatctttgcatttgtttgtattaagtacatgttgacctcttaaaaataaacagatgagcatgttgtagttctctgatctgaatgtgcaaacaaaaaaaacttcgtagatatttctggttttggtttaaacttgagccagaaaaataatttgtaaattgaggtacttcatcagtaaattgaaaaacattttcataaatttggaaatttagaattgggcgtttttttctagacatggtgtctaccattgttcttttattctagctaaccctttttgtgtttgtggagttaatgcttggtttttcttcctatcatcttattttcatttaagtcttttgaattctgcctagcacatacctacatttgttctttggattgtatgagtttctttctgaattctcctattttttttcttccttgagctttaccttaaaaacaaaattttcctatctctcatcttttttcttccttttcttctttttcacattgcatgatgacctcccattagatatatagatttatctctgcttctgcttttctccaagtgtagaattgctctcatgttacaaatttgggttacacttaacaatgaaaacttggtatttaaggaaaatgttgggagaagcccacagataacacacttgctctgtttaatgctaataaattgcattttttctttattgttattattgtcacatgcagatgggatgcatttatttataagttctggggataggatacttttttgcctgtactttttacattccagagtttgtgcttgacttcatcttgactaagacagatgagaatatttcctagaatttgtttttagtcttatttggatcctgtcacactgcagcattttattgtcctcagctgtctgtgatcctggaaacatacgtgtgactgaagctcccaaacacccaatctctgaagaactggaaactcccataaaagacagccacctgatccctacgcctcaagcccccagtattgcctttccactcgccaacccccctgtggctccgcaccctagagaaaagattataacgatagaggagactcatgaagaattaaaaaaacagtacatatttcagttatcatctctgaatcctcaagaacgtattgactattgtcatctgattgagaaactaggtggattggtgatagaaaagcagtgctttgatcccacctgtacacacattgttgtgggacatccacttcgaaacgagaagtatttagcctcagtggcagctgggaagtgggtgcttcatcgctcctaccttgaagcctgcaggactgctggacacttcgtgcaggaagaagactatgaatggggaagtagttccatacttgatgttttgactggaatcaatgtacagcaacgaagactagcacttgcagcaatgagatggagaaaaaaaatccagcaaagacaagaatctggcattgttgagggagcatttagtgggtggaaggttattttacatgtggatcagtctcgagaagcaggcttcaaacgccttcttcagtcaggaggagcaaaggtgctacctggtcattctgtacctttatttaaagaggccacacatcttttttctgacttgaataaactgaaaccagatgactcaggagttaatatagcagaagctgctgcccagaacgtgtactgcttgagaacagaatacattgctgattatctcatgcaggaatcacctcctcatgtagaaaattactgtctaccagaagctatttcatttattcagaataataaggaacttgggactggattatcacaaaagaggaaagctcctacagaaaaaaataaaatcaaacgacctagagtacactaatcgcatctaccctttagttaccaaacattaaatgtttttaaaaattgaaagcctgaatgtgactgtgatagatttgggtagtaatttaaagatgagtacctgaagaattctgcttcagagtataatgatgacccttcttgagttttgaacacctgaaattgtaatcactgaaatattaactgtttcttaataaaaagttacctgaaataacaacaaaatacaactcctcagctagcttgctgttaaaccacattgaagtctgttaaaagatatttatttttcttgtaaatatctgaagctgtagcttagtggaaattttagcaaggtaatggattttgctttaaaatgtctgccttacaaattcataacaacaagatttgtcagtcagcatttattcatgttttccctgatttttatcttctcaccattttacctcttttaacaggagcctgagcacaaggttaactcagagcggtgagcctcatgtgggatcctctagacag

SEQ ID NO: 23081 - DNA, 6869 bp, Homo sapiens
tggggtaggggcggcgccgagtcgggggagggggctgtgcgccgggctggcgcccgaccccagccaccgccctgcggccagcgcgtcccccgactcgccgcccggagaccccgaggctccaacgagttcagaaatgtccagaaatgacaaagaaccgttttttgtgaagtttttaaagtcttcagacaattccaaatgtttttttaaagctctcgagtccataaaagaattccaatcagaagaatatcttcagattattacagaagaagaggcattgaagataaaggagaatgatagatcactttatatctgtgacccttttagtggcgttgtctttgatcacctcaaaaagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacatcagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacagggtaacaagaaagaaatctttgcatttgtttgtattaagtacatgttgacctcttaaaaataaacagatgagcatgttgtagttctctgatctgaatgtgcaaacaaaaaaaacttcgtagatatttctggttttggtttaaacttgagccagaaaaataatttgtaaattgaggtacttcatcagtaaattgaaaaacattttcataaatttggaaatttagaattgggcgtttttttctagacatggtgtctaccattgttcttttattctagctaaccctttttgtgtttgtggagttaatgcttggtttttcttcctatcatcttattttcatttaagtcttttgaattctgcctagcacatacctacatttgttctttggattgtatgagtttctttctgaattctcctattttttttcttccttgagctttaccttaaaaacaaaattttcctatctctcatcttttttcttccttttcttctttttcacattgcatgatgacctcccattagatatatagatttatctctgcttctgcttttctccaagtgtagaattgctctcatgttacaaatttgggttacacttaacaatgaaaacttggtatttaaggaaaatgttgggagaagcccacagataacacacttgctctgtttaatgctaataaattgcattttttctttattgttattattgtcacatgcagatgggatgcatttatttataagttctggggataggatacttttttgcctgtactttttacattccagagtttgtgcttgacttcatcttgactaagacagatgagaatatttcctagaatttgtttttagtcttatttggatcctgtcacactgcagcattttattgtcctcagctgtctgtgatcctggaaacatacgtgtgactgaagctcccaaacacccaatctctgaagaactggaaactcccataaaagacagccacctgatccctacgcctcaagcccccagtattgcctttccactcgccaacccccctgtggctccgcaccctagagaaaagattataacgatagaggagactcatgaagaattaaaaaaacagtacatatttcagttatcatctctgaatcctcaagaacgtattgactattgtcatctgattgagaaactaggtggattggtgatagaaaagcagtgctttgatcccacctgtacacacattgttgtgggacatccacttcgaaacgagaagtatttagcctcagtggcagctgggaagtgggtgcttcatcgctcctaccttgaagcctgcaggactgctggacacttcgtgcaggaagaagactatgaatggggaagtagttccatacttgatgttttgactggaatcaatgtacagcaacgaagactagcacttgcagcaatgagatggagaaaaaaaatccagcaaagacaagaatctggcattgttgagggagcatttagtgggtggaaggttattttacatgtggatcagtctcgagaagcaggcttcaaacgccttcttcagtcaggaggagcaaaggtgctacctggtcattctgtacctttatttaaagaggccacacatcttttttctgacttgaataaactgaaaccagatgactcaggagttaatatagcagaagctgctgcccagaacgtgtactgcttgagaacagaatacattgctgattatctcatgcaggaatcacctcctcatgtagaaaattactgtctaccagaagctatttcatttattcagaataataaggaacttgggactggattatcacaaaagaggaaagctcctacagaaaaaaataaaatcaaacgacctagagtacactaatcgcatctaccctttagttaccaaacattaaatgtttttaaaaattgaaagcctgaatgtgactgtgatagatttgggtagtaatttaaagatgagtacctgaagaattctgcttcagagtataatgatgacccttcttgagttttgaacacctgaaattgtaatcactgaaatattaactgtttcttaataaaaagttacctgaaataacaacaaaatacaactcctcagctagcttgctgttaaaccacattgaagtctgttaaaagatatttatttttcttgtaaatatctgaagctgtagcttagtggaaattttagcaaggagcctgagcacaaggtttaatgaggaagctggggctataaatatgtgtgtatatatgtatatgtatgtttgtacaaatctccatgatgtttgccaagtttgaatgcgcaaaacttggaaaatgtgacaataaagaataaaagtagtaactcaaattagtattaagatgtgtttacatagataaattttttaaaagagcaccctggcatctgttcttctgttgaagcaacaaaacatttatgtaacgtaaaaaatgaattgcaggggcctgggtgcggtggctcgtgcctgtaatcccagcactttgggaggctgaggcaggcggatcgtctgaggtcgggagtttgagaccagcctgaccaacatggagaaacctcatctgtactaaaaatacaaaaaattagcccagtgtggtggcacatgcctgtaatcccagctactcaggaggctgaggcaggagaatcgcttgaacccgggaggcggaggttgcggtgagctgagatcgcgccattgcactccagcctgggcaacaagagcgaaactccatctcaaaaaaaaaaaaaaaaagaattgcaggccaggcacggtggctcatgcttgtaatcccaccactttgggaggccaaggtgggtggactgcttgaacccagaagttcaagaccagcctggacaacatggcgaaaccccatctctgcaaaaaatagcaaaaaattagccgggcatgctgtttgatgcttgtagtcccagctacttgggaggctgaggcatgagaattacttgaactcaggaggcagaggttgcagtgagctgaaatcatgccactgcaactccagcctgggtgacagaatgagaccctgtctcaaaaaaaataaatgaattgcttaacatttctgatatttgttatttagaatattgccctattagattaaaacatactgttattggaactctgtattg

SEQ ID NO: 23082 - DNA, 5808 bp, Homo sapiens
tggggtaggggcggcgccgagtcgggggagggggctgtgcgccgggctggcgcccgaccccagccaccgccctgcggccagcgcgtcccccgactcgccgcccggagaccccgaggctccaacgagttcagaaatgtccagaaatgacaaagaaccgttttttgtgaagtttttaaagtcttcagacaattccaaatgtttttttaaagctctcgagtccataaaagaattccaatcagaagaatatcttcagattattacagaagaagaggcattgaagataaaggagaatgatagatcactttatatctgtgacccttttagtggcgttgtctttgatcacctcaaaaagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacatcagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacagggtaacaagaaagaaatctttgcatttgtttgtattaagtacatgttgacctcttaaaaataaacagatgagcatgttgtagttctctgatctgaatgtgcaaacaaaaaaaacttcgtagatatttctggttttggtttaaacttgagccagaaaaataatttgtaaattgaggtacttcatcagtaaattgaaaaacattttcataaatttggaaatttagaattgggcgtttttttctagacatggtgtctaccattgttcttttattctagctaaccctttttgtgtttgtggagttaatgcttggtttttcttcctatcatcttattttcatttaagtcttttgaattctgcctagcacatacctacatttgttctttggattgtatgagtttctttctgaattctcctattttttttcttccttgagctttaccttaaaaacaaaattttcctatctctcatcttttttcttccttttcttctttttcacattgcatgatgacctcccattagatatatagatttatctctgcttctgcttttctccaagtgtagaattgctctcatgttacaaatttgggttacacttaacaatgaaaacttggtatttaaggaaaatgttgggagaagcccacagataacacacttgctctgtttaatgctaataaattgcattttttctttattgttattattgtcacatgcagatgggatgcatttatttataagttctggggataggatacttttttgcctgtactttttacattccagagtttgtgcttgacttcatcttgactaagacagatgagaatatttcctagaatttgtttttagtcttatttggatcctgtcacactgcagcattttattgtcctcagctgtctgtgatcctggaaacatacgtgtgactgaagctcccaaacacccaatctctgaagaactggaaactcccataaaagacagccacctgatccctacgcctcaagcccccagtattgcctttccactcgccaacccccctgtggctccgcaccctagagaaaagattataacgatagaggagactcatgaagaattaaaaaaacagtacatatttcagttatcatctctgaatcctcaagaacgtattgactattgtcatctgattgagaaactaggtggattggtgatagaaaagcagtgctttgatcccacctgtacacacattgttgtgggacatccacttcgaaacgagaagtatttagcctcagtggcagctgggaagtgggtgcttcatcgctcctaccttgaagcctgcaggactgctggacacttcgtgcaggaagaagactatgaatggggaagtagttccatacttgatgttttgactggaatcaatgtacagcaacgaagactagcacttgcagcaatgagatggagaaaaaaaatccagcaaagacaagaatctggcattgttgagggagcatttagtgggtggaaggttattttacatgtggatcagtctcgagaagcaggcttcaaacgccttcttcagtcaggaggagcaaaggtgctacctggtcattctgtacctttatttaaagaggccacacatcttttttctgacttgaataaactgaaaccagatgactcaggagttaatatagcagaagctgctgcccagaacgtgtactgcttgagaacagaatacattgctgattatctcatgcaggtaggaatcctcaacctgtgcctaggattcagcaacaaaccacctggaacacatggtcccttagcacttgaagaggttaaagcctaacctgctatgtgactgtagacagagcctttataaggggattaaatgaggtcataagaatgagtccctaacccaccaggactagtgtcctggtaagaagagggaggcacaccaggagtttgccggcacggaggaaaagccctgtgaggacacggggagggcagctatctgtttacacaccaggaagaaatgtctcaccagataccaaccctggccgtctcctggattttggatttccaatctccagaactgtgagaaaataaatttctgtttaagccac

SEQ ID NO: 23083 - DNA, 5824 bp, Homo sapiens
tggggtaggggcggcgccgagtcgggggagggggctgtgcgccgggctggcgcccgaccccagccaccgccctgcggccagcgcgtcccccgactcgccgcccggagaccccgaggctccaacgagttcagaaatgtccagaaatgacaaagaaccgttttttgtgaagtttttaaagtcttcagacaattccaaatgtttttttaaagctctcgagtccataaaagaattccaatcagaagaatatcttcagattattacagaagaagaggcattgaagataaaggagaatgatagatcactttatatctgtgacccttttagtggcgttgtctttgatcacctcaaaaagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacatcagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacagggtaacaagaaagaaatctttgcatttgtttgtattaagtacatgttgacctcttaaaaataaacagatgagcatgttgtagttctctgatctgaatgtgcaaacaaaaaaaacttcgtagatatttctggttttggtttaaacttgagccagaaaaataatttgtaaattgaggtacttcatcagtaaattgaaaaacattttcataaatttggaaatttagaattgggcgtttttttctagacatggtgtctaccattgttcttttattctagctaaccctttttgtgtttgtggagttaatgcttggtttttcttcctatcatcttattttcatttaagtcttttgaattctgcctagcacatacctacatttgttctttggattgtatgagtttctttctgaattctcctattttttttcttccttgagctttaccttaaaaacaaaattttcctatctctcatcttttttcttccttttcttctttttcacattgcatgatgacctcccattagatatatagatttatctctgcttctgcttttctccaagtgtagaattgctctcatgttacaaatttgggttacacttaacaatgaaaacttggtatttaaggaaaatgttgggagaagcccacagataacacacttgctctgtttaatgctaataaattgcattttttctttattgttattattgtcacatgcagatgggatgcatttatttataagttctggggataggatacttttttgcctgtactttttacattccagagtttgtgcttgacttcatcttgactaagacagatgagaatatttcctagaatttgtttttagtcttatttggatcctgtcacactgcagcattttattgtcctcagctgtctgtgatcctggaaacatacgtgtgactgaagctcccaaacacccaatctctgaagaactggaaactcccataaaagacagccacctgatccctacgcctcaagcccccagtattgcctttccactcgccaacccccctgtggctccgcaccctagagaaaagattataacgatagaggagactcatgaagaattaaaaaaacagtacatatttcagttatcatctctgaatcctcaagaacgtattgactattgtcatctgattgagaaactaggtggattggtgatagaaaagcagtgctttgatcccacctgtacacacattgttgtgggacatccacttcgaaacgagaagtatttagcctcagtggcagctgggaagtgggtgcttcatcgctcctaccttgaagcctgcaggactgctggacacttcgtgcaggaagaagactatgaatggggaagtagttccatacttgatgttttgactggaatcaatgtacagcaacgaagactagcacttgcagcaatgagatggagaaaaaaaatccagcaaagacaagaatctggcattgttgagggagcatttagtgggtggaaggttattttacatgtggatcagtctcgagaagcaggcttcaaacgccttcttcagtcaggaggagcaaaggtgctacctggtcattctgtacctttatttaaagaggccacacatcttttttctgacttgaataaactgaaaccagatgactcaggagttaatatagcagaagctgctgcccagaacgtgtactgcttgagaacagaatacattgctgattatctcatgcaggtttgtgagattctatccttgacctcctcattaccagagatacgtttatgtgcatagataagtaactgcacaacaaaaccttcagctcatgattagtagaagattagtctcctgttattctcttctattccagccctttcagttttattctatttgtgttttttattataatgaacatattatgtaaacatttagcttggaagttaaatatgagaagagtataaaaatctaggtacctctaaaggctttaaaaataccctttaaaatgttggaatataaagcagaaatcgattccaggagtccaaggagaaacatttatccaaaggtcctttagttttcttgactgtttgctttcatgtacattaaatacctatgttaga

SEQ ID NO: 23084 - DNA, 5384 bp, Homo sapiens
tggggtaggggcggcgccgagtcgggggagggggctgtgcgccgggctggcgcccgaccccagccaccgccctgcggccagcgcgtcccccgactcgccgcccggagaccccgaggctccaacgagttcagaaatgtccagaaatgacaaagaaccgttttttgtgaagtttttaaagtcttcagacaattccaaatgtttttttaaagctctcgagtccataaaagaattccaatcagaagaatatcttcagattattacagaagaagaggcattgaagataaaggagaatgatagatcactttatatctgtgacccttttagtggcgttgtctttgatcacctcaaaaagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacatcagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacagggtaacaagaaagaaatctttgcatttgtttgtattaagtacatgttgacctcttaaaaataaacagatgagcatgttgtagttctctgatctgaatgtgcaaacaaaaaaaacttcgtagatatttctggttttggtttaaacttgagccagaaaaataatttgtaaattgaggtacttcatcagtaaattgaaaaacattttcataaatttggaaatttagaattgggcgtttttttctagacatggtgtctaccattgttcttttattctagctaaccctttttgtgtttgtggagttaatgcttggtttttcttcctatcatcttattttcatttaagtcttttgaattctgcctagcacatacctacatttgttctttggattgtatgagtttctttctgaattctcctattttttttcttccttgagctttaccttaaaaacaaaattttcctatctctcatcttttttcttccttttcttctttttcacattgcatgatgacctcccattagatatatagatttatctctgcttctgcttttctccaagtgtagaattgctctcatgttacaaatttgggttacacttaacaatgaaaacttggtatttaaggaaaatgttgggagaagcccacagataacacacttgctctgtttaatgctaataaattgcattttttctttattgttattattgtcacatgcagatgggatgcatttatttataagttctggggataggatacttttttgcctgtactttttacattccagagtttgtgcttgacttcatcttgactaagacagatgagaatatttcctagaatttgtttttagtcttatttggatcctgtcacactgcagcattttattgtcctcagctgtctgtgatcctggaaacatacgtgtgactgaagctcccaaacacccaatctctgaagaactggaaactcccataaaagacagccacctgatccctacgcctcaagcccccagtattgcctttccactcgccaacccccctgtggctccgcaccctagagaaaagattataacgatagaggagactcatgaagaattaaaaaaacagtacatatttcagttatcatctctgaatcctcaagaacgtattgactattgtcatctgattgagaaactaggtggattggtgatagaaaagcagtgctttgatcccacctgtacacacattgttgtgggacatccacttcgaaacgagaagtatttagcctcagtggcagctgggaagtgggtgcttcatcgctcctaccttgaagcctgcaggactgctggacacttcgtgcaggtgtgtattcagatttgtggaagtttatttttctttaaaagcaagtgtccaccgggtgcagtggctcacacctgttatcctagcactttgggaggccgaggtgggtggatcacctgagatcaggagttcgagacatgcctggccaacatggtgaaaccctctctactaaaactacaaagattagccaggcatggtggtgagtgcctgtaatcccagttactcaggaggctgaggcaggagaatcacttgaacccagaaggcagaggttgcagtgagccgagatcatgccattgtactccagcctgggccacaagagtgagaccctatcta

SEQ ID NO: 23085 - DNA, 1873 bp, Homo sapiens
ctagttatgtgacattggttgttttcatttaaccttttttattttatctcaaaaatggggattaaaaacaccgatatgaaatgtttgtaagatctgagctagtcccactctacctgaaccatacacgtatttctttgataaaaggtgagactttgtcccacagggtccattttgtttaatttgctggaacctaggaatgaatatgcgttttcctttaagtttgtcagattcatccctgagaggtctgagatttaaagaaaaaatctattaccagatcacgtaaatgtttgaaatcattttaaaaaatcacttatttttccttttataggaatcacctcctcatgtagaaaattactgtctaccagaagctatttcatttattcagaataataaggaacttgggactggattatcacaaaagaggaaagctcctacagaaaaaaataaaatcaaacgacctagagtacactaatcgcatctaccctttagttaccaaacattaaatgtttttaaaaattgaaagcctgaatgtgactgtgatagatttgggtagtaatttaaagatgagtacctgaagaattctgcttcagagtataatgatgacccttcttgagttttgaacacctgaaattgtaatcactgaaatattaactgtttcttaataaaaagttacctgaaataacaacaaaatacaactcctcagctagcttgctgttaaaccacattgaagtctgttaaaagatatttatttttcttgtaaatatctgaagctgtagcttagtggaaattttagcaaggtaatggattttgctttaaaatgtctgccttacaaattcataacaacaagatttgtcagtcagcatttattcatgttttccctgatttttatcttctcaccattttacctcttttaacaggagcctgagcacaaggtttaatgaggaagctggggctataaatatgtgtgtatatatgtatatgtatgtttgtacaaatctccatgatgtttgccaagtttgaatgcgcaaaacttggaaaatgtgacaataaagaataaaagtagtaactcaaattagtattaagatgtgtttacatagataaattttttaaaagagcaccctggcatctgttcttctgttgaagcaacaaaacatttatgtaacgtaaaaaatgaattgcaggggcctgggtgcggtggctcgtgcctgtaatcccagcactttgggaggctgaggcaggcggatcgtctgaggtcgggagtttgagaccagcctgaccaacatggagaaacctcatctgtactaaaaatacaaaaaattagcccagtgtggtggcacatgcctgtaatcccagctactcaggaggctgaggcaggagaatcgcttgaacccgggaggcggaggttgcggtgagctgagatcgcgccattgcactccagcctgggcaacaagagcgaaactccatctcaaaaaaaaaaaaaaaaagaattgcaggccaggcacggtggctcatgcttgtaatcccaccactttgggaggccaaggtgggtggactgcttgaacccagaagttcaagaccagcctggacaacatggcgaaaccccatctctgcaaaaaatagcaaaaaattagccgggcatgctgtttgatgcttgtagtcccagctacttgggaggctgaggcatgagaattacttgaactcaggaggcagaggttgcagtgagctgaaatcatgccactgcaactccagcctgggtgacagaatgagaccctgtctcaaaaaaaataaatgaattgcttaacatttctgatatttgttatttagaatattgccctattagattaaaacatactgttattggaactctgtattg

SEQ ID NO: 23086 - DNA, 4631 bp, Homo sapiens
tggggtaggggcggcgccgagtcgggggagggggctgtgcgccgggctggcgcccgaccccagccaccgccctgcggccagcgcgtcccccgactcgccgcccggagaccccgaggctccaacgagttcagaaatgtccagaaatgacaaagaaccgttttttgtgaagtttttaaagtcttcagacaattccaaatgtttttttaaagctctcgagtccataaaagaattccaatcagaagaatatcttcagattattacagaagaagaggcattgaagataaaggagaatgatagatcactttatatctgtgacccttttagtggcgttgtctttgatcacctcaaaaagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacatcagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacagggtaacaagaaagaaatctttgcatttgtttgtattaagtacatgttgacctcttaaaaataaacagatgagcatgttgtagttctctgatctgaatgtgcaaacaaaaaaaacttcgtagatatttctggttttggtttaaacttgagccagaaaaataatttgtaaattgaggtacttcatcagtaaattgaaaaacattttcataaatttggaaatttagaattgggcgtttttttctagacatggtgtctaccattgttcttttattctagctaaccctttttgtgtttgtggagttaatgcttggtttttcttcctatcatcttattttcatttaagtcttttgaattctgcctagcacatacctacatttgttctttggattgtatgagtttctttctgaattctcctattttttttcttccttgagctttaccttaaaaacaaaattttcctatctctcatcttttttcttccttttcttctttttcacattgcatgatgacctcccattagatatatagatttatctctgcttctgcttttctccaagtgtagaattgctctcatgttacaaatttgggttacacttaacaatgaaaacttggtatttaaggaaaatgttgggagaagcccacagataacacacttgctctgtttaatgctaataaattgcattttttctttattgttattattgtcacatgcagatgggattacaggcaaatgccaccacgtgtggctaatttttgtatttttagtagagatgaggtttagccatgttgaccaggctggtctcgaattcctgacctcaagtgatctgccctcctcggcctcccaaagtgctgggattacacgaatgagccaccacgcctggcctagttaaaatatttttaaaattaaa

SEQ ID NO: 23087 - DNA, 1606 bp, Homo sapiens
ctgaaatattaactgtttcttaataaaaagttacctgaaataacaacaaaatacaactcctcagctagcttgctgttaaaccacatgaagtctgttaaaagctatttcatttattcagaataataaggaacttgggactggattatcacaaaagaggaaagctcctacagaaaaaaataaaatcaaacgacctagagtacactaatcgcatctaccctttagttaccaaacattaaatgtttttaaaaattgaaagcctgaatgtgactgtgatagatttgggtagtaatttaaagatgagtacctgaagaattctgcttcagagtataatgatgacccttcttgagttttgaacacctgaaattgtaatcactgaaatattaactgtttcttaataaaaagttacctgaaataacaacaaaatacaactcctcagctagcttgctgttaaaccacattgaagtctgttaaaagatatttatttttcttgtaaatatctgaagctgtagcttagtggaaattttagcaaggtaatggattttgctttaaaatgtctgccttacaaattcataacaacaagatttgtcagtcagcatttattcatgttttccctgatttttatcttctcaccattttacctcttttaacaggagcctgagcacaaggtttaatgaggaagctggggctataaatatgtgtgtatatatgtatatgtatgtttgtacaaatctccatgatgtttgccaagtttgaatgcgcaaaacttggaaaatgtgacaataaagaataaaagtagtaactcaaattagtattaagatgtgtttacatagataaattttttaaaagagcaccctggcatctgttcttctgttgaagcaacaaaacatttatgtaacgtaaaaaatgaattgcaggggcctgggtgcggtggctcgtgcctgtaatcccagcactttgggaggctgaggcaggcggatcgtctgaggtcgggagtttgagaccagcctgaccaacatggagaaacctcatctgtactaaaaatacaaaaaattagcccagtgtggtggcacatgcctgtaatcccagctactcaggaggctgaggcaggagaatcgcttgaacccgggaggcggaggttgcggtgagctgagatcgcgccattgcactccagcctgggcaacaagagcgaaactccatctcaaaaaaaaaaaaaaaaagaattgcaggccaggcacggtggctcatgcttgtaatcccaccactttgggaggccaaggtgggtggactgcttgaacccagaagttcaagaccagcctggacaacatggcgaaaccccatctctgcaaaaaatagcaaaaaattagccgggcatgctgtttgatgcttgtagtcccagctacttgggaggctgaggcatgagaattacttgaactcaggaggcagaggttgcagtgagctgaaatcatgccactgcaactccagcctgggtgacagaatgagaccctgtctcaaaaaaaataaatgaattgcttaacatttctgatatttgttatttagaatattgccctattagattaaaacatactgttattggaactctgtattg

SEQ ID NO: 23088 - DNA, 4186 bp, Homo sapiens
tggggtaggggcggcgccgagtcgggggagggggctgtgcgccgggctggcgcccgaccccagccaccgccctgcggccagcgcgtcccccgactcgccgcccggagaccccgaggctccaacgagttcagaaatgtccagaaatgacaaagaaccgttttttgtgaagtttttaaagtcttcagacaattccaaatgtttttttaaagctctcgagtccataaaagaattccaatcagaagaatatcttcagattattacagaagaagaggcattgaagataaaggagaatgatagatcactttatatctgtgacccttttagtggcgttgtctttgatcacctcaaaaagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacatcagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacagggtaacaagaaagaaatctttgcatttgtttgtattaagtacatgttgacctcttaaaaataaacagatgagcatgttgtagttctctgatctgaatgtgcaaacaaaaaaaaaaaaaaaaaaaaaaaaaaaaatttgtggggggtggggcggaaggaaggtttctcacaacacccattccgtgttggggccccgccgagcccagaggtggtagctgcaaaaactgtgccgacacacgcgtgggtccccataagaaaagaacccggggccaaggagactaaggcggctgggagttgcccccaataaaaaaaccgccgggggagcacaaaccaaggccgggtctgttgaacacaacccacagaagggaggtccaggcgggacatacacgagattgattcaaggaagcgggaggccccaagggacgaccaaattataaattagcggcgccacgtgagggagtgt

SEQ ID NO: 23089 - DNA, 3844 bp, Homo sapiens
  misc_feature (3836)..(3836): n is a, c, g, or t
tggggtaggggcggcgccgagtcgggggagggggctgtgcgccgggctggcgcccgaccccagccaccgccctgcggccagcgcgtcccccgactcgccgcccggagaccccgaggctccaacgagttcagaaatgtccagaaatgacaaagaaccgttttttgtgaagtttttaaagtcttcagacaattccaaatgtttttttaaagctctcgagtccataaaagaattccaatcagaagaatatcttcagattattacagaagaagaggcattgaagataaaggagaatgatagatcactttatatctgtgacccttttagtggcgttgtctttgatcacctcaaaaagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacatcagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtggagttttgatgaaacagtgactcatttcatctatcaagggcggccaaatgacactaatcgggagtataaatctgtaaaagaaagaggagtacacattgtttccgagcactggcttttagattgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgagccagatcctttgattttagaagaaaatgatgtagacaatatggccaccaataataaagagtcagcaccatcaaatggaagtggaaagaatgactctaaaggagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacaggctgtctgtgatcctggaaacatacgtgtgactgaagctcccaaacacccaatctctgaagaactggaaactcccataaaagacagccacctgatcccttctttcaaaacanaaaaaaaa

SEQ ID NO: 23090 - DNA, 3192 bp, Homo sapiens
tggggtaggggcggcgccgagtcgggggagggggctgtgcgccgggctggcgcccgaccccagccaccgccctgcggccagcgcgtcccccgactcgccgcccggagaccccgaggctccaacgagttcagaaatgtccagaaatgacaaagaaccgttttttgtgaagtttttaaagtcttcagacaattccaaatgtttttttaaagctctcgagtccataaaagaattccaatcagaagaatatcttcagattattacagaagaagaggcattgaagataaaggagaatgatagatcactttatatctgtgacccttttagtggcgttgtctttgatcacctcaaaaagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacatcagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaagaagcagagtgaactaaatgggatcgcagcctctctaggagcagattacaggtagttggcacatctttctgtttcatggtgatatgactgaaatttataaggaaacctaaagctattgtgagcatctacaagaatacatttattttgtttcatgcatctttatctacaaaatctctccagttgatttttaatttaccacatctgttgaaaatagcctctcacatatcaattcactcttatatgtatataatgtatattttttagggtatgcacaacaaatattggagagcctattttatgccacta

SEQ ID NO: 23091 - DNA, 2912 bp, Homo sapiens
tggggtaggggcggcgccgagtcgggggagggggctgtgcgccgggctggcgcccgaccccagccaccgccctgcggccagcgcgtcccccgactcgccgcccggagaccccgaggctccaacgagttcagaaatgtccagaaatgacaaagaaccgttttttgtgaagtttttaaagtcttcagacaattccaaatgtttttttaaagctctcgagtccataaaagaattccaatcagaagaatatcttcagattattacagaagaagaggcattgaagataaaggagaatgatagatcactttatatctgtgacccttttagtggcgttgtctttgatcacctcaaaaagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaaaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcggatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggcctcatgtagtgggagcaaagtggttgctagagtgtttcagtaaaggttatatgctttctgaagaaccatatatccatgctaattaccagccagtggaaattccagtttcacatcagcctgaaagtaaagcagctcttttaaaaaagaagaacagcagcttctctaagaaagactttgctcctagtgaaaagcatgagcaagctgatgaagatctgctctctcaatatgaaaatggtagctccacagtagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggttacttgcatagactatcagactttgtttgatccaaagtcgaatcctctcttcacaccagttccagtaatgacaggaatgactcctttagaggattgtgttatttcatttagccagtgtgctggagcagaaaaagagtctttaacattcctagcaaacctccttggagcaagtgttcaagaatactttgttcgcaaatccaatgcaaagaaaggcatgtttgccagtactcatcttatactgaaagaacgtggtggctctaaatatgaagctgcaaagaagtggaatttacctgccgttactatagcttggctgttggagactgctagaacgggaaagagagcagacgaaagccattttctgattgaaaattcaactaaagaagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggaagaagccccaaagccacttcacaaagtagtggtatgtgttagtaaaaaactcagtaccttttctaggggagagatggtaccga

SEQ ID NO: 23092 - DNA, 382 bp, Homo sapiens
atgacaggaatgactcctttagaggattgtgttatttcatttagccagtgtgctggagcagaaaaagagtctttaacattcctagcaaacctccttggagcaaggtatgtaatatttttaatgcacctgttgtattggtgtatctttttatttattttgacttcttggagagcattcaaattagaatttgggtgggtgtctttattatatttatgagtgttatgtggttccttctccactcccactgcttcacttgactagccttaaaaaaaaaaagtgcctctgttgtccaaagatgaaaacttaggtatcattagaggtaataactgcagtgggtccaaacacatgaaatagtgtttaagttgtgacttcataatgacac

SEQ ID NO: 23093 - DNA, 434 bp, Homo sapiens
gcatataaaggtgagccacaacttttatggtctaacttatggatttaatgagtttggatttgttattgctgtttatttaaactgtcacttctattccttaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacagggtaacaagaaagaaatctttgcatttgtttgtattaagtacatgttgacctcttaaaaataaacagatgagcatgttgtagttctctgatctgaatgtgcaaacaaaaaaaa

SEQ ID NO: 23094 - DNA, 358 bp, Homo sapiens
tgatctcatgcctaaagtcctaaaatcaaaattctaaaatccttttgtctctctctatctttatgtgaacatgtatatgttatatgttttatcacatatatgtatatgtcacacatttatatactgttgacacatagtttcaaattaatgtaaaaataaatgagtactcacaaattaagtgaataagccaaaatgcttttctatacatgtgattttaataacctttggtgaatatagatagttttaaaattgttgaaaaataaagtataaacgtcttcataatttaatttatacgtttttgcctaggtctgttggcaggcaggtttatattgtctttactagatgttttaaggtcatc

SEQ ID NO: 23095 - DNA, 674 bp, Homo sapiens
gatcacctgagatcagaagtttgagaccagcctagacaacatggcaaaaccccatctctacgaaaaatacagaagctagccaggcatggtggttcatgcctgtaatcccagctactcaggaggctgaggcaggagaattacttgaacctagagaagtggaggttgcagtgagccaagatcgcaccactgcactccagcctgggtgacagagtgagactctgtcacacacacacacacaaaaaatccttttttcatgattttctatttctatcaattttctgagtcacccaagctcaagtctgcatttggtttttcatctcatacttagtcactttctatcagttaccaattcctattgatggtttttaaagggtaaacctcacatctgttccttcttttttcattcattccactgttgaccatctaagaacatgaaccaatgtttctccttatgtctgtgatcattttgctccctggggcatagggaggtgcttccttcatgagatgaactgtctaaacattttagcctagcatgttcagcatgaccagaacagacaccacatgatcagatccagaattacctttccagccctaatctgtacaggtatgttacatatactttatttcctgattcctctggattagttgtccccctctccagactctgctgcttt

SEQ ID NO: 23096 - DNA, 433 bp, Homo sapiens
caatgggagctaacttcactgttttcttacaatacctggtttttcctatctttggtttccttttgattatctctcatccatctcagccactattctcctcccctcccttgtgtctacaacaccccattttaccaagtctcccatttaacctccccatccttttctttcccttaaagtctcatatgatactgcagtcctcatttgtcttcccaaaaaaaaaaaagaatttttttttttttaaggaatccttccttgactcctaaagactcctaaggatgctgaggcctcctcagcatgatttccatatacttactttctctgttggactgcagacaacttgaaagcaggaactttggcagtgtttccccagcaccagcatcatgcctggtccatagtagctaccaataaaaaagtaagcatcatgaacccaaaa

SEQ ID NO: 23097 - DNA, 355 bp, Homo sapiens
tttttgagacgtagtctcgctctgtcgcccaggctggagtgcagtggcgcgatctcggctcactgcaacctccgcctcccgggttcaagcgattccccggcctgagccccccgagtagctgcaactactagtagctggaactactagaggcgtgtggcaccacgcccggttaatttttgtgtttttagtagagacgggttttcaccatgttagtcaggctactctcaaactcctgacctagtgatccgttcgcctctgcctcccaaagtgctgggattacaggcataagttaccgcgcccggccagagactttccaaggccgctttggaacataggactttcactaaaacatttt

SEQ ID NO: 23098 - DNA, 775 bp, Homo sapiens
agacttgagcatctgtggattcgggtatctgtgggaggatcaaaccattgtccattgatactgaggggtgacttggcgtggctgtcacaaatcccagaattcactgtgtatttgttgtcttagtcttcatcttaatcagtattctaggatttttttctacatttttgcttttgatcttcactaaaagattttaacttctctgcgctatatcttattttgacatttttagtatttatcatgtataataatatctcattttgaaaacttaaaaaaaaaagatgtgatttgtatatgtagttctctgggtataaaagaacctttctctgttctgaatttttaagatattacctgccagtaagattatctgaatttttaatatcttaaaaatatctgaatttttaagatattacctgccagtgagattagtactgttataaggcaatcgttttataaactgtttttcaccaaatagtcattttattttgttttcttttttaatacagtttttatgtaacaactgttttcctcatcactattacaaatcagtttttaatatgtatgctagtgttttgaattttaatattgattataaattcacaacccgtagattagtaatttgtaaaaaaaaaatgttgtaaatttacataactcatttttcaggtactttggtactaatgttattttatcgttaccaattgttacaacaaatataccaaactatggatttaaatgttttggcattaaaaactatttgataataaaattaagaaatttt

SEQ ID NO: 23099 - DNA, 220 bp, Homo sapiens
aagcttccactaagtgttacttgttgtatttttagaacacaggctgtagtcaaaatcaaagcttaatattaaaacctatgtaactttagaaatgtgattgccctatctgatgcctgtttgtacatatataatatatatctattatgttaactttgaatcatttttgtgaagattgaatgatataatgcctggcatccaataaatgaaataaataatggtc

SEQ ID NO: 23100 - DNA, 412 bp, Homo sapiens
atgaaccttgaggatgttatgctaaattaaataaggccaaccacaaaaagataagtacagtgtgattccacttttaggagatacttagagcagtcagaatcacaaagacagagtggtggttggcaggggctgcaggaagggggaatgaggaatgattgtttcataggtatagagttttggttttacaagacaaaaggattatgggggtagttggtggcaatggctgcacaacattacaaatgtatttaataacatgaactgtacacttgaaaatggttaagatagcaaattttacagaatatgtattttacgacaattttaaaaatgaaataaaaaagaattatcttgcacgcgaaatggttgccaagaaatcatagccaatagtaaattaaaagttattcatagtgcaaaa

SEQ ID NO: 23101 - DNA, 476 bp, Homo sapiens
gttcctgccccaccctaactgatcaattgaccctgtgacattctttctcctggacaatgagccttagaagctccccaccgagcaccttgtaacccccacccctgcccacaagagaaaaaccccctttgactgtaattttccactatctacccaaatcctataaaactgccccaccccatctccctttgctgactcctttctcggactcagcccacttgtacccaagtgaataaacagccttgttgcttacacaaagcctgttggtagactcttttcacacaaatgcgtgtgacacacagcagggaagggatgaagtaaggattcaaatctagctcgaattgtcctggttccatcacccctcacttatcactggaacaggagtgaatggaattcacaaatgttccctgaatctaccataacagcataagaatccataccctgtgcttgctcggacttaacccttgtggcttgatgtc

SEQ ID NO: 23102 - DNA, 468 bp, Homo sapiens
ctcaccagggtatgtgccagcaagactccgtgtaatcatgtttcattacctggggctcgctcagagaacattttggttttgtttcttattgttgtttttatttttgtttgattttggcaggtatgaaaagccaattatatcagattctttcctgaaaggtcatttcttgtcattgaatgacgaccataaaaatttgcttctacaagaaattctatggtttcaggagtcaagggtcatcccagcaaagtcagattagggaaacactgaaacccatcttgtccagacacctggtttgcctgggtggtgcagaagaggagattggaccctcacgacaccagcatgaaccactcctatgtccacactgtctcaaggcactaacccagccagccccgtagagcatcctgactgctgcaagagggacgaggcaggcatgtggaaggatgtttaattaaactcactgccattagt

SEQ ID NO: 23103 - DNA, 408 bp, Homo sapiens
ccacacagtctctatcaaaactactgaactcctgcacgacctcatgaaagccacatgtaaaccaacgagctaaggatagcttttatatttttaaatggttgcaaaaaattaaagtagaggccgggcctggtggctcacgcttgtaatcccagcactttgggaggccaaggcgggtggatcacaaagtcatgagttcgagaccagcctggccaatatggtgaaaccctgtctctactaaaaatacaaaaaaaattagccaggtgtggtagcgtgcgcctgtagtcccagctactcaggaggctgaggcaggagaatcgcttgaacttgggaggtggaggttgcagtgagccgagatctcgccactgccctccagcctgggcaacagaatgagactctgtctcaaaaaaa

SEQ ID NO: 23104 - DNA, 427 bp, Homo sapiens
gatctctttataagttatatgttcgtcttatctttctttaaagatgaaattttttttttttagtataaaagtaacatgagcataatagaaagttacaaaatcaaatgtaatgaagaaagtattatttagggtcaggtgtggtggctcacgcctgtaatcccagcactttgggaggccgaggtgggcagatcacttgaggtcaggagttggagaccagcctgggcaacctggtgaaaccccatctctactaaaaatacaaaaaattagccaggcatggtggcaagtgcctgtaatccagctacttgggaggctgagacacttgaacccaggaggttcaagaatcacttgaacccaggaggcagagtttgcagtgagccaagattgcaccactgtgctccatcctgggcaacagagtgagactctgtct

SEQ ID NO: 23105 - DNA, 486 bp, Homo sapiens
cagtttgcccaggtctgaggggcagtcctgggcatgggaccttgatgggtacaaccaggtcgagatggtccccctatctctctgcatctctgtgctggcttccatcaggcaaattctccccagaaagccagaagtagctccaagtgtacttgcttttcacagtggttactcctgggggacaagaaatactttttcctgagagttccagcggcagcttaagggagacctcagattggccctgcttggtccaaattcccatccctggttgggcacggtggctcacaccggtagtcccagcactttttgaggcccaggcgggaggatcccttgagcccaagagtttgagaccagcctgggcaacaaagcaagaccctgtctctacaaaaaataaattattcaccaggcatggtggtgtgcgcctgtacttccagccactcaggagaccaaggcagaaggatcacttgacagagtcagaacttctctgaa

SEQ ID NO: 23106 - DNA, 518 bp, Homo sapiens
gattcccatccagctcctaattccagggcatgtccctaaactgctatataattcagcttgctaacagcctcagacttaaacaagtggaaaataaaagcagtaaggcacacaaaaacccctgagagtgcagctggaactgggatgggacacagactttgatgaagcctaggactttaggtcccagtctgaaaatccctgctccaggctgtgggaaattgcatgctcctagcttcagcagcacgctcatgctgcctggagtttgcagctatcggacaccaactccagccactttgcaggaagatggaaagccacagactcctctccattccaaggagagccaccaagccaccagagggatacagctggccccttcccttcatatggtggggggagatcagaggcatggcacagatgctggctgtgccctttgtccaccaaatctgattctggtcacttctccctttgccaccatgcgtgcccaggaaatgcaagcccctcccagtgtagtttaagcccag

SEQ ID NO: 23107 - DNA, 170 bp, Homo sapiens
gaaaaaacattcctccgtaacaggctggcaataactctttacgatttccacatacctcttaaaaattatgaaagacccattgtattaaaacctgggataaacaggatatttaaagcctgttagtgtgatcaagttcatctgtaaatttcactttgttttagagatctctg

SEQ ID NO: 23108 - DNA, 1062 bp, Homo sapiens
ggggacaggggaggagccaagatggccgaataggaacagctccggtctacagctcccagcgtgagcgacgcagaagacgggtgatttctgcatttccatctgagaccagtgaccttttctatttcatagtaaacaaacttcatgagtacttgccggagtctagggataagaatgcactacaaaatcaaagccaaagggttgatgagctggtggcatgcattgaaattatacagaccctagtattgatgttcagagaaacagaaaccgagtcatcacgcctgaacacattggcagctaagaagggagcactatttaatctcttggtaattttaattagtgagcctcagattccaaaatcttgtcctgtgtttgatatccagttggtggctgattcagctttagtcagaatgtcttttgacgctgagttacagaagcttattctggagtatacaaatactgctacagcacttttatatgagatacttcttgtctttcagcagggaaatctcggattgggatccacaaagtttgctattagctggataatgtcctttctacaaagctgtcctcccatcattacttttgtggccagtattgtgaaacaagtggtgaggggtctttcagcttcatttcagctgctaagtccctgccaagcagttctgttgtaccagcaattttacatcctcaagagctgtctgcggcacagcaggactctagctgagtatattaggaataactacagagaagaattcaggtactttattcacatgccagccttgcagaaaaggctcccattgtgttaccccatcactcaacctaccattcaactttttcatgaagttctgaaattggttgaatagaaacaaacaatgtacgcaatgttaataagagtataaaatgttaatcaagagtcaacttgatattcacgagaaacatttttttatttgtttaatatctggctatctctgagtcctataaacaaagattttaattgaatgttccatcaatacctctctatgagaagtttaaaattttaaaaaataaatttgatttattataaaa

SEQ ID NO: 23109 - DNA, 1083 bp, Homo sapiens
ggggacaggggaggagccaagatggccgaataggaacagctccggtctacagctcccagcgtgagcgacgcagaagacgggtgatttctgcatttccatctgagaccagtgaccttttctatttcatagtaaacaaacttcatgagtacttgccggagtctagggataagaatgcactacaaaatcaaagccaaagggttgatgagctggtggcatgcattgaaattatacagaccctagtattgatgttcagagaaacagaaaccgagtcatcacgcctgaacacattggcagctaagaattacagaagcttattctggagtatacaaatactgctacagcacttttatatgagatacttcttgtctttcagcagggaaatctcggattgggatccacaaagtttgctattagctggataatgtcctttctacaaagctgtcctcccatcattacttttgtggccagtattgtgaaacaagtggtgaggggtctttcagcttcatttcagctgctaagtccctgccaagcagttctgttgtaccagcaattttacatcctcaagagctgtctgcggcacagcaggactctagctgagtatattaggaataactacagagaagaattcaggcttttactgaggccgtgggggatgagttctactcttccctcttgacttggccctagtagtcaccacagcttgaccctttcatttcaacacctcactgcgcattgcctgataaaccaagaagcaggagcctctgctcatactgtggtactttattcacatgccagccttgcagaaaaggctcccattgtgttaccccatcactcaacctaccattcaactttttcatgaagttctgaaattggttgaatagaaacaaacaatgtacgcaatgttaataagagtataaaatgttaatcaagagtcaacttgatattcacgagaaacatttttttatttgtttaatatctggctatctctgagtcctataaacaaagattttaattgaatgttccatcaatacctctctatgagaagtttaaaattttaaaaaataaatttgatttattataaaa

SEQ ID NO: 23110 - DNA, 938 bp, Homo sapiens
ggggacaggggaggagccaagatggccgaataggaacagctccggtctacagctcccagcgtgagcgacgcagaagacgggtgatttctgcatttccatctgagaccagtgaccttttctatttcatagtaaacaaacttcatgagtacttgccggagtctagggataagaatgcactacaaaatcaaagccaaagggttgatgagctggtggcatgcattgaaattatacagaccctagtattgatgttcagagaaacagaaaccgagtcatcacgcctgaacacattggcagctaagaattacagaagcttattctggagtatacaaatactgctacagcacttttatatgagatacttcttgtctttcagcagggaaatctcggattgggatccacaaagtttgctattagctggataatgtcctttctacaaagctgtcctcccatcattacttttgtggccagtattgtgaaacaagtggtgaggggtctttcagcttcatttcagctgctaagtccctgccaagcagttctgttgtaccagcaattttacatcctcaagagctgtctgcggcacagcaggactctagctgagtatattaggaataactacagagaagaattcaggtactttattcacatgccagccttgcagaaaaggctcccattgtgttaccccatcactcaacctaccattcaactttttcatgaagttctgaaattggttgaatagaaacaaacaatgtacgcaatgttaataagagtataaaatgttaatcaagagtcaacttgatattcacgagaaacatttttttatttgtttaatatctggctatctctgagtcctataaacaaagattttaattgaatgttccatcaatacctctctatgagaagtttaaaattttaaaaaataaatttgatttattataaaa

SEQ ID NO: 23111 - DNA, 482 bp, Homo sapiens
tttttttttgagacggagtctcgctctgtcgcccaggctggagtgcagtggcgcaatctcagctcactgcaagctccgcctcctggcttcacgctattctcctgcctctgcctccccagtagctgagactacaggcgcctgcaaccatgcctggctaattttttgtactttttagtagagacggagtttcactgtgttagccaggagatttaatgaattctaaataaataatattggtggcatgtatctatggcaaaaatcatgaagaaagatgcaaatggctcttggctcttgactttcatttattggtttcactttttacaaagccctgacattttatctttaaaaaatgtatgatatggttcttctaaggaaacaactatgagtaaattatgagtcaccttcctgtttcactttggaagattgaccattgaaagtctatttccaaggaaattaatcccaatttcacttgaagttgttaa

SEQ ID NO: 23112 - DNA, 489 bp, Homo sapiens
ttttaggtttttgtatgcatttattaaaataattagcagaatatcatcaagctaaaaagagttgtaacatggaaacacagacaactttgccatttatcagagattctctaggtaattacagtcttctttcttaatttcaattctgttgtttccattttgaatgaaggaagctacctgatttaccaagttgtgtggttgcttcttgaacaagagggatgcagcctgcagggaaaaggggaatttactttttctggaatcatcctgggggcccagcaagtgctctccaatgtcatttcctggcctcatgcatgccagggctacattggccaaagcatgcaaggattcaaaggcccaaaatcttccctgtttgttgagttttacctctcttaactgggaggtccttcctcgtgtcttgtcttaagtttacagcaaccaaggtagaagattatggactatttgttttgcagagaactagagaagtaattggct

SEQ ID NO: 23113 - DNA, 605 bp, Homo sapiens
gcaaagcattgtgtatgctctagtaattctaactgcataagtactcatttcctcataggacagaaacaaccagcatgtttcttggtatgaaaactccattttcccaaatgcccacctaggtacatactcaccgagaaaaggatgattgaggaaggtcacacctctgaaatgaggcctgtgctgctgttgttgagtggctctttacagttttcttcatggcatttccaagtttattatttttttctgactcattgattaaaaaaaaattgtttaactttcaggtaaaatagacaaacagccgggcgcggtggctcacgcctgtaatcccagcactttgggaggccgaggggggtggattacttgaggtcaggagatcaagactggcctgcccaacatggtgaaaccccatctctactaaaaatacaaaaattagctgggcatggtggtgcacgcctgtaatcccagctactcaggaggctgaggcaggagaatcacttgaacccgggaggtggaggttgcagtgagccgagatcacgccactgcactccagcctggatgacaagagtgaaactctgtctcagaaaaaaaaaaagaaagaaagaaaa

SEQ ID NO: 23114 - DNA, 411 bp, Homo sapiens
ccctgatctgtcaaactctaaaaaccacatctttgtgttagatcaggctgtgtcaaggcagagttccagtggacattttaaagctgaaggtgctagaattgccctggggcattggctctttcaccagccctctccctgattgcggcttcccggagcttgcaccattgtttcatcccaccccggagttcaatggaacttttctgaacaataggaggaaagtattccctatcacagaaatagatctgtgttcctgcagctcctgggattgttatgcctcagggcatcatcaataaactaaaaatcataagtcaatcatttctatattgtgaaaccatatttgagtgcttttatcaggggataagaaaagtgctttttaaataaacattaattttgtacatgaaatctggctgt

SEQ ID NO: 23115 - DNA, 364 bp, Homo sapiens
gtgagaggtttgagcagacaattcacacacacaaggtgttgagctggccaaaggctcagggaaaaccctctgcttcactagcaagctaagacacaaaatgaaagtagctggctgggcgtggtggctcacacctgtaatcccagcactttgggagactgaggtgggcagatcacctgaggccaggagttcgggaccaacctggccaacatggtgaaaccccgtctctactaaaatacaaaaattagctgggtgtggtggcacatgcctgtaattccagctactcaggaggctgaggcatgagaattgcttgaacctgggaggccgaggttgcactgagccgagatcacaccactgcactccatcc

SEQ ID NO: 23116 - DNA, 351 bp, Homo sapiens
ggcactttagtgtagaaacaatcccaaggcagaagcagtagactacaattatgttaaattatttttaggtccataaatggatacatttgcgggttctattgttacaaagagtgataagataaaaccttgttttcaactgcagattccatgtctatgaagcaggagctatcagaacatgatagtagcatgttccttccttccttggtgctgggtgagggaatggtggtgttggtgaaagatgaagattaagaatagggaaatattaggaataacaataaaatcaatgttttttcaagtctgcactaaactgaaataatttgcttgtatactcaacttgtatggagattaaat

SEQ ID NO: 23117 - DNA, 360 bp, Homo sapiens
tgacagtcaatttttccatcactatttgttaaaaaagctatcctttctacactgaaattattttgcacatttgtcaaaaattaattgtctctgtatatgtgagtctgtttttagactcacttctatcctatggatctatttgttatctttataagctttgttcctcagtgcattatctttctcagtcttttactattaaccagtttgtgccttgatatttaaaacacgtttttattcacaaaatataatttggtcttggtttttcctgagaatctctgccacataattggtatgtttagatcacccatatttaacatgattatcgatatggtaagatatgattttgttatcttgctattt

SEQ ID NO: 23118 - DNA, 363 bp, Homo sapiens
atatgcccacctgtccaaacccaaagaatggacttagaggcatgaagaacagtgaaggtgagacttttaataacgttctggcaagatcagttgtctggaagacatgcacacctgggcaattacaacaggctccaacagcaggagaagaccattttgtatggctcgatccttccaaggttgggagccaaacaacctgctgaacatgccaatgtggcataactatgaactaaagaaacatcctccacccaaatctcccaggccaggaataaggagggctaaagacctctctacagtctgccacctcagtgtttcatgtttatattgtcaagtcgctcctcaataaaattcatcccatttccagaa

SEQ ID NO: 23119 - DNA, 469 bp, Homo sapiens
  misc_feature (389)..(389): n is a, c, g, or t
cgtgaattatatctcagttatagatatctgaattatatctcaataaaacatgacataatataaaatatataatatttacatatcatatataataatgctatatatataatatacactgacacctggatccttctcttagagagtctgaattaattggtctgtggtatggcctgggcattggacttctggaaaccttcccagataattctattaaaaagctgatgtggagaatctttgacatgggtcttggtacttacaagtgtggtttgtgtgccagtggcaccaaccgagacctgggaacttacaaggagggcaaaacctcagaccccacccaagatcccactgaatcaggaatcttgcatttttgatggggatcctcaaataacttngggtgggacattcaagtttgaggaaacattgtcagtaagggtagtttgaatagtaaggcaggcgaatgttatctctgaag

SEQ ID NO: 23120 - DNA, 1378 bp, Homo sapiens
tgatctatgtgtctatttagtcaacgaatatttatcaagggcttgccaccacgccatgccgggacttggtcttgttcacaggtctagaacagtgcctaacacatagctggggcacagtaaatgctgagagaatgcatgtgttgtcgggaggtcacttctgaggaggcaagtcttaaacgaggctagcaaggatggtcagccgcttccagagcttgggaagagtgttcttggtggacggaacagtgtagtcttgttggtaaccacttgcctctggctctctgtgcctggagaatagtgtttctgtgtcttttttgtttgtagtctgtgatcctgggagccctggggccagtttaaacagggccccatcagggtctctggaagtgaggtcactgcccaacagattcaccccactggctaactctggcttaactggctgggcctggccattcccctggaagcaactcctccccacaacagcatcagtcccacgacctctggctccttcccagggcagcatcctgcagtccggaaggaagttcttcgtcctgtctaaccacagaccccgctgaggcaaccccagccttttcctcttattctgccttgtgggcagaagggaggagatgggctgacccttcagcaacgggtcctggcctagacggagagcccagtaaagacctgacagagtgggggtgacaacaccctgcagcctcggggaagtgaacttcaaagggcagaaataatcactcatctcagaagcttctttggcatccattatctcatttaatcaattaacacctactttatagacagaaactcaagcaggcccagggagggaaaacagtggcagaactgggaccagaatccaggcctcttgataaaatagtaataattaatattattgcacatatactcactgccaggtactgtgctaaaactttgcatgcattttcttctttaagcctcatcacatccccatgaggtgggtaccctcattattcctgttgtcctcagatgagaaggcggaggctcagagctgtcaaatgacttgtccaaagacacccaggcagttcatggcaggacagaatttgagcccaggcagtctggcgtgctcagccatgctccctgtgccctgggattcgggaggattgtcacagatgtctactttccagggacttggggagacaggcttcaggctctatcacatgatgatcctggggccgacttgtgccaaggctgggctgggagggaagatggcctggacgcacagcgtaatcctgagtcccctctctgtggatgacgatgagttacctttgccctccctcctgagatctctgtggttctgcccttcattctccaaataaaatcgctgtggcctcaa

SEQ ID NO: 23121 - DNA, 1471 bp, Homo sapiens
ccggagggaagggacacttgccccaatcccgtcttcccgatttcccttccctccaggtggaagcaccggtggcagaatattaactactattttctgggcaaaaggaagcgacatctagttcccttgcgcccgtgagagccaccacgccatgccgggacttggtcttgttcacaggtctagaacagtgcctaacacatagctggggcacagtaaatgctgagagaatgcatgtgttgtcgggaggtcacttctgaggaggcaagtcttaaacgaggctagcaaggatggtcagccgcttccagagcttgggaagagtgttcttggtggacggaacagtgtagtcttgttggtaaccacttgcctctggctctctgtgcctggagaatagtgtttctgtgtcttttttgtttgtagtctgtgatcctgggagccctggggccagtttaaacagggccccatcagggtctctggaagtgaggtcactgcccaacagattcaccccactggctaactctggcttaactggctgggcctggccattcccctggaagcaactcctccccacaacagcatcagtcccacgacctctggctccttcccagggcagcatcctgcagtccggaaggaagttcttcgtcctgtctaaccacagaccccgctgaggcaaccccagccttttcctcttattctgccttgtgggcagaagggaggagatgggctgacccttcagcaacgggtcctggcctagacggagagcccagtaaagacctgacagagtgggggtgacaacaccctgcagcctcggggaagtgaacttcaaagggcagaaataatcactcatctcagaagcttctttggcatccattatctcatttaatcaattaacacctactttatagacagaaactcaagcaggcccagggagggaaaacagtggcagaactgggaccagaatccaggcctcttgataaaatagtaataattaatattattgcacatatactcactgccaggtactgtgctaaaactttgcatgcattttcttctttaagcctcatcacatccccatgaggtgggtaccctcattattcctgttgtcctcagatgagaaggcggaggctcagagctgtcaaatgacttgtccaaagacacccaggcagttcatggcaggacagaatttgagcccaggcagtctggcgtgctcagccatgctccctgtgccctgggattcgggaggattgtcacagatgtctactttccagggacttggggagacaggcttcaggctctatcacatgatgatcctggggccgacttgtgccaaggctgggctgggagggaagatggcctggacgcacagcgtaatcctgagtcccctctctgtggatgacgatgagttacctttgccctccctcctgagatctctgtggttctgcccttcattctccaaataaaatcgctgtggcctcaa

SEQ ID NO: 23122 - DNA, 1130 bp, Homo sapiens
  misc_feature (435)..(436): n is a, c, g, or t
  misc_feature (444)..(445): n is a, c, g, or t
  misc_feature (449)..(449): n is a, c, g, or t
  misc_feature (452)..(452): n is a, c, g, or t
  misc_feature (455)..(455): n is a, c, g, or t
  misc_feature (463)..(463): n is a, c, g, or t
ggatttgttgttttctcgtgagcttaggctgctggtttggtgatttttgtctgattgcaatgtctggacgtggtaagcaaggaggcaaagctcgcgccaaagcgaaatcccgctcttctcgcggacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggttgcaaaagcttctcatttcagagagatgccaggatcctaagtgcctgccaaacttaccaattctaaggataagtggatggatggcattactgattccttacattactgattgattctgcatccgnnaattgtcnnattnaanaanattctacntcatgtgtggggagcataaggaggataacctgaagagacaagagctatctcacttcgacggggaacgttcttgctgaagtaccataatcgtgttatcaattgtgtcacactccagtattacattcagcagggttcagaacctatttgaaggtcaaagaggttctcctattccgaaatcccttcccttcaatttaacccggtgggtccctttttcctttcccttcggggtatctgggccaggatttcattgcgtgcggggagtattccgggcactgggtggcatgggaacggggtgtctctttcgcctctgtttccattcccggcgcacggttggcgcaccggggtgtcaccctttgctgtcggtgtgccctttctaaagagacccatacccgggggacagcttctgcccctgtaggaaccattctgaaggcgctcctgggtgaccacttggaccgctcacggcgccatttggcaccaggcggttctgtacttacagtcttaaccccgcgccccagcaggtgttgcacccgcacactgagcatgggcgtctccgtcgaaacaacaagcgtggcggagtataacccagctactgtgacacgaaaacgtccgcgcccaccgcgaccacggggcgagcacgcatgacaccaccctgcggcccacacgccgc

SEQ ID NO: 23123 - DNA, 1204 bp, Homo sapiens
  misc_feature (704)..(705): n is a, c, g, or t
  misc_feature (713)..(714): n is a, c, g, or t
  misc_feature (718)..(718): n is a, c, g, or t
  misc_feature (721)..(721): n is a, c, g, or t
  misc_feature (724)..(724): n is a, c, g, or t
  misc_feature (732)..(732): n is a, c, g, or t
ggatttgttgttttctcgtgagcttaggctgctggtttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagcccccctaccgtttcaaaggaagagctaacctcactgcttgtaggtagaaggaacaaaaggcactaaggttgcaaaagcttctcatttcagagagatgccaggatcctaagtgcctgccaaacttaccaattctaaggataagtggatggatggcattactgattccttacattactgattgattctgcatccgnnaattgtcnnattnaanaanattctacntcatgtgtggggcacgcatccgcgaggatacacatgaagcagcaccgcacctacttattgagggcgacagctcccttctgacataccgaaatgtgctcccactcccgtctcaccatcacgtattaccatacacagggttcaaacctatccgaccgtaaacgagatccatcatataaccgaatccatgccctcaactttacccaggtggtcacttcacttaagcttgtgtattctgacccaggtattcaattccctgctgaatcatcagtcacataatgaaatgatacgctgatcactccggctgtagtagcattatcacttcacaatcttatcctgcacacacacctatcccctaatgagccacactacagaaccctctcctgcagagcagccgccatgttactgcattactgcccatgactcatctgcactgtaccctgtcccggactgctagccgaccggacctcgtacc

SEQ ID NO: 23124 - DNA, 1087 bp, Homo sapiens
  misc_feature (587)..(588): n is a, c, g, or t
  misc_feature (596)..(597): n is a, c, g, or t
  misc_feature (601)..(601): n is a, c, g, or t
  misc_feature (604)..(604): n is a, c, g, or t
  misc_feature (607)..(607): n is a, c, g, or t
  misc_feature (615)..(615): n is a, c, g, or t
ggatttgttgttttctcgtgagcttaggctgctggtttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggttgcaaaagcttctcatttcagagagatgccaggatcctaagtgcctgccaaacttaccaattctaaggataagtggatggatggcattactgattccttacattactgattgattctgcatccgnnaattgtcnnattnaanaanattctacntcatgtgtggggcacgcatccgcgaggatacacatgaagcagcaccgcacctacttattgagggcgacagctcccttctgacataccgaaatgtgctcccactcccgtctcaccatcacgtattaccatacacagggttcaaacctatccgaccgtaaacgagatccatcatataaccgaatccatgccctcaactttacccaggtggtcacttcacttaagcttgtgtattctgacccaggtattcaattccctgctgaatcatcagtcacataatgaaatgatacgctgatcactccggctgtagtagcattatcacttcacaatcttatcctgcacacacacctatcccctaatgagccacactacagaaccctctcctgcagagcagccgccatgttactgcattactgcccatgactcatctgcactgtaccctgtcccggactgctagccgaccggacctcgtacc

SEQ ID NO: 23125 - DNA, 357 bp, Homo sapiens
tcacatttttcacagatctggtcttttttatcttttgtctcttcaatttaagtatctcttccccagagaggtgttacctggccatcctatctaagagaggtttccaggctggtcagtctctcagtcccttgttgagcacttgttataatagtaccacttgcagccattttattttacatcttatgtaggggttatttatttatttcactactgtttccccttccccatgaaacagagatttattgagagaagggattgtgtttttctcacacagcatggttcctcactgcctagtgctgtgtttggcacataggaggatctgtgtgaaagaaggaaagaaggaaggaaggaagacag

SEQ ID NO: 23126 - DNA, 405 bp, Homo sapiens
atgatctgtcttcttaacaagtacataagtgccattgaagtcagggatccagatgctttgtatagctacaaaatactacggtattttctcttaacctaacctaatctacataaacatgtaaaagctagattacagaaggcagggttccaacttattttgctcaatatctccttatagtattactaaacaatgttcaaatgtcagtagacatgggaaaaccacaagaatattcaaaactcagcagttaatattttgtcttagtgtgttacaaacttgccttctccttaaatatataatttcttcaaacttattttaactgcttccctgcagaaaagcactaggccaagttatctcccttgatggctaaatggcctcctgcctccttcattaagcatacatggcaaa

SEQ ID NO: 23127 - DNA, 457 bp, Homo sapiens
gaggaaactgaggctcagagaagttaaatcattcactccaggccatacatctgctaaatgtgtcatgctacatccactttgcacctagtttgaacaggtttacaaagcaagtcagtaacccctgcatgcctgggtgcctgaagttgaaaaggggtggctctaagatgtggtctactacctctcctggactgttgcagttgggtgtggctgatttgaaattgtgcttcaaaagaatgagttctagtccctgaatagaggagctcacaccacagtgcactgtagatctttgtgatccagaagtcctccagatgttcccaaaaggatctctaaggtgttgctggggatgttgtgtgtatagggagtgttcccttgggggcctctgagccctcctggcagagaagcctcatagataatggcatccccagaaaactctacacttggaatgggacccaaatta

SEQ ID NO: 23128 - DNA, 351 bp, Homo sapiens
tcgtcttcaaaaaaaaaaaaaattagctgggggtggtggtgtgtacctgtagggaatctgaggtgagaggatcgcttgagccctggagttccaggctgcaatgagccactgtactccagcttgggcaaaagagcaagaccctgtctcaaaacacaaaacaaaacaaacaaacaaacaacaacaacaaacaataaaaaaaaaccatgctaagtccagtggggaggaaggaaagtacagaatgagcctggaaagtcagaagagctcaaagaatgatgcggacacgtcagaagccagctggaaagagctctccccagccaaatctgggacaatctgagaacccaaactgtaatt

SEQ ID NO: 23129 - DNA, 465 bp, Homo sapiens
ggtaaaattcaatattctaagttattttcaatcacactgtacacaggtgacttcacagtttccaccagcatttgcgagcatccgaattctgtagtgcgtatttcatcctaagggcaatcccattcataagctttttaaaatttttttctcctcttttgtatctgtagttgtaatatgtctactgatttatttcctagaaaaaaatgttgccagatggtttctaattaaaaaataataaaaatatcaaagcaaattgatacttggagagcctcagatttttgaaacttatttctcatcaattccagttctattttagttttggcaatctagtaataaactcaaaacactgtagggtaaaaaaacaacagtccctgtaactccagcactttgggaggctgaggcgggctgatcacctgaggtcaggtgtttgagaccagcctggccaacatggtgaaactctttctc

SEQ ID NO: 23130 - DNA, 456 bp, Homo sapiens
ccacttgcaaagccagtaacaaaggtgagatgcagtgaaaggaaagtgactttcttccagagctagcagtgggtaaatagccaaggctagtgccttaaagaaaccattttcaactttggctggagagaggggcttaaaaagggaacttggaatgggaggcatgcgggagtgttgctgggcacaaggtctctgtgtcttgtttcagtggctatcttgagtcgtggtccacctggagcatggtggcctcatctcagtaatagctgggttgttgacaaacggccttgaggtaatctctggaattttgaaactggatctccaggcctggtttctctccacattagccctggaacttctaagaaagcacatagttagataagtgtgcctggtgtaagttgaataagtacataattaaataaatgtgcatggtgtaagggagtgtctggtgggaaaggaggg

SEQ ID NO: 23131 - DNA, 713 bp, Homo sapiens
gcagtggtatgatctcggctcactgcaacctccgcctcctgcattcaagtgattctcccacctcggcttcccgagtagctgggatcacaggtgtgcaccaccacgcccacctgtgtattgtatttttagtagagatggggttttgccatgtaggccaggctggtctcaaactgctgacctcatgtgatccgtcaacctcaacctcccaaagtgctgggattacaggcttgagccaccatgcccagccccagctcagggcctttctactggctgttctctctacttgggacgttcttgccccaaatcattgcatgaatgcttcctcctgtggttcaggtctcaagttcagcttcacgtgctcagagacgccctcactgatcttgtctatagaacttgtcttgctttgtctccatatcactattaaaaattatatgaggctgggcacagtggctcatgcctataatcccagctcgttaggagtccatggcaggaggattacttgagcccaggagtttgagaccagccgggacaacatagcaagaccctgtctctaaaaaataaaaataaaaaaattagcagggcatggtggcaagcacctgtggtcccagctactcaagaggctggggcgggaggatcacttgagcccaggagggcaagggtgcagtgagctctgattgcaccactgcacctcagccttggcaacacagcaagac

SEQ ID NO: 23132 - DNA, 900 bp, Homo sapiens
gaagcatctgtgtcctcccaccccaagagcatcaactcccagagggcagggatcccggccctgtgcaggactctgtggctcctggtagaagacaaccacccttacagatggaagatgctggaatacgggttctcgctgcaagtgtgtttgagccttggagccaggcagtgtttgcgtgtccccctgggaccctggaccaccatgaggagagcttgcagtcctcacaagtgcagcctctcaaaggtcaagggtcaggagggtcagggacaccgcctgcaaggacacacatggctcctgtagccaagtggccctgtgtggcctacaaagatctgctgagtggagaccagccaggagcagcttcgcccagggctgctgaggaggaagccattgtggggaacagggtcagaacatgaccctggaccgaggtcgagggggcacatccagacgcacacgaaactgaaacctgtgaaacccaggaaaatggcacctccttcatgctttccagaagaaggggtgcatggagcagggatcccggttaggtcttaaaaatctcgccacaaagcgtattttctcagatgaaatagtcatcctgtacgtccgcatagagctttacatcttccagagccgaccgcatccactaactcctgtgtgcctcccgtggctccctgcaggtgggccttttcctcaaggcagctgaaggtcccccagggtcccaggcgagtagtctgtccccctgagccattcccaaaacactggaaggggcctacagccacccctgcccagccaggcctcctggggaacgctgtggggagaaacccgtgagaggcaaaagccatgatggaggctggtcactggagacaagctgcttgccctgtgtcctgtgaacgtgggaactcaccc

SEQ ID NO: 23133 - DNA, 666 bp, Homo sapiens
ggctcaagtgatcctcccacctcagcctcctgagctgggactacaggcacacaccaccacccccggctacaaaattttctttataaagcatgaaaccattatgtcacttccctacttaaaactatgtaaaatgatttcagtggccctcattgcttacatgataaaatctaatgtccaggtactggtctgcatggcttcttaagaactggccaatacctgtctttggaggcccagtctccctcaagtccctcacctgtggctccagtcacaccagacctcttggggcttctggaacctgtggcctgctttcagttgtggatatttgctgaatggattcttccattcatccaaaccatccattcattctttcaacacacacacacacgtatatatacacatacacacattatacacgcacacacacacacacacacgcacacacatacatatatgtatatattattgggaagccccctgagccagaataggttcagagactccctcaacaaatattttttgagcacttgctatatgcaagacacttcaaggtgctagaaatatgcagtgaacaagacacaaaatctttacttccatggagcttatattcttataagcttacacaaacttatattctagtcttgtattgtgtctcctagggaagaccag

SEQ ID NO: 23134 - DNA, 189 bp, Homo sapiens
tatcatcttcctggccccacatttgatctcgttcctgttccactccctgtcttggtggatggtgccccggcccccatagcctgggatggaagcctgagtcattcctgcctcctccgttcccttcactccccatacctgactggtcatgaatccttttggttctgccccctaaacagcgaggatcctgca

SEQ ID NO: 23135 - DNA, 366 bp, Homo sapiens
tcactgagttgtgaaaagttaacggagcatgcatatgttttcaggatataatagaaccaagaaatctgtgcatcttattaagatgtttatagattatatatatatatattttaatcatatttaaaataaaaatttttacttgcagctactgaggaggattgattaagcccaggagtttgagtcaccatgggcaacatagcaacactccatctctaaaaaaagaaaatttggcctactagacaaaatagaagtgtagaaatataaatcagttttctcatattctttgcatggatttagtagttacccaacattttctaaaatgtgcctattgaataaaatgaaatatgaatagaagttacatttatt

SEQ ID NO: 23136 - DNA, 247 bp, Homo sapiens
tggattttgagagttgtttatttatctggatacaagttctgtgttggacaggtgatttgcaagtattttcacccagtctgtgggttgttcttctcttataaatgacttttgcacaacagaagctttttattttgatgaagtcaagtacatccatttttgcttttatgattatgctttaggtgttacatgttagaaatctaacccagggtcacaaaggctgattttcttttaggagttctgtaatttt

SEQ ID NO: 23137 - DNA, 337 bp, Homo sapiens
aaggaaatttaatcaataattcaaaacaggaatagattattcatagggagagctgtgctcacagttttgttaatttgcagtggtagcattctttatcactggctgaaactcaagtaaaggagtgaaagatcaagtatttgttgagaaactattttgtgcctagcatcatgctaaggattatggtgacaaccgcaaaaggttagtttcatggcacttgttggagatgcatgtatttaacttgcaaatagtatacacaactcgtgtgttattaagttatgaaatattgaaaaagcataacatgggagtttaataatggaacacagacagactgagcaga

SEQ ID NO: 23138 - DNA, 409 bp, Homo sapiens
tagtgtacatccttagaatttgattagaatgattctttgtaacaaaacaaaaatccttagcatcatattcttccatgactgacttaacatggccttcaaatgcttttaagctgtctcattcagctgttgaaagctttctatcacaggcactctgcctatctaagccaagaaaggcaaaaatgtgtcattttcccgggtaactctggaattactgggtgtgggctaaccgagtctaagggtaacgttcatcatccccgcttcctggggattcacacccttgtgtaatctccttcctttgagtgtgggggcagggatatgtggacttgcttcttaaccaacagagtacaggcaaagggtaatgggatgctcctgattacacaacattgtaatgtctgtcttgctagaatac

SEQ ID NO: 23139 - DNA, 770 bp, Homo sapiens
ccgagaagcccggactggagtatctgagaacatatttcttccctataggagttgagaagaggaggaagaataatgggaggagacaggacctttttcaacttgacaaatagagtcaacttttataacactgttactgggaatacttgacttactaagcttttactgaacactttaattttgggagtacaatttctaaactcacgaaataatcttcatgcaacaagatgttattttatcaaattttggtattacatgctcattctttgacaaattttaattaacagatttctgagagagcagacaccatcttatttctgttgaattgtatttagtaactcaaaaggcatataccaagctgtcagaagcagcttcatttaaaagaaataaaatttctagtcctgcctgaagtttaagctagcccatgactacacaagtgcaactgtatttcccaggtagatgccggtagattgggcccagtaagtttgggccgttgggatgtgaaaggaagagatgcgggcaactttttgggtcatcttcttaaagaaaaagccatttgtcctggatgccctcttttcttttttctctttggctgggaaatgacaagaattaaagcagcagccttggatccagagatggacgccaattgatgaagacagcagaactgactggctagtctgggttccctggagcagagctgtctctccaccctaggttatccacttacttttgtactgttatgtgagagagaaataaacttctatcttctttaa

SEQ ID NO: 23140 - DNA, 545 bp, Homo sapiens
gcggaccgcgccaggcggaagcccggctccgggccagcatccgagagcccggactggagatttctgagagagcagacaccatcttatttctgttgaattgtatttagtaactcaaaaggcatataccaagctgtcagaagcagcttcatttaaaagaaataaaatttctagtcctgcctgaagtttaagctagcccatgactacacaagtgcaactgtatttcccaggtagatgccggtagattgggcccagtaagtttgggccgttgggatgtgaaaggaagagatgcgggcaactttttgggtcatcttcttaaagaaaaagccatttgtcctggatgccctcttttcttttttctctttggctgggaaatgacaagaattaaagcagcagccttggatccagagatggacgccaattgatgaagacagcagaactgactggctagtctgggttccctggagcagagctgtctctccaccctaggttatccacttacttttgtactgttatgtgagagagaaataaacttctatcttctttaa

SEQ ID NO: 23141 - DNA, 593 bp, Homo sapiens
agcgctgagcatacagagagagtttcatggatttttgtggaaggatgcacaaactgaaacccactgataaaaatacacacgatcacttttgagtgtctcataaaagtacatggtattaagcaattcatggatgtttttagggaaaatagactcagtgagatggagactgacaagactcccaacacttaggggaactcagactctgtcaatctggggtgtagttgtgtatgctcagcgctagacgtgagcaatctggagagcagtggagggactgaaaacaaggcaggagggaaagtggagctgagcttgtcacagacggatgcaagtgtgaactcagaacatttcaatcagaatgaaccaaaagtcctatttaatcatttaatgggggaggctggttgtaggtcttgcccaaataattcacaaagttgtggcagaattgtgagagtgaagtgcaattctgtggactgtcaaatgccaaacatggaagccaatgtgcctgctgtattaacacactcggaactttctggtgaaagtttgttaataaaaacactataataaatgcagcattcaattcagaaaaagtgcctcaatta

SEQ ID NO: 23142 - DNA, 605 bp, Homo sapiens
gcggaccgcgccaggcggaagcccggctccgggccagcatccgagagcccggactggagatttctgagagagcagacaccatcttatttctgttgaattgtatttagtaactcaaaaggcatataccaagctgtcagaagcagcttcatttaaaagggattataatacctacctatgacagagactgccaaatatactccagtagccattctgcttttcttcttttcagaaataaaatttctagtcctgcctgaagtttaagctagcccatgactacacaagtgcaactgtatttcccaggtagatgccggtagattgggcccagtaagtttgggccgttgggatgtgaaaggaagagatgcgggcaactttttgggtcatcttcttaaagaaaaagccatttgtcctggatgccctcttttcttttttctctttggctgggaaatgacaagaattaaagcagcagccttggatccagagatggacgccaattgatgaagacagcagaactgactggctagtctgggttccctggagcagagctgtctctccaccgaggtaccaccatactcagatacatgcggagtggacagaagactactatc

SEQ ID NO: 23143 - DNA, 879 bp, Homo sapiens
ggcacgagggctctgtggagctgcgcctgccaactcattgctttctgctgtgctgtgatcctgcagtcagttgccgctgttgctactgcaatcatttgcaccaaactgagccagagaagttccctcttttaacataaagagtcaagaaattggagcatggctatgagcaatggaaacaatgattttgtggttctgagcaacagcagcatcgcaaccagtgctgctaacccgagtcccctcaccccctgtgatggagaccatgcagcccagcagctcacacccaaagaagcaacaagaacaaaagtgagtccaaatggatgcctgcaacttaatggcacggtcaaatcatcctttctgcctttagacaaccaaagaatgcctcagatgttaccccaatgctgccatccttgcccataccatcaccctttgactagccatagcagtcaccaagagtgccatcccgaggctggccctgcagcaccctctgctttggcctcgtgttgcatgcagccacactccgagtattctgcatctctttgtccaaatcattcacctgtgtatcagactacgtgctgtcttcagccctctccatccttctgcctgcatcatccgtggcctgaccattttcagcatcagcctgtgcaacagcacatagccaacataaggtaagtgatccgaaagttttgcttttagcattcaactaatgccacgtgaacatgacagcttgtgtttattttcctgaaaggagaggagaaaaatgaggcacagaaagaaaacatgaaaacgcatattctgtggattgtgtgaagccaacaaaaacgcaaataaaataatactgtatatcgattttatccactgacttgttagtcaaatcctccc

SEQ ID NO: 23144 - DNA, 4769 bp, Homo sapiens
ggcacgagggctctgtggagctgcgcctgccaactcattgctttctgctgtgctgtgatcctgcagtcagttgccgctgttgctactgcaatcatttgcaccaaactgagccagagaagttccctcttttaacataaagagtcaagaaattggagcatggctatgagcaatggaaacaatgattttgtggttctgagcaacagcagcatcgcaaccagtgctgctaacccgagtcccctcaccccctgtgatggagaccatgcagcccagcagctcacacccaaagaagcaacaagaacaaaagtgagtccaaatggatgcctgcaacttaatggcacggtcaaatcatcctttctgcctttagacaaccaaagaatgcctcagatgttaccccaatgctgccatccttgcccataccatcaccctttgactagccatagcagtcaccaagagtgccatcccgaggctggccctgcagcaccctctgctttggcctcgtgttgcatgcagccacactccgagtattctgcatctctttgtccaaatcattcacctgtgtatcagactacgtgctgtcttcagccctctccatccttctgcctgcatcatccgtggcctgaccattttcagcatcagcctgtgcaacagcacatagccaacataagaccatccagacctttcaagttgccaaaaagttatgcagccctgatagccgactggccggtggtggtcttgggcatgtgcaccatgttcatcgtagtctgtgccttggttggagtattagtgccagagctccctgacttctctgatccattgctgggttttgaaccaagaggaacagcaataggccagagattggtcacatggaataatatggtgaaaaatacaggatacaaagcaacattagcaaattatccctttaaatatgcagatgaacaagccaaaagccatcgggatgatagatggtcagatgatcattatgaaagagagaaaagagaagttgactggaacttccacaaggacagctttttctgcgacgttccaagtgaccgatattccagagtggtatttacttcatctggaggggagacattatggaatttacctgcaattaaatcaatgtgcaatgtagataattccaggatcagatctcatccccagtttggtgatctctgccagaggaccactgctgcctcctgctgccccagctggacactgggaaactacatcgccattctgaacaatagatcgtcctgtcagaaaatagttgagcgagacgtttctcataccttgaagctgcttcggacttgtgccaaacactaccaaaatggcactctggggccagactgctgggacatggcagccagaagaaaggaccagctcaagtgcaccaatgtgccacgcaaatgtaccaagtacaatgctgtgtaccagatcctccattacttggtggacaaagactttatgaccccaaagacggctgactatgccacgccagctttaaaatacagcatgctcttctctcccacagagaaaggggagagcatgatgaacatttacttggacaactttgaaaactggaactcttctgacggcgtgactaccatcaccgggattgagtttggtatcaaacacagtttgtttcaggattatcttctaatggatactgtgtatcctgccatagccattgtgattgtccttttagttatgtgtgtctacaccaagtccatgtttatcactctgatgacaatgtttgcaataatcagttctttgattgtttcctattttctctatcgtgtagtatttcacttcgaattttttccttttatgaacctcactgccctcattattttggttggaattggagcagatgatgcttttgtcctgtgtgatgtttggaactacacaaaatttgataagcctcatgccgaaacctcagaaacagtaagcatcaccttgcagcacgctgccctctccatgttcgtcaccagttttaccactgctgctgccttttatgctaactatgttagcaacattacagcaatccgatgctttggggtttatgcggggacagctatattggtgaattacgttttgatggtcacatggcttccagcagttgttgtgctgcatgagcggtatcttcttaatatattcacttgcttcaaaaagccccagcagcaaatatatgataacaaaagctgctggacagtggcttgccagaagtgccacaaagtactctttgccatttcagaagcatctcgaatttttttcgaaaaagtattgccatgcattgtcattaagtttcgctacctttggctgttttggttccttgccttaactgtaggtggggcctacattgtatgtataaatccaaagatgaaactgccctcactggagttatccgagttccaggtgttccggtcgtcccatccttttgagcgttatgatgctgaatacaaaaagcttttcatgtttgaacgtgttcaccatggcgaggagctccacatgcccatcacagtaatctggggcgtgtccccagaagacaatggcaacccactaaatcccaagagtaaagggaagttgacattagatagcagttttaacatcgccagcccagcttcccaggcctggattttgcacttctgtcaaaaactgagaaaccaaacattcttttaccagactgatgaacaggacttcaccagctgcttcattgagacattcaaacagtggatggaaaaccaggactgtgatgagcctgccctgtacccatgctgcagccactggagcttcccctacaagcaagagatttttgaactgtgcatcaagagagctatcatggagctggaaaggagtacagggtaccatttggatagcaaaaccccagggccgaggtttgatatcaatgatactatcagggcagtggtgttagagttccagagtacctacctcttcacactggcttatgaaaagatgcatcagttttataaagaggtggactcgtggatatccagtgagctgagttcggcccctgaaggcctcagcaatggttggtttgtcagcaatctggagttctatgacctccaggatagcctctccgatggcaccctcattgccatggggctgtcagttgctgttgcatttagcgtgatgctgctgacaacttggaacatcatcataagcctttatgccatcatttcaattgctggaacgatatttgtcactgttggttctcttgtcctgctgggctgggagctcaatgtgttggaatctgtcaccatttcggttgccgtcggcttgtctgtagactttgccgtccattatggggttgcctaccgcttggctccagatcccgaccgagaaggcaaagtgatcttctctctgagtcgcgtgggctctgcgatggccatggctgccctgaccaccttcgtggcaggggccatgatgatgccctccacagttctagcttacacccagctgggcaccttcatgatgctcatcatgtgtatcagttgggctttcgccaccttctttttccagtgcatgtgccggtgccttggaccacagggtacctgtggtcagattcctttacctaaaaaactacagtgcagtgccttttcccatgccttgtctacaagtcccagtgacaagggacaaagcaaaacacataccataaatgcttatcatttagatcccaggggcccaaaatctgaactggagcatgagttttatgaattagaacctctggcttcccacagctgcactgcccctgagaagaccacttatgaagagacccacatctgctctgaatttttcaacagccaagcaaagaatttagggatgcctgtgcatgcagcttacaacagtgaactcagcaaaagcactgaaagtgacgctggctctgccttgttacagccccctcttgaacagcataccgtgtgtcacttcttctctctgaatcagagatgtagctgccccgatgcctacaaacacttgaactatggcccacactcttgccagcagatgggggactgcttgtgccaccagtgctctcctaccactagcagctttgtccagatccaaaacggcgtggcacctctgaaggccacacaccaagctgtcgagggctttgtgcaccccatcacgcacatccaccactgtccctgcctgcagggcagagtaaagccagccggaatgcagaattctctgcctaggaattttttcctccacccagtgcagcacattcaggcccaagaaaaaattggcaagaccaatgtacacagtcttcagaggagcatagaagagcatcttccaaagatggcagagccatcgtcatttgtctgcagaagcactggatcgttactcaaaacgtgttgcgaccccgagaataaacaaagggaactctgtaaaaatagagacgtgagcaatctggagagcagtggagggactgaaaacaaggcaggagggaaagtggagctgagcttgtcacagacggatgcaagtgtgaactcagaacatttcaatcagaatgaaccaaaagtcctatttaatcatttaatgggggaggctggttgtaggtcttgcccaaataattcacaaagttgtggcagaattgtgagagtgaagtgcaattctgtggactgtcaaatgccaaacatggaagccaatgtgcctgctgtattaacacactcggaactttctggtgaaagtttgttaataaaaacactataataaatgcagcattcaattcagaaaaagtgcctcaatta

SEQ ID NO: 23145 - DNA, 4672 bp, Homo sapiens
atttggcgaggcagtctccctcccagagtgttgggattacagagtcaagaaattggagcatggctatgagcaatggaaacaatgattttgtggttctgagcaacagcagcatcgcaaccagtgctgctaacccgagtcccctcaccccctgtgatggagaccatgcagcccagcagctcacacccaaagaagcaacaagaacaaaagtgagtccaaatggatgcctgcaacttaatggcacggtcaaatcatcctttctgcctttagacaaccaaagaatgcctcagatgttaccccaatgctgccatccttgcccataccatcaccctttgactagccatagcagtcaccaagagtgccatcccgaggctggccctgcagcaccctctgctttggcctcgtgttgcatgcagccacactccgagtattctgcatctctttgtccaaatcattcacctgtgtatcagactacgtgctgtcttcagccctctccatccttctgcctgcatcatccgtggcctgaccattttcagcatcagcctgtgcaacagcacatagccaacataagaccatccagacctttcaagttgccaaaaagttatgcagccctgatagccgactggccggtggtggtcttgggcatgtgcaccatgttcatcgtagtctgtgccttggttggagtattagtgccagagctccctgacttctctgatccattgctgggttttgaaccaagaggaacagcaataggccagagattggtcacatggaataatatggtgaaaaatacaggatacaaagcaacattagcaaattatccctttaaatatgcagatgaacaagccaaaagccatcgggatgatagatggtcagatgatcattatgaaagagagaaaagagaagttgactggaacttccacaaggacagctttttctgcgacgttccaagtgaccgatattccagagtggtatttacttcatctggaggggagacattatggaatttacctgcaattaaatcaatgtgcaatgtagataattccaggatcagatctcatccccagtttggtgatctctgccagaggaccactgctgcctcctgctgccccagctggacactgggaaactacatcgccattctgaacaatagatcgtcctgtcagaaaatagttgagcgagacgtttctcataccttgaagctgcttcggacttgtgccaaacactaccaaaatggcactctggggccagactgctgggacatggcagccagaagaaaggaccagctcaagtgcaccaatgtgccacgcaaatgtaccaagtacaatgctgtgtaccagatcctccattacttggtggacaaagactttatgaccccaaagacggctgactatgccacgccagctttaaaatacagcatgctcttctctcccacagagaaaggggagagcatgatgaacatttacttggacaactttgaaaactggaactcttctgacggcgtgactaccatcaccgggattgagtttggtatcaaacacagtttgtttcaggattatcttctaatggatactgtgtatcctgccatagccattgtgattgtccttttagttatgtgtgtctacaccaagtccatgtttatcactctgatgacaatgtttgcaataatcagttctttgattgtttcctattttctctatcgtgtagtatttcacttcgaattttttccttttatgaacctcactgccctcattattttggttggaattggagcagatgatgcttttgtcctgtgtgatgtttggaactacacaaaatttgataagcctcatgccgaaacctcagaaacagtaagcatcaccttgcagcacgctgccctctccatgttcgtcaccagttttaccactgctgctgccttttatgctaactatgttagcaacattacagcaatccgatgctttggggtttatgcggggacagctatattggtgaattacgttttgatggtcacatggcttccagcagttgttgtgctgcatgagcggtatcttcttaatatattcacttgcttcaaaaagccccagcagcaaatatatgataacaaaagctgctggacagtggcttgccagaagtgccacaaagtactctttgccatttcagaagcatctcgaatttttttcgaaaaagtattgccatgcattgtcattaagtttcgctacctttggctgttttggttccttgccttaactgtaggtggggcctacattgtatgtataaatccaaagatgaaactgccctcactggagttatccgagttccaggtgttccggtcgtcccatccttttgagcgttatgatgctgaatacaaaaagcttttcatgtttgaacgtgttcaccatggcgaggagctccacatgcccatcacagtaatctggggcgtgtccccagaagacaatggcaacccactaaatcccaagagtaaagggaagttgacattagatagcagttttaacatcgccagcccagcttcccaggcctggattttgcacttctgtcaaaaactgagaaaccaaacattcttttaccagactgatgaacaggacttcaccagctgcttcattgagacattcaaacagtggatggaaaaccaggactgtgatgagcctgccctgtacccatgctgcagccactggagcttcccctacaagcaagagatttttgaactgtgcatcaagagagctatcatggagctggaaaggagtacagggtaccatttggatagcaaaaccccagggccgaggtttgatatcaatgatactatcagggcagtggtgttagagttccagagtacctacctcttcacactggcttatgaaaagatgcatcagttttataaagaggtggactcgtggatatccagtgagctgagttcggcccctgaaggcctcagcaatggttggtttgtcagcaatctggagttctatgacctccaggatagcctctccgatggcaccctcattgccatggggctgtcagttgctgttgcatttagcgtgatgctgctgacaacttggaacatcatcataagcctttatgccatcatttcaattgctggaacgatatttgtcactgttggttctcttgtcctgctgggctgggagctcaatgtgttggaatctgtcaccatttcggttgccgtcggcttgtctgtagactttgccgtccattatggggttgcctaccgcttggctccagatcccgaccgagaaggcaaagtgatcttctctctgagtcgcgtgggctctgcgatggccatggctgccctgaccaccttcgtggcaggggccatgatgatgccctccacagttctagcttacacccagctgggcaccttcatgatgctcatcatgtgtatcagttgggctttcgccaccttctttttccagtgcatgtgccggtgccttggaccacagggtacctgtggtcagattcctttacctaaaaaactacagtgcagtgccttttcccatgccttgtctacaagtcccagtgacaagggacaaagcaaaacacataccataaatgcttatcatttagatcccaggggcccaaaatctgaactggagcatgagttttatgaattagaacctctggcttcccacagctgcactgcccctgagaagaccacttatgaagagacccacatctgctctgaatttttcaacagccaagcaaagaatttagggatgcctgtgcatgcagcttacaacagtgaactcagcaaaagcactgaaagtgacgctggctctgccttgttacagccccctcttgaacagcataccgtgtgtcacttcttctctctgaatcagagatgtagctgccccgatgcctacaaacacttgaactatggcccacactcttgccagcagatgggggactgcttgtgccaccagtgctctcctaccactagcagctttgtccagatccaaaacggcgtggcacctctgaaggccacacaccaagctgtcgagggctttgtgcaccccatcacgcacatccaccactgtccctgcctgcagggcagagtaaagccagccggaatgcagaattctctgcctaggaattttttcctccacccagtgcagcacattcaggcccaagaaaaaattggcaagaccaatgtacacagtcttcagaggagcatagaagagcatcttccaaagatggcagagccatcgtcatttgtctgcagaagcactggatcgttactcaaaacgtgttgcgaccccgagaataaacaaagggaactctgtaaaaatagagacgtgagcaatctggagagcagtggagggactgaaaacaaggcaggagggaaagtggagctgagcttgtcacagacggatgcaagtgtgaactcagaacatttcaatcagaatgaaccaaaagtcctatttaatcatttaatgggggaggctggttgtaggtcttgcccaaataattcacaaagttgtggcagaattgtgagagtgaagtgcaattctgtggactgtcaaatgccaaacatggaagccaatgtgcctgctgtattaacacactcggaactttctggtgaaagtttgttaataaaaacactataataaatgcagcattcaattcagaaaaagtgcctcaatta

SEQ ID NO: 23146 - DNA, 719 bp, Homo sapiens
gcggaccgcgccaggcggaagcccggctccgggccagcatccgagagcccggactggagagtcaacttttataacactgttactgggaatacttgacttactaagcttttactgaacactttaattttgggagtacaatttctaaactcacgaaataatcttcatgcaacaagatgttattttatcaaattttggtattacatgctcattctttgacaaattttaattaacagatttctgagagagcagacaccatcttatttctgttgaattgtatttagtaactcaaaaggcatataccaagctgtcagaagcagcttcatttaaaagaaataaaatttctagtcctgcctgaagtttaagctagcccatgactacacaagtgcaactgtatttcccaggtagatgccggtagattgggcccagtaagtttgggccgttgggatgtgaaaggaagagatgcgggcaactttttgggtcatcttcttaaagaaaaagccatttgtcctggatgccctcttttcttttttctctttggctgggaaatgacaagaattaaagcagcagccttggatccagagatggacgccaattgatgaagacagcagaactgactggctagtctgggttccctggagcagagctgtctctccaccctaggttatccacttacttttgtactgttatgtgagagagaaataaacttctatcttctttaa

SEQ ID NO: 23147 - DNA, 527 bp, Homo sapiens
tcggcgcgccgccgcccggcgccgcgggactgggagaccggatttctgagagagcagacaccatcttatttctgttgaattgtatttagtaactcaaaaggcatataccaagctgtcagaagcagcttcatttaaaagaaataaaatttctagtcctgcctgaagtttaagctagcccatgactacacaagtgcaactgtatttcccaggtagatgccggtagattgggcccagtaagtttgggccgttgggatgtgaaaggaagagatgcgggcaactttttgggtcatcttcttaaagaaaaagccatttgtcctggatgccctcttttcttttttctctttggctgggaaatgacaagaattaaagcagcagccttggatccagagatggacgccaattgatgaagacagcagaactgactggctagtctgggttccctggagcagagctgtctctccaccctaggttatccacttacttttgtactgttatgtgagagagaaataaacttctatcttctttaa

SEQ ID NO: 23148 - DNA, 596 bp, Homo sapiens
ccgagaagcccggactggagtatctgagaacatatttcttccctataggagttgagaagaggaggaagaataatgggaggagacaggacctttttcaacttgacaaatagatttctgagagagcagacaccatcttatttctgttgaattgtatttagtaactcaaaaggcatataccaagctgtcagaagcagcttcatttaaaagaaataaaatttctagtcctgcctgaagtttaagctagcccatgactacacaagtgcaactgtatttcccaggtagatgccggtagattgggcccagtaagtttgggccgttgggatgtgaaaggaagagatgcgggcaactttttgggtcatcttcttaaagaaaaagccatttgtcctggatgccctcttttcttttttctctttggctgggaaatgacaagaattaaagcagcagccttggatccagagatggacgccaattgatgaagacagcagaactgactggctagtctgggttccctggagcagagctgtctctccaccctaggttatccacttacttttgtactgttatgtgagagagaaataaacttctatcttctttaa

SEQ ID NO: 23149 - DNA, 983 bp, Homo sapiens
gcggaccgcgccaggcggaagcccggctccgggccagcatccgagagcccggactggagagtcaacttttataacactgttactgggaatacttgacttactaagcttttactgaacactttaattttgggagtacaatttctaaactcacgaaataatcttcatgcaacaagatgttattttatcaaattttggtattacatgctcattctttgacaaattttaattaacagatttctgagagagcagacaccatcttatttctgttgaattgtatttagtaactcaaaaggcatataccaagctgtcagaagcagcttcatttaaaagaaataaaatttctagtcctgcctgaagtttaagctagcccatgactacacaagtgcaactgtatttcccaggtagatgccggtagattgggcccagtaagtttgggccgttgggatgtgaaaggaagagatgcgggcaactttttgggtcatcttcttaaagaaaaagccatttgtcctggatgccctcttttcttttttctctttggctgggaaatgacaagaattaaagcagcagccttggatccagagatggacgccaattgatgaagacagcagaactgactggctagtctgggttccctggagcagagctgtctctccaccctaggttatccacttacttttgtactgttatgtgagagagaaataaacttctatcttctttaaaaaaaaaaaaaaaaaaaaaaaaaaaaaaaaagggggggggggaaaaaattcccccgggggggcccaattaacggcagtacccaggtttcttgtggtacaagggggccccataatggaggagcccgatataataatagagcgaggacggggccggcggcttaacaacggcggggagcggggaaaacctggtgacgctgggcaccttcggggaaggagaccctatcttgcggggggggcgacataatgtggggcaaaattacccta

SEQ ID NO: 23150 - DNA, 843 bp, Homo sapiens
ccgagaagcccggactggagtatctgagaacatatttcttccctataggagttgagaagaggaggaagaataatgggaggagacaggacctttttcaacttgacaaatagagtcaacttttataacactgttactgggaatacttgacttactaagcttttactgaacactttaattttgggagtacaatttctaaactcacgaaataatcttcatgcaacaagatgttattttatcaaattttggtattacatgctcattctttgacaaattttaattaacagatttctgagagagcagacaccatcttatttctgttgaattgtatttagtaactcaaaaggcatataccaagctgtcagaagcagcttcatttaaaagggattataatacctacctatgacagagactgccaaatatactccagtagccattctgcttttcttcttttcagaaataaaatttctagtcctgcctgaagtttaagctagcccatgactacacaagtgcaactgtatttcccaggtagatgccggtagattgggcccagtaagtttgggccgttgggatgtgaaaggaagagatgcgggcaactttttgggtcatcttcttaaagaaaaagccatttgtcctggatgccctcttttcttttttctctttggctgggaaatgacaagaattaaagcagcagccttggatccagagatggacgccaattgatgaagacagcagaactgactggctagtctgggttccctggagcagagctgtctctccaccctaggttatccacttacttttgtactgttatgtgagagagaaataaacttctatcttctttaa

SEQ ID NO: 23151 - DNA, 666 bp, Homo sapiens
atttggcgaggcagtctccctcccagagtgttgggattacagagtcaagaaattggagcatggctatgagcaatggaaacaatgattttgtggttctgagcaacagcagcatcgcaaccagtgctgctaacccgagtcccctcaccccctgtgatggagaccatgcagcccagcagctcacacccaaagaagcaacaagaacaaaagtgagtccaaatggatgcctgcaacttaatggcacggtcaaatcatcctttctgcctttagacaaccaaagaatgcctcagatgttaccccaatgctgccatccttgcccataccatcaccctttgactagccatagcagtcaccaagagtgccatcccgaggctggccctgcagcaccctctgctttggcctcgtgttgcatgcagccacactccgagtattctgcatctctttgtccaaatcattcacctgtgtatcagactacgtgctgtcttcagccctctccatccttctgcctgcatcatccgtggcctgaccattttcagcatcagcctgtgcaacagcacatagccaacataagaccatccagacctttcaagttgccacaaagttatgcagcttccacaacaacatcaacacaatcttcacatctgcccttctatgtgtcggtaccgagcc

SEQ ID NO: 23152 - DNA, 567 bp, Homo sapiens
gcggaccgcgccaggcggaagcccggctccgggccagcatccgagagcccggactggagagtcaacttttataacactgttactgggaatacttgacttactaagcttttactgaacactttaattttgggagtacaatttctaaactcacgaaataatcttcatgcaacaagatgttattttatcaaattttggtattacatgctcattctttgacaaattttaattaacagatttctgagagagcagacaccatcttatttctgttgaattgtatttagtaactcaaaaggcatataccaagctgtcagaagcagcttcatttaaaagaaataaaatttctagtcctgcctgaagtttaagctagcccatgactacacaagtgcaactgtatttcccagaattaaagcagcagccttggatccagagatggacgccaattgatgaagacagcagaactgactggctagtctgggttccctggagcagagctgtctctccaccctaggttatccacttacttttgtactgttatgtgagagagaaataaacttctatcttctttaa

SEQ ID NO: 23153 - DNA, 596 bp, Homo sapiens
ccgagaagcccggactggagtatctgagaacatatttcttccctataggagttgagaagaggaggaagaataatgggaggagacaggacctttttcaacttgacaaatagggtctcactcttgcccgggctggccttgaactcctgggctcaagccatctacctgcctcgacctcccagagtgttgggattacagaccatccagacctttcaagttgccaaaaagttatgcagccctgatagccgactggccggtggtggtcttgggcatgtgcaccatgttcatcgtagtctgtgccttggttggagtattagtgccagagctccctgacttctctgatccattgctgggttttgaaccaagaggaacagcaataggccagagattggtcacatggaataatatggtgaaaaatacaggatacaaagcaacattagcaaattatccctttaaatatgcagatgaacaagccaaaagccatcgggatgatagatggtcagatgatcattatgaaagagagaaaagagaagttgactggaacttccacaaggacagctttttctgcgacgttccaagtgagtgacattgtagatgaa

SEQ ID NO: 23154 - DNA, 3037 bp, Homo sapiens
ggaggattgcttgagtccaggagatcaaggctgtagtgagctgtgattgccccaggcaacagagtgagaccctgtctcaaacaacaacgacaacaacaaaacccactcaggctatatttaaactagatgaggccagatgtggtggcacatgtctgtggtcccagctactgaagaggctgaggtgggatgattacttaagcccaggaattcggggctatagtgagctatactgatggggtatctatactgtttggcatcaatatggtggccactggggagcatggtaccaccaggttgcctaaggaggggtgaactggcccaggttggaaacagagtgggtcaaaacttctgtgctggtcagtagtgggatcatgcctgtgaattgccactgcactccagtctgggcaacatagcaagaccccatcttaaaaaaaaaaaaaaactaatgggaaatgcttcattttggaagtgctgaaattctgaacccactagtgcaccagtggtaaattatcatgttacctgttatgccagatgaccaagagctaaggacatccccctgctaaaagcagtttatttcttgtacaccaagggtcaggcctcatacagaaaacatgagcaaactgatgactatgaaaataggaactgttactttttaatgttttctgcaaaagcttttgaaataaatagttcactgttttgcagatcacgttactagaaggacacatttatagttgtgggcggatgtggaatcagagggaaatttacactggacaccaccaccaagcccaaattattataatttagtcttgaatcactttaatcaacactttaaaatattttggtattcttagccataatttattttgttctcttacaagtgctctttagcagttttctggatcatcaaataagagttcagtaaaatttacttttgggtcaattagttggaatgacacttttggaattatcaattactttatttctgatgaattttgaacaggactcaccaacctcatttcttagtttagccgttttgagttacataaagacaaaaacatggcaaggattttacagcaggaaaatgatttgtttttgtttttcaacattcctataatccagagagctgaagaaatctttgatctagaaagcttggaaattcaaagcccctcaaggcacttcttttttttttttcaaattaaagaagaattaaaaacagtatttgtaatggaaaattttggtgccattaagtacataatggcttttactttagtctgtaattcatcctgtggatttaagattttggccaagagtaagttttaggtgtgatataacataagtgcctccaaggtttgctagtgttactgacattctagagtggtggaaaaacaactggcattaatgcagaattggagtgactagtcccaggaatcaagtcagaaaaaaagaccaactgacaaatagagttaatacaaaatgaattttaaaatcccaccctaggccaggcgcggtggctcatgcctgtaatcccagcactttgggaggccgaggcgggcggatcacaaggtcaggagttcgagaccagcctggccaatatggtgaaaccccattgctactaaaaatacaaaaattagcagggcatggtggcaggcacctgtaatcccagctacttgagaggctaaggcaggagaattgcttgaacccgggaggcggaggttgcagtgagccgatatcccaccactgcactccagcctgggcaacagagcgagactctgtgtcaaaggaaaaaaaaaattcccaccctagttagattaggatgcagaggactcacagatttggaggatttggaggacccaaattaccaaaaccccttctattacacacttgtaaagttttattagcagtcaggtacgttttcaggtacgtttccacccccattaacttttcagagcatgtgaggactttcttcctggagcatggtgggccttcaaagcgctgttaaaactacagccgccatttgtccgaggtggtaacattatgtcctgttatagatatcctggatctatttccaggatccagatatctctatttgaaaatgaccgtttttcttccctggtcttaaaagacaagcctgcttccggtgcctctgctggacaccaggagctgcactctgacaaactgtccagggtaaaggaggaagaactggtcagcctagggcacagaaactccagacttgatttaaccgtgtctgcttgaagcatagcctctcttacaaagacttcagaactcctgaattggctccaagccttgtgtgaggtgctctctgcttgccactggccatccctgggtactcaatgtggggctcttttgggaagccatctccagatgcttccttactctgagctgtacctgcttatggccctggtgtctcccatctcctccctggactggaagctcctctctagggcaaggattagatctcattcataatctacccccagacagagtatttcacacctaattaatgttcagtaagtatgttcagaataaatgtatattagtcccttttcatgctgctgataaagacgtacccaagactgggcaatttacaaaagaaagatgtttaatggactcacagttccatgaggctggggaggcctcacaatcatggtggaaggttaaaggcacgtctcatatggtagcagacaagggaagagagctgatgcagggaaactctcccctacaaaatcatcagatctcctgagactcattcatcaccatgagaacagcatgggaaagacccaccccctacaattcaaccacctcccaccgggtccctcccacaacacgagggaactgtgggagccacaagtcaagatgagatttgggtggggacacagccaaaccctatcaaaatggccaaaaagaatatgctcaaatttagactatgaggtacttataatccctcaagcccctgaagattgtcaaacactgaacttgcctttcagctatttctactatttttcaaaagacttatctt

SEQ ID NO: 23155 - DNA, 477 bp, Homo sapiens
gaactaagaaatgacatgatctcactgatattttaaaaatagactgaagagtagaagggggaaggaaccagagcaaccagtcagaaggcatttcagagaactgaaccagggtgcagtgggaagacagaattgtatctgtgtgtgttttgaaggtaaagaagacattacctgctgatggattagatatggaagtgtgacaaagaagtgccaagaataaccccaagcattttgacacaagcagcccaaaaatcaaggctgccatttaccaagatggggaagggtaaaggaagaccaggttggcgggcagcgggtggggcaggattcaggagtttggatttggacatgttaggtttgacatacctatttcacagtcgttgaagtggagacctaccttagtctcactgagccgccactgccccctaggtagcctgtggatcactacataggctgagggctggtctgctggctctgtgttct

SEQ ID NO: 23156 - DNA, 474 bp, Homo sapiens
atagtaggaaaaggatgagcattgtagctagtcacactcaaagggtacaagtatgcattcattagctcctaaattccctgatgatataattcacgagcatctgccatttatgaattttcgatattcctctatgtctgaaatacatgcatatatttatatcatataccaagggtccaactactatacaaagatttaacaaagcatctcaccttccggccataataggaaaatcatgtcacatttacccaaatgtggatacatctatctatttccattaaaaattatgcatagatgtcaggaaaaatgacagcaaggaattccagggacatacctgtccttagaaaaacaggaaaaaaaaaaaacactgtcacattccattttattggaaatttgttttaaaaaaaaaagtttaccaaaccactgtttaaaacaagaaaatgcttaaattaaaaaagcaactgaaactcagctgga

SEQ ID NO: 23157 - DNA, 689 bp, Homo sapiens
ctcttcccatggttcctaggaccatttcagacaagtgccaccacgcgacctcagcctcatgcaatctacaccctacatgccccccagagctggtgtgcctgggtgggctcagagaactcctagcaatcctccaagacccaactcaaacatcacctctcccctggagccctgctgtggaaacaaacagcaggctcagcactaataaaagcctcaccccatcatcttgagaatgaatgcaacacaccgtgccattcttgttgaattgtatgcttgcttccctccctgtgagagttctcaagtgcccaaaccagagcctacacatatcctaaggccggatgtgtgcttttttatgtgtcacgctacagggatccaaacagcgccaagaagatgaagaaggacccactgctgaaagggttaacatgttctgagctgtcccagaggcaggtggagtgggttctttctctgactttagtgatgaagaaactaaggcttggtataggtcagcggcctatgcaagcaggtaagtgacctctgactcagatgcttctcccacctgcccggcgggtccaaatttctgcccaatgccagatgacaaaactgcacagcaaaacaagttgttgttttttgggtttttttttctgagacagagtctcactctgtcacccaggctggagagcagactctgtctc

SEQ ID NO: 23158 - DNA, 248 bp, Homo sapiens
ctctcaaacacagtatcacttaagagaacaatatttagagcgatttaaaaagtctaagcaaaaccttactctgtggtctttttttagtctatcagctgaattataacaatgcttttacaaatattttcttttcattctttaccacaagtgttattctaattataatgcagttttatagcaatttttatagatccccaatagtcacatgctagataataaacattcttggaagcagtaggtctaaaggg

SEQ ID NO: 23159 - DNA, 212 bp, Homo sapiens
agcccggaaatgggaaggctctgtggtttcctctctgggttccagttagattcctttcgggaaagtgaacttggatatggagttgagtgaccccgagtgcacccccgcagtaaatgatgctcaggactaaagtgactgaaggcttttggggaaacagatgcgaacaaaacagcagtattcattttctaattaaaagcttgtgaaaatcgatg

SEQ ID NO: 23160 - DNA, 358 bp, Homo sapiens
tatttattttgcagaaataaaatgtctccctttttcttgcactctgaagatttagtagaatgaaaattacaataagcagagagagaatgttaccaactgcagatgtcagactcacatgtaccctcaggcacacacacacacacacacacatttctgcacttgtgaggccgttaagaagagcattttataaccttgcactctctaagctaaacttagccttaaatgggcatcagagaaataccaaaagatctgtgggaacttaactttttggcactagctcagttgatacccttatcttgaatgccattaagaacagagggaaagaaaattagagaaggaaaagcagacagtgggaagt

SEQ ID NO: 23161 - DNA, 476 bp, Homo sapiens
aacctccaaatgagtacacaaggtaaatacatattttataggcctatagctcatataatcgccaagctgaaagagttctttaagatctaagtataagtcctctggtctatagaatgaatgagtgaggcttgggtttcagttctggcttcttaactagctatgtgactttgggcagttcatttgtaccctctaaggttgtcagttaattcatctgtaaaagggaagtaatgccatctatctcatggagttgttcattttgttcatttcaacaatatttattgagtgcttatctgtgtatgatgctgttctagacacaataaacaagaccccaagaaatgttcctcctcgtgagcacacatttcagtgagggagacagacaagaaataagataaattagtaggctgggcacggtggctcacgcctgtaatcccagcactttgggaggccgaggcgggtggatcacgaggtcaggagat

SEQ ID NO: 23162 - DNA, 374 bp, Homo sapiens
agttacccagaacaggagttatcatggcccttacagtcccccaggaagaagaatggagacttttttttaaccgagccaggccaagggataaaaccagctctagctaagcaatggccttgaatatgggcagaggataatcctccaggactggtggtcaaccaagcccctgtactcatagaagttaagcctggggcccaaccaattagacaaaagcagtatccagttcccagggaagctcttgaaggaatccaggctcaactcaggcacttgaaagcctatggaattatagttccttgccagtctccatggaactcggttgttggagacgtgagtcttgctaaagctcttgcctaaataaagcccttccttcttta

SEQ ID NO: 23163 - DNA, 477 bp, Homo sapiens
tgtcttgcaagaagacatgggtagtgaggatgaaagtgagaactcccactattgagtgaaattctcaaatggggggaataagggaggagaccaccccttatattgtcttatgcccaatttctgcctccaaagaaagaagaagtaaaaactaaaaggcagaaatgaaatctacaaacagacaacccggtgccacaccctgggcctggtagttaaagatcgacccctgacctaatcagttatttgcataaaaaaggcactgtgaagatccgtgtcctgttcagtttctttctaattaccgatgtatgcagcccccagtcatgtacccctgcttgctcaattgatcacgaccctctcaagcggacacccttagagttgtgagcccttaaaagggacaggaattgctcacttggggagctcggttgttggagacgtgagtcttgctaaagctcttgcctaaataaagcccttccttcttta

SEQ ID NO: 23164 - DNA, 466 bp, Homo sapiens
actgaaaagccccaggcccctcctcagcccacccctctggcccgggccctcctggaccctcaatcaattctggaagtcctggtttcgacacccccacccagtccgggggacacaccctacctgtcgctgcagtcaaagccaatgaaaccaacccctgcgaggggcccagcccctgttcctgggctagggcttctgacaaaggattgggctggcccctcttcagccatccatgaaccctatcaaggatgacaggggtggacacagttgttcatccgtggaagctgcttccattccccgggtggctcgcgagtaggcttctcatcttactgatggggagactgaggcttaggatgtagctaatgagccatggggaggagagagggggtgactctgcagccagggcttgggaccccagagggactggatctgaggccaatcagaggacctgattcagaggtccccaagg

SEQ ID NO: 23165 - DNA, 407 bp, Homo sapiens
ttttttttttttgagacagagtctcactgcattgcccaggttggagtgcagtggtgtgatctcgacttgctgcaacctccacctcccgggttcaagcgattctcgtgccttagcctcccgcgtagctgggattacaggtgcaggctaccacacctggctaaatttctgtatttttagtagagacagggtttcaccacgttggccaggctggtctcgaactcctgacctcaggtgatccacctgccttggcctcccaaactgctgggatcacaggcgtgagccaccgtacctggccaccattactttcaatggcaaaattgcaccaacctattaaaataaattagtaatgattaagtcacatgccccaccttttgatactaacactgatgggtaattgaatagctcat

SEQ ID NO: 23166 - DNA, 616 bp, Homo sapiens
tttttttttggacagttttaattttatagattaatttaggggaatttgacatcattatcatgttaaagctttttatctaaaccatggtgcactatctaaaaatcatgccccttcatctttttttgtttccttcagatgaattttacactttacagagatctcatacatttttaagagtttattttttttaatttttacattttattgcctttattaatgaaatcctgtttataattttgcctaattttagtgcatgtaaaggccaattatttatgttaattttctacctggctacctgattccatttttttgttgtttttaatagtatttcacttaattagtttgtgtttgccaactacacagtcctgtcatcagcaaacactgataatgtaaccattgttacagtttgcattcctctttgtatcttaattgcattgtctagtacttctaaaataatgttcaataactggctataatgaattgagttgagatagatttaatcatattaaggagtatcaactaatccctagtcttaaaactttttaaagactgcatgtttaattttatcacatgccttttcgacatctgtggagatgatcatatgattttttttcct

SEQ ID NO: 23167 - DNA, 392 bp, Homo sapiens
tgggggtgaaaagttgaggaagtttttgcttgtttgccttaattatctcaggtaagtacatagaaaatatctccatctagtgaataagaaaattgggactggccaggcgtggtggcttatgcatgtaatcccagcacttggggaggctgaggcaggtggattatgaggtcaggaaatcgagaccatcctggctaacacggtgaaaccccgtctctactaaaaatacaaaaaaaaaaaaaaaaattagtcgggcgtggtggcgggcgcctgtagtcccagctactcgggaggctgaggcaggagaatggcgtgaacctgggaggtggagcttgcagtgagccgagattgcgccactgcactccaacctgggcaacagagcgagactccgtctc

SEQ ID NO: 23168 - DNA, 379 bp, Homo sapiens
ttttttttgagatggagtttcactcttgtcacccaagctggagtgcaatggtgcgatcttggctcactgcaacctccgcctcccaggttcaagtgattcttgtgcctcagcctcccaagtatctgagattacaggcctgagcaaccatgcccagctaatttttgtatttttagtagagactgggttttgccatgtcaggcaggctggtctcaaactcctgaccttaggtgatccacccacctcggcctctcaaagtgctgggattacaggtgggagccaccatgcctggccctaactaaaaacatttttaaacactgtgcagactaaataaatctgtggagtccatagggtccagttttagacccctggctgagctctc

SEQ ID NO: 23169 - DNA, 1096 bp, Homo sapiens
aagtgaccctctcacctcagcttcctgagtagctgggactacaggcatgcaccaccacgcctggctaatttttaaattttttgcagagacagggtctagctatgttgcccaccctggtcttgaactcctgggctcaagcaatctgtctgccttggtctcccagctcgctgggattacaggcatgaatcaccatgcccggtcctccaaagttgaacttttgagactcagtttccttcttggtaaattcaggctcctaggtgctacctcctcagagacatcctccttgaccacatcacatgacctctcgcagaggccagattctttaatgtattcatttgtctattatcatgtttccccagtagaagttgcacaaacggcaggggcttcatctgttttgtttgccgttatgtccttagcacctaaaattgtgcctggcacatatagtactcagtatgtatttgctgggtcaatgagtgagtgaatttatactaataacagcagctaccatttctagagtgtttaccatatattgggcactgtgtcaatcttcccaacaacccacagacgaagatcaattattacacccattgtacagatcaggaaactgagtcaggttaagaaacttgccctaaatcctacagtctcacttagaacttctgactgcagtgctcatcagaatgcattgtcaacccaaaggtcatttccagctcaggtggcttctatcaaaagagctcatcctggcctttccaagagccagacctccgacatcggtggagccctgtgcatagctggcctctcctgggcgtcttgtcccaagtacagagacctggatcctttcccactcatgtgcaacagcccaaaattaaaaacaaaagccatattaaaaaacaaaaccaactttctgccttaaaatattgtgagccagggggcaattagcaattatgctgtattttattatgagaagatagaattctaattggactgatttgaattccacacacctccacagattgttttgggaattaaggtatcagttgtatcggtaattatggtttaccattcaattacccccccacagaaaactgttaaattgtct

SEQ ID NO: 23170 - DNA, 917 bp, Homo sapiens
ggaattgaacgcacaagaaaagaataagaccccatcaaatacctggtgaatttgagacaaaagctgtaggaatgaaaaatagagtgattaaaaatcaattgatgggatatagagcagatttttgagaggattactgaacaggattctgtttccttctgccccaagtagaatgtcctctccgttgagaagaggtgcgggcagcagggagattttagttctaaacccaagccagaggaaatagttgtcattttccttgctctcttttgcccttttctaacagccagctgctggggcagtgctggtcctgggagcaaacgtcaccatctccctccagtcgggctggccaagtctcccagggaaattgaagaccagtacacctgaagcatgtaagccccaggctgcctctcccattctccttcccgttcatcagcagcataaagaaagttggcctgggttttcgtgactcggcagggtccactcagtttaaaatgccagaggacatggtgtggcaagttgactgtatcgtgatgttagccgtcttgtggcagagactcagagacttgaagggtaaagctcagtaaggcccacatccagagcctggggggccaatgactacaaggaaaatgaccctgctttctagccagcaccccactctcccgaacgcctctctcttcttaatagtctgaggaggtttatctcctttctgcagatgaagcagggaatctttgagaatctgagacactagtctgagaccacatagctgagggcgtggaggaacgtgccgaccccaaacacatgctggtggctaccatgcgaggctggctttttggatttagggccagccagcatttccaaattctgttcatggaacactgtagccctgatggaggataactggtattatagccaaaaaaaaa

SEQ ID NO: 23171 - DNA, 460 bp, Homo sapiens
agggccggctctggttgaatttggttttctggctactatcctcccccatgcagggatgtgggtcccctcatcggccattacaaagaggcacactaggcggcgcccatggcacatccaagcagtcacctgttgctcccggggtctcactggagggtacctccagggctcatcagcctgcacatcccagggcccaaacgccaccgcgaccttttgtccctccctggggtggccgagcctccatggccatcagttgggtcctgggcatggtcgcacactgcctgcatgatgtccacaaagtagtttacccactcaacttagcttcagtttcccccatgaagccctggtgcaggattcccacgtggatgctgcgggcatgacaccaacttgggtgaagcaggcagaacattcttccacagaggcatccccaactatttctgtctctgtgggaagtttgtcttat

SEQ ID NO: 23172 - DNA, 232 bp, Homo sapiens
agctgaaagccaagtataagcatggagttgaaatgagcatggacttgtgttgagaccacagatgcatcaagatttcaagctgtgcattatttaggccattttattcatttggctcccatttgaccacctcagctgcactgccagaggccagctaattcctctgcatctagcatcatctatgcctggataattcacgtatctcaccacacatgtatatcatttctttcttttg

SEQ ID NO: 23173 - DNA, 367 bp, Homo sapiens
aaaaaagatggttataaaatgcctgctgatttcagaaacagctccacagctggagcaacatactgattcatgaaatatgatgagaaacccaccagcacctcatccatcgagatgattattacactagcatttattaagtggtagatttttttctaccttgtagaattgtcttatttttatctctgatgttgataccttgtcttacctgagacaatgaataccagttacataccaaaagcatatttgtaacactatataatgtgaattcccccttaaaagatgcaaaaataacactgcaatgtcatgtattggcagcattttttatgtgtgtgtgtgtatatgtagccagctacagttatcttatcag

SEQ ID NO: 23174 - DNA, 298 bp, Homo sapiens
tattatgtcatttaatcctcactgggaccccatgaggtagacattattattcttattttatatattattacatggaaatataacttaatgatatatataacttaaaaatataacaatattataacaacaatttaccactccatctcactccagcatttaggacatttcttggtacatataaatattcaaaagtacaaattgagtttacttactataagcaagtagcttaagagtagattataattttacaatgtagaagaggtccttttgataatcacattctcatatttataaaacg

SEQ ID NO: 23175 - DNA, 806 bp, Homo sapiens
aaagccaggacagaactaacggctaggtacgaggctgggtgttgatgccccgctggcagatgctgagagttcttgaagaggagctcggcagggactggcaggccaaggtggcctccttggaggaggtgccctttgccgctgcctcaattgggcaggtgcaccagggcctgctgagggacgggacggaggtggccgtgaagatccagtaccccggcatagcccagagcattcagagcgatgtccagaacctgctggcggtactcaagatgagcgcggccctgcccgcgggcctgtttgccgagcagagcctgcaggccttgcagcaggagctggcttgggagtgtgactaccgtcgtgaggcggcttgtgcccagaatttcaggcagctgctggcaaatgaccccttcttccgggtcccagccgtggttaaggagctgtgcacgacacgggtgctgggcatggagctggctggaggggtccccctggaccagtgccagggcctaagccaggacctgcggaaccagatttgcttccagctcctgacgctgtgtctgcgggagctgtttgagttccgattcatgcagactgaccccaactgggccaacttcctgtatgatgcctccagccaccaggtgaccctgctggactttggtgcaagccgggagtttgggacagagttcacagaccattacatcgaggtggtgaaggctgcagctgatggagacagagactgtgtcctgcagaagtccagggacctcaaattcctcacaggctttgaaaccaaggtggggagacactgggggaga

SEQ ID NO: 23176 - DNA, 268 bp, Homo sapiens
aactagcagaggtactatcttgccaattagagctggcgctgcatgtcgttatgcagatcagactcatcagggggagccctcacctctgcctcaagcctcccgtggaaggcgagatggtcctggaggcagtcctcacctctgcctccctcgctcctccaacagctgccttctcccgggttccagcctctcagtgtgttggagaggtaggggtgcggggtgggggggagctgaatcttcaatcggaataaaagcagccctccccttcccc

SEQ ID NO: 23177 - DNA, 2292 bp, Homo sapiens
  misc_feature (17)..(17): n is a, c, g, or t
ggtttgctctgagcatncgaagcgcggcagggcgggacggactttcaaagacttggagttcccacgggtgtgggttcgagaccttcctctgccagttcccagctccgctaccctgagcaaatgacttacgctccattggattttccgcaatgtggctgaaggtggggggcctacttcgggggaccggtggacagctgggccagactgttggttggccttgtggggccctggggcctgggccccaccgctggggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaaggtgcctgcctcccgcatcagccgcttggccaactttgggggactggctgtgggcttggggctaggagtactggccgagatggctaagaagtccatgccaggaggtcgtctgcagtcagagggtggttctgggctggactccagccccttcctgtcggaggccaatgccgagcggattgtgcagaccttatgtacagttcgaggggccgccctcaaggttggccagatgctcagcatccaggacaacagcttcatcagccctcagctgcagcacatctttgagcgggtccgccagagcgccgacttcatgccccgctggcagatgctgagagttcttgaagaggagctcggcagggactggcaggccaaggtggcctccttggaggaggtgccctttgccgctgcctcaattgggcaggtgcaccagggcctgctgagggacgggacggaggtggccgtgaagatccagtaccccggcatagcccagagcattcagagcgatgtccagaacctgctggcggtactcaagatgagcgcggccctgcccgcgggcctgtttgccgagcagagcctgcaggccttgcagcaggagctggcttgggagtgtgactaccgtcgtgaggcggcttgtgcccagaatttcaggcagctgctggcaaatgaccccttcttccgggtcccagccgtggttaaggagctgtgcacgacacgggtgctgggcatggagctggctggaggggtccccctggaccagtgccagggcctaagccaggacctgcggaaccagatttgcttccagctcctgacgctgtgtctgcgggagctgtttgagttccgattcatgcagactgaccccaactgggccaacttcctgtatgatgcctccagccaccaggtgaccctgctggactttggtgcaagccgggagtttgggacagagttcacagaccattacatcgaggtggtgaaggctgcagctgatggagacagagactgtgtcctgcagaagtccagggacctcaaattcctcacaggctttgaaaccaaggcattctccgacgcccacgtggaggcagtgatgatcctgggggagcctttcgccacccagggcccttatgactttgggtcgggggaaacggcccgccgcatacaggacctcatcccggtgctgctgcggcaccggctgtgtcccccacccgaggagacctatgccctgcaccgcaagctggcaggggctttcctggcctgtgcccacctccgagcccacatcgcctgcagggacctcttccaggacacctaccaccgctactgggccagtcgccagccagacgcagccactgccggcagcctccccaccaaaggggactcctgggtggatccctcatgacagcctccatgggggattcagtccccagagcaggccgtaccctgctgtagtgcctcttatcccttccccgtctgccctgggtcagaggagcccccttgggcttcccagtcttgcctggctctcctccttggcccaggagctcaggatccctggggctggggaactcccaacttcgtgccctagatcctgcacctccccactcgaaagtgggtatccgaaaactaagccagggaagcggttaacttatctttgccaacatttgagggagccttgggccgctgcatgtcgttatgcagatcagactcatcagggggagccctcacctctgcctcaagcctcccgtggaaggcgagatggtcctggaggcagtcctcacctctgcctccctcgctcctccaacagctgccttctcccgggttccagcctctcagtgtgttggagaggtaggggtgcggggtgggggggagctgaatcttcaatcggaataaaagcagccctccccttcccc

SEQ ID NO: 23178 - DNA, 2588 bp, Homo sapiens
tctgagcatccgaagcgcggccaggtatgcatctagggcaccggggtcctggtggcgcgccagtgggccccctccctccacccctgtgactaaaccaccctccctacacggttgaatgacaagttcaaccttccctaaaacccccggtgacgagtccagccgcgcgcccattcttcacgcaggggcgggacggactttcaaagacttggagttcccacgggtgtgggttcgagaccttcctctgccagttcccagctccgctaccctgagcaaatgacttacgctccattggattttccgcaatgtggctgaaggtggggggcctacttcgggggaccggtggacagctgggccagactgttggttggccttgtggggccctggggcctgggccccaccgctggggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaaggtgcctgcctcccgcatcagccgcttggccaactttgggggactggctgtgggcttggggctaggagtactggccgagatggctaagaagtccatgccaggaggtcgtctgcagtcagagggtggttctgggctggactccagccccttcctgtcggaggccaatgccgagcggattgtgcagaccttatgtacagttcgaggggccgccctcaaggttggccagatgctcagcatccagggtacagcatgaccctcgactcctgacccctgacctcccttctaccccagccctacccaccaacaggccccaacttcagatactcacacggggtccctcctcacctcttcgcttacttcccccctggttccactgtctcccaagacaacagcttcatcagccctcagctgcagcacatctttgagcgggtccgccagagcgccgacttcatgccccgctggcagatgctgagagttcttgaagaggagctcggcagggactggcaggccaaggtggcctccttggaggaggtgccctttgccgctgcctcaattgggcaggtgcaccagggcctgctgagggacgggacggaggtggccgtgaagatccagtaccccggcatagcccagagcattcagagcgatgtccagaacctgctggcggtactcaagatgagcgcggccctgcccgcgggcctgtttgccgagcagagcctgcaggccttgcagcaggagctggcttgggagtgtgactaccgtcgtgaggcggcttgtgcccagaatttcaggcagctgctggcaaatgaccccttcttccgggtcccagccgtggttaaggagctgtgcacgacacgggtgctgggcatggagctggctggaggggtccccctggaccagtgccagggcctaagccaggacctgcggaaccagatttgcttccagctcctgacgctgtgtctgcgggagctgtttgagttccgattcatgcagactgaccccaactgggccaacttcctgtatgatgcctccagccaccaggtgaccctgctggactttggtgcaagccgggagtttgggacagagttcacagaccattacatcgaggtggtgaaggctgcagctgatggagacagagactgtgtcctgcagaagtccagggacctcaaattcctcacaggctttgaaaccaaggcattctccgacgcccacgtggaggcagtgatgatcctgggggagcctttcgccacccagggcccttatgactttgggtcgggggaaacggcccgccgcatacaggacctcatcccggtgctgctgcggcaccggctgtgtcccccacccgaggagacctatgccctgcaccgcaagctggcaggggctttcctggcctgtgcccacctccgagcccacatcgcctgcagggacctcttccaggacacctaccaccgctactgggccagtcgccagccagacgcagccactgccggcagcctccccaccaaaggggactcctgggtggatccctcatgacagcctccatgggggattcagtccccagagcaggccgtaccctgctgtagtgcctcttatcccttccccgtctgccctgggtcagaggagcccccttgggcttcccagtcttgcctggctctcctccttggcccaggagctcaggatccctggggctggggaactcccaacttcgtgccctagatcctgcacctccccactcgaaagtgggtatccgaaaactaagccagggaagcggttaacttatctttgccaacatttgagggagccttgggccgctgcatgtcgttatgcagatcagactcatcagggggagccctcacctctgcctcaagcctcccgtggaaggcgagatggtcctggaggcagtcctcacctctgcctccctcgctcctccaacagctgccttctcccgggttccagcctctcagtgtgttggagaggtaggggtgcggggtgggggggagctgaatcttcaatcggaataaaagcagccctccccttcccc

SEQ ID NO: 23179 - DNA, 2071 bp, Homo sapiens
caggttgcggactcggaggctgagagcagtggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaaggtgcctgcctcccgcatcagccgcttggccaactttgggggactggctgtgggcttggggctaggagtactggccgagatggctaagaagtccatgccaggaggtcgtctgcagtcagagggtggttctgggctggactccagccccttcctgtcggaggccaatgccgagcggattgtgcagaccttatgtacagttcgaggggccgccctcaaggttggccagatgctcagcatccaggacaacagcttcatcagccctcagctgcagcacatctttgagcgggtccgccagagcgccgacttcatgccccgctggcagatgctgagagttcttgaagaggagctcggcagggactggcaggccaaggtggcctccttggaggaggtgccctttgccgctgcctcaattgggcaggtgcaccagggcctgctgagggacgggacggaggtggccgtgaagatccagtaccccggcatagcccagagcattcagagcgatgtccagaacctgctggcggtactcaagatgagcgcggccctgcccgcgggcctgtttgccgagcagagcctgcaggccttgcagcaggagctggcttgggagtgtgactaccgtcgtgaggcggcttgtgcccagaatttcaggcagctgctggcaaatgaccccttcttccgggtcccagccgtggttaaggagctgtgcacgacacgggtgctgggcatggagctggctggaggggtccccctggaccagtgccagggcctaagccaggacctgcggaaccagatttgcttccagctcctgacgctgtgtctgcgggagctgtttgagttccgattcatgcagactgaccccaactgggccaacttcctgtatgatgcctccagccaccaggtgaccctgctggactttggtgcaagccgggagtttgggacagagttcacagaccattacatcgaggtggtgaaggctgcagctgatggagacagagactgtgtcctgcagaagtccagggacctcaaattcctcacaggctttgaaaccaaggcattctccgacgcccacgtggaggcagtgatgatcctgggggagcctttcgccacccagggcccttatgactttgggtcgggggaaacggcccgccgcatacaggacctcatcccggtgctgctgcggcaccggctgtgtcccccacccgaggagacctatgccctgcaccgcaagctggcaggggctttcctggcctgtgcccacctccgagcccacatcgcctgcagggacctcttccaggacacctaccaccgctactgggccagtcgccagccagacgcagccactgccggcagcctccccaccaaaggggactcctgggtggatccctcatgacagcctccatgggggattcagtccccagagcaggccgtaccctgctgtagtgcctcttatcccttccccgtctgccctgggtcagaggagcccccttgggcttcccagtcttgcctggctctcctccttggcccaggagctcaggatccctggggctggggaactcccaacttcgtgccctagatcctgcacctccccactcgaaagtgggtatccgaaaactaagccagggaagcggttaacttatctttgccaacatttgagggagccttgggccgctgcatgtcgttatgcagatcagactcatcagggggagccctcacctctgcctcaagcctcccgtggaaggcgagatggtcctggaggcagtcctcacctctgcctccctcgctcctccaacagctgccttctcccgggttccagcctctcagtgtgttggagaggtaggggtgcggggtgggggggagctgaatcttcaatcggaataaaagcagccctccccttcccc

SEQ ID NO: 23180 - DNA, 2318 bp, Homo sapiens
ggggttgcggactcggaggctggagagcggcaatgtggctgaaggtggggggcctacttcgggggaccggtggacagctgggccagactgttggttggccttgtggggccctggggcctgggccccaccgctggggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaaggtgcctgcctcccgcatcagccgcttggccaactttgggggactggctgtgggcttggggctaggagtactggccgagatggctaagaagtccatgccaggaggtcgtctgcagtcagagggtggttctgggctggactccagccccttcctgtcggaggccaatgccgagcggattgtgcagaccttatgtacagttcgaggggccgccctcaaggttggccagatgctcagcatccagggtacagcatgaccctcgactcctgacccctgacctcccttctaccccagccctacccaccaacaggccccaacttcagatactcacacggggtccctcctcacctcttcgcttacttcccccctggttccactgtctcccaagacaacagcttcatcagccctcagctgcagcacatctttgagcgggtccgccagagcgccgacttcatgccccgctggcagatgctgagagttcttgaagaggagctcggcagggactggcaggccaaggtggcctccttggaggaggtgccctttgccgctgcctcaattgggcaggtgcaccagggcctgctgagggacgggacggaggtggccgtgaagatccagtaccccggcatagcccagagcattcagagcgatgtccagaacctgctggcggtactcaagatgagcgcggccctgcccgcgggcctgtttgccgagcagagcctgcaggccttgcagcaggagctggcttgggagtgtgactaccgtcgtgaggcggcttgtgcccagaatttcaggcagctgctggcaaatgaccccttcttccgggtcccagccgtggttaaggagctgtgcacgacacgggtgctgggcatggagctggctggaggggtccccctggaccagtgccagggcctaagccaggacctgcggaaccagatttgcttccagctcctgacgctgtgtctgcgggagctgtttgagttccgattcatgcagactgaccccaactgggccaacttcctgtatgatgcctccagccaccaggtgaccctgctggactttggtgcaagccgggagtttgggacagagttcacagaccattacatcgaggtggtgaaggctgcagctgatggagacagagactgtgtcctgcagaagtccagggacctcaaattcctcacaggctttgaaaccaaggcattctccgacgcccacgtggaggcagtgatgatcctgggggagcctttcgccacccagggcccttatgactttgggtcgggggaaacggcccgccgcatacaggacctcatcccggtgctgctgcggcaccggctgtgtcccccacccgaggagacctatgccctgcaccgcaagctggcaggggctttcctggcctgtgcccacctccgagcccacatcgcctgcagggacctcttccaggacacctaccaccgctactgggccagtcgccagccagacgcagccactgccggcagcctccccaccaaaggggactcctgggtggatccctcatgacagcctccatgggggattcagtccccagagcaggccgtaccctgctgtagtgcctcttatcccttccccgtctgccctgggtcagaggagcccccttgggcttcccagtcttgcctggctctcctccttggcccaggagctcaggatccctggggctggggaactcccaacttcgtgccctagatcctgcacctccccactcgaaagtgggtatccgaaaactaagccagggaagcggttaacttatctttgccaacatttgagggagccttgggccgctgcatgtcgttatgcagatcagactcatcagggggagccctcacctctgcctcaagcctcccgtggaaggcgagatggtcctggaggcagtcctcacctctgcctccctcgctcctccaacagctgccttctcccgggttccagcctctcagtgtgttggagaggtaggggtgcggggtgggggggagctgaatcttcaatcggaataaaagcagccctccccttcccc

SEQ ID NO: 23181 - DNA, 1632 bp, Homo sapiens
aaagccaggacagaactaacggctaggtacgaggctgggtgttgatgccccgctggcagatgctgagagttcttgaagaggagctcggcagggactggcaggccaaggtggcctccttggaggaggtgccctttgccgctgcctcaattgggcaggtgcaccagggcctgctgagggacgggacggaggtggccgtgaagatccagtaccccggcatagcccagagcattcagagcgatgtccagaacctgctggcggtactcaagatgagcgcggccctgcccgcgggcctgtttgccgagcagagcctgcaggccttgcagcaggagctggcttgggagtgtgactaccgtcgtgaggcggcttgtgcccagaatttcaggcagctgctggcaaatgaccccttcttccgggtcccagccgtggttaaggagctgtgcacgacacgggtgctgggcatggagctggctggaggggtccccctggaccagtgccagggcctaagccaggacctgcggaaccagatttgcttccagctcctgacgctgtgtctgcgggagctgtttgagttccgattcatgcagactgaccccaactgggccaacttcctgtatgatgcctccagccaccaggtgaccctgctggactttggtgcaagccgggagtttgggacagagttcacagaccattacatcgaggtggtgaaggctgcagctgatggagacagagactgtgtcctgcagaagtccagggacctcaaattcctcacaggctttgaaaccaaggcattctccgacgcccacgtggaggcagtgatgatcctgggggagcctttcgccacccagggcccttatgactttgggtcgggggaaacggcccgccgcatacaggacctcatcccggtgctgctgcggcaccggctgtgtcccccacccgaggagacctatgccctgcaccgcaagctggcaggggctttcctggcctgtgcccacctccgagcccacatcgcctgcagggacctcttccaggacacctaccaccgctactgggccagtcgccagccagacgcagccactgccggcagcctccccaccaaaggggactcctgggtggatccctcatgacagcctccatgggggattcagtccccagagcaggccgtaccctgctgtagtgcctcttatcccttccccgtctgccctgggtcagaggagcccccttgggcttcccagtcttgcctggctctcctccttggcccaggagctcaggatccctggggctggggaactcccaacttcgtgccctagatcctgcacctccccactcgaaagtgggtatccgaaaactaagccagggaagcggttaacttatctttgccaacatttgagggagccttgggccgctgcatgtcgttatgcagatcagactcatcagggggagccctcacctctgcctcaagcctcccgtggaaggcgagatggtcctggaggcagtcctcacctctgcctccctcgctcctccaacagctgccttctcccgggttccagcctctcagtgtgttggagaggtaggggtgcggggtgggggggagctgaatcttcaatcggaataaaagcagccctccccttcccc

SEQ ID NO: 23182 - DNA, 1639 bp, Homo sapiens
  misc_feature (26)..(26): n is a, c, g, or t
tgtgtccaagttaaaccccccccggngttatggtagcgaggctgggtggcgatgccccgctggcagatgctgagagttcttgaagaggagctcggcagggactggcaggccaaggtggcctccttggaggaggtgccctttgccgctgcctcaattgggcaggtgcaccagggcctgctgagggacgggacggaggtggccgtgaagatccagtaccccggcatagcccagagcattcagagcgatgtccagaacctgctggcggtactcaagatgagcgcggccctgcccgcgggcctgtttgccgagcagagcctgcaggccttgcagcaggagctggcttgggagtgtgactaccgtcgtgaggcggcttgtgcccagaatttcaggcagctgctggcaaatgaccccttcttccgggtcccagccgtggttaaggagctgtgcacgacacgggtgctgggcatggagctggctggaggggtccccctggaccagtgccagggcctaagccaggacctgcggaaccagatttgcttccagctcctgacgctgtgtctgcgggagctgtttgagttccgattcatgcagactgaccccaactgggccaacttcctgtatgatgcctccagccaccaggtgaccctgctggactttggtgcaagccgggagtttgggacagagttcacagaccattacatcgaggtggtgaaggctgcagctgatggagacagagactgtgtcctgcagaagtccagggacctcaaattcctcacaggctttgaaaccaaggcattctccgacgcccacgtggaggcagtgatgatcctgggggagcctttcgccacccagggcccttatgactttgggtcgggggaaacggcccgccgcatacaggacctcatcccggtgctgctgcggcaccggctgtgtcccccacccgaggagacctatgccctgcaccgcaagctggcaggggctttcctggcctgtgcccacctccgagcccacatcgcctgcagggacctcttccaggacacctaccaccgctactgggccagtcgccagccagacgcagccactgccggcagcctccccaccaaaggggactcctgggtggatccctcatgacagcctccatgggggattcagtccccagagcaggccgtaccctgctgtagtgcctcttatcccttccccgtctgccctgggtcagaggagcccccttgggcttcccagtcttgcctggctctcctccttggcccaggagctcaggatccctggggctggggaactcccaacttcgtgccctagatcctgcacctccccactcgaaagtgggtatccgaaaactaagccagggaagcggttaacttatctttgccaacatttgagggagccttgggccgctgcatgtcgttatgcagatcagactcatcagggggagccctcacctctgcctcaagcctcccgtggaaggcgagatggtcctggaggcagtcctcacctctgcctccctcgctcctccaacagctgccttctcccgggttccagcctctcagtgtgttggagaggtaggggtgcggggtgggggggagctgaatcttcaatcggaataaaagcagccctccccttcccc

SEQ ID NO: 23183 - DNA, 986 bp, Homo sapiens
tgctcactcttgggggagtcggggcttgtgttgatggtggagactggagggagtggaggctacacgttgtttctgggttatgcagagggctctatgtccacactggctgcctttgctctccccccacccccactcccaggcattctccgacgcccacgtggaggcagtgatgatcctgggggagcctttcgccacccagggcccttatgactttgggtcgggggaaacggcccgccgcatacaggacctcatcccggtgctgctgcggcaccggctgtgtcccccacccgaggagacctatgccctgcaccgcaagctggcaggggctttcctggcctgtgcccacctccgagcccacatcgcctgcagggacctcttccaggacacctaccaccgctactgggccagtcgccagccagacgcagccactgccggcagcctccccaccaaaggggactcctgggtggatccctcatgacagcctccatgggggattcagtccccagagcaggccgtaccctgctgtagtgcctcttatcccttccccgtctgccctgggtcagaggagcccccttgggcttcccagtcttgcctggctctcctccttggcccaggagctcaggatccctggggctggggaactcccaacttcgtgccctagatcctgcacctccccactcgaaagtgggtatccgaaaactaagccagggaagcggttaacttatctttgccaacatttgagggagccttgggccgctgcatgtcgttatgcagatcagactcatcagggggagccctcacctctgcctcaagcctcccgtggaaggcgagatggtcctggaggcagtcctcacctctgcctccctcgctcctccaacagctgccttctcccgggttccagcctctcagtgtgttggagaggtaggggtgcggggtgggggggagctgaatcttcaatcggaataaaagcagccctccccttcccc

SEQ ID NO: 23184 - DNA, 1953 bp, Homo sapiens
tctgagcatccgaagcgcggccaggtatgcatctagggcaccggggtcctggtggcgcgccagtgggccccctccctccacccctgtgactaaaccaccctccctacacggttgaatgacaagttcaaccttccctaaaacccccggtgacgagtccagccgcgcgcccattcttcacgcaggggcgggacggactttcaaagacttggagttcccacgggtgtgggttcgagaccttcctctgccagttcccagctccgctaccctgagcaaatgacttacgctccattggattttccgcaatgtggctgaaggtggggggcctacttcgggggaccggtggacagctgggccagactgttggttggccttgtggggccctggggcctgggccccaccgctggggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaaggtgcctgcctcccgcatcagccgcttggccaactttgggggactggctgtgggcttggggctaggagtactggccgagatggctaagaagtccatgccaggaggtcgtctgcagtcagagggtggttctgggctggactccagccccttcctgtcggaggccaatgccgagcggattgtgcagaccttatgtacagttcgaggggccgccctcaaggttggccagatgctcagcatccagggtacagcatgaccctcgactcctgacccctgacctcccttctaccccagccctacccaccaacaggccccaacttcagatactcacacggggtccctcctcacctcttcgcttacttcccccctggttccactgtctcccaagacaacagcttcatcagccctcagctgcagcacatctttgagcgggtccgccagagcgccgacttcatgccccgctggcagatgctgctggtgagtgcccagtgggggagggcggtgagggaggcaggctccatctcctctgacctgcctgaccttcctggcttcactgccccactccctgcctctgagcctcactttccccatctgtaaaatgggaatcaccagagtacacacctcctggcattgctgtggtgattaaaacagggaacagcagcctgacctctctgtgcttcagttcccttccctgggaaatggcgatagtgacagccacacccacatcatagggtcacataaatcagtttacactgagcactgagaacggcccctgattcactgtgagcaacatgcaggtgttagctgtgattattactgtttttttaattaaaggagatcgtgtctgtaataggttggcacggcgcctggcaccaagtaagtgcccaggacatgagctgttctaataactgggtaaggcatggaatccaggattccgccacccacctgctctcccatccctgttctgcttattcgccatgcggccccaggcaggtactgcctctctctgggccactctgaataggacctggcccacaggaagcccattgtaaattttagctcttcttgatcacagtaactgtgagttaataataacatataagagcataataaaggatggttggccacgtgtaatggctcatgcctgtaatcccagcactttgggaggctgcggtgggaggatcatttgagctcaggacttccagaccaccctgggcaacatagtgagaccttgtctctactaaacataataacagtaataattagctgggcacagtggcacatatctgtagtcccagctattcaggaggcaggaggatggcttgagctcgggaggttgatgctgcagtgagccgtgagagtgccactacactccagcctgggctacagaacaagaccctgtctca

SEQ ID NO: 23185 - DNA, 2445 bp, Homo sapiens
tctgagcatccgaagcgcggccaggtatgcatctagggcaccggggtcctggtggcgcgccagtgggccccctccctccacccctgtgactaaaccaccctccctacacggttgaatgacaagttcaaccttccctaaaacccccggtgacgagtccagccgcgcgcccattcttcacgcaggggcgggacggactttcaaagacttggagttcccacgggtgtgggttcgagaccttcctctgccagttcccagctccgctaccctgagcaaatgacttacgctccattggattttccgcaatgtggctgaaggtggggggcctacttcgggggaccggtggacagctgggccagactgttggttggccttgtggggccctggggcctgggccccaccgctggggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaaggtgcctgcctcccgcatcagccgcttggccaactttgggggactggctgtgggcttggggctaggagtactggccgagatggctaagaagtccatgccaggaggtcgtctgcagtcagagggtggttctgggctggactccagccccttcctgtcggaggccaatgccgagcggattgtgcagaccttatgtacagttcgaggggccgccctcaaggttggccagatgctcagcatccaggacaacagcttcatcagccctcagctgcagcacatctttgagcgggtccgccagagcgccgacttcatgccccgctggcagatgctgagagttcttgaagaggagctcggcagggactggcaggccaaggtggcctccttggaggaggtgccctttgccgctgcctcaattgggcaggtgcaccagggcctgctgagggacgggacggaggtggccgtgaagatccagtaccccggcatagcccagagcattcagagcgatgtccagaacctgctggcggtactcaagatgagcgcggccctgcccgcgggcctgtttgccgagcagagcctgcaggccttgcagcaggagctggcttgggagtgtgactaccgtcgtgaggcggcttgtgcccagaatttcaggcagctgctggcaaatgaccccttcttccgggtcccagccgtggttaaggagctgtgcacgacacgggtgctgggcatggagctggctggaggggtccccctggaccagtgccagggcctaagccaggacctgcggaaccagatttgcttccagctcctgacgctgtgtctgcgggagctgtttgagttccgattcatgcagactgaccccaactgggccaacttcctgtatgatgcctccagccaccaggtgaccctgctggactttggtgcaagccgggagtttgggacagagttcacagaccattacatcgaggtggtgaaggctgcagctgatggagacagagactgtgtcctgcagaagtccagggacctcaaattcctcacaggctttgaaaccaaggcattctccgacgcccacgtggaggcagtgatgatcctgggggagcctttcgccacccagggcccttatgactttgggtcgggggaaacggcccgccgcatacaggacctcatcccggtgctgctgcggcaccggctgtgtcccccacccgaggagacctatgccctgcaccgcaagctggcaggggctttcctggcctgtgcccacctccgagcccacatcgcctgcagggacctcttccaggacacctaccaccgctactgggccagtcgccagccagacgcagccactgccggcagcctccccaccaaaggggactcctgggtggatccctcatgacagcctccatgggggattcagtccccagagcaggccgtaccctgctgtagtgcctcttatcccttccccgtctgccctgggtcagaggagcccccttgggcttcccagtcttgcctggctctcctccttggcccaggagctcaggatccctggggctggggaactcccaacttcgtgccctagatcctgcacctccccactcgaaagtgggtatccgaaaactaagccagggaagcggttaacttatctttgccaacatttgagggagccttgggccgctgcatgtcgttatgcagatcagactcatcagggggagccctcacctctgcctcaagcctcccgtggaaggcgagatggtcctggaggcagtcctcacctctgcctccctcgctcctccaacagctgccttctcccgggttccagcctctcagtgtgttggagaggtaggggtgcggggtgggggggagctgaatcttcaatcggaataaaagcagccctccccttcccc

SEQ ID NO: 23186 - DNA, 2053 bp, Homo sapiens
caggttgcggactcggaggctgagagcagtgcaatgtggctgaaggtggggggcctacttcgggggaccggtggacagctgggccagactgttggttggccttgtggggccctggggcctgggccccaccgctggggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaaggtgcctgcctcccgcatcagccgcttggccaactttgggggactggctgtgggcttggggctaggagtactggccgagatggctaagaagtccatgccaggaggtcgtctgcagtcagacaacagcttcatcagccctcagctgcagcacatctttgagcgggtccgccagagcgccgacttcatgccccgctggcagatgctgagagttcttgaagaggagctcggcagggactggcaggccaaggtggcctccttggaggaggtgccctttgccgctgcctcaattgggcaggtgcaccagggcctgctgagggacgggacggaggtggccgtgaagatccagtaccccggcatagcccagagcattcagagcgatgtccagaacctgctggcggtactcaagatgagcgcggccctgcccgcgggcctgtttgccgagcagagcctgcaggccttgcagcaggagctggcttgggagtgtgactaccgtcgtgaggcggcttgtgcccagaatttcaggcagctgctggcaaatgaccccttcttccgggtcccagccgtggttaaggagctgtgcacgacacgggtgctgggcatggagctggctggaggggtccccctggaccagtgccagggcctaagccaggacctgcggaaccagatttgcttccagctcctgacgctgtgtctgcgggagctgtttgagttccgattcatgcagactgaccccaactgggccaacttcctgtatgatgcctccagccaccaggtgaccctgctggactttggtgcaagccgggagtttgggacagagttcacagaccattacatcgaggtggtgaaggctgcagctgatggagacagagactgtgtcctgcagaagtccagggacctcaaattcctcacaggctttgaaaccaaggcattctccgacgcccacgtggaggcagtgatgatcctgggggagcctttcgccacccagggcccttatgactttgggtcgggggaaacggcccgccgcatacaggacctcatcccggtgctgctgcggcaccggctgtgtcccccacccgaggagacctatgccctgcaccgcaagctggcaggggctttcctggcctgtgcccacctccgagcccacatcgcctgcagggacctcttccaggacacctaccaccgctactgggccagtcgccagccagacgcagccactgccggcagcctccccaccaaaggggactcctgggtggatccctcatgacagcctccatgggggattcagtccccagagcaggccgtaccctgctgtagtgcctcttatcccttccccgtctgccctgggtcagaggagcccccttgggcttcccagtcttgcctggctctcctccttggcccaggagctcaggatccctggggctggggaactcccaacttcgtgccctagatcctgcacctccccactcgaaagtgggtatccgaaaactaagccagggaagcggttaacttatctttgccaacatttgagggagccttgggccgctgcatgtcgttatgcagatcagactcatcagggggagccctcacctctgcctcaagcctcccgtggaaggcgagatggtcctggaggcagtcctcacctctgcctccctcgctcctccaacagctgccttctcccgggttccagcctctcagtgtgttggagaggtaggggtgcggggtgggggggagctgaatcttcaatcggaataaaagcagccctccccttcccc

SEQ ID NO: 23187 - DNA, 1985 bp, Homo sapiens
gggaaagatgccccaaccagatgcctctattccagactgtgagaagtgggcaatgtggctgaaggtggggggcctacttcgggggaccggtggacagctgggccagactgttggttggccttgtggggccctggggcctgggccccaccgctggggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaagacaacagcttcatcagccctcagctgcagcacatctttgagcgggtccgccagagcgccgacttcatgccccgctggcagatgctgtaccccggcatagcccagagcattcagagcgatgtccagaacctgctggcggtactcaagatgagcgcggccctgcccgcgggtgaggcgcccacccactcctctgctgacctcccaaaggggctatgcccagagagagaaagcaggagggggagcccagaggagagcacgggcagggtgtgctggcgttgtgagcgggagtgtcagagacagaaaggacaccaaggcggggagagcccagggagcatgagcaggcctgtttgccgagcagagcctgcaggccttgcagcaggagctggcttgggagtgtgactaccgtcgtgaggcggcttgtgcccagaatttcaggcagctgctggcaaatgaccccttcttccgggtcccagccgtggttaaggagctgtgcacgacacgggtgctgggcatggagctggctggaggggtccccctggaccagtgccagggcctaagccaggacctgcggaaccagatttgcttccagctcctgacgctgtgtctgcgggagctgtttgagttccgattcatgcagactgaccccaactgggccaacttcctgtatgatgcctccagccaccaggtgaccctgctggactttggtgcaagccgggagtttgggacagagttcacagaccattacatcgaggtggtgaaggctgcagctgatggagacagagactgtgtcctgcagaagtccagggacctcaaattcctcacaggctttgaaaccaaggcattctccgacgcccacgtggaggcagtgatgatcctgggggagcctttcgccacccagggcccttatgactttgggtcgggggaaacggcccgccgcatacaggacctcatcccggtgctgctgcggcaccggctgtgtcccccacccgaggagacctatgccctgcaccgcaagctggcaggggctttcctggcctgtgcccacctccgagcccacatcgcctgcagggacctcttccaggacacctaccaccgctactgggccagtcgccagccagacgcagccactgccggcagcctccccaccaaaggggactcctgggtggatccctcatgacagcctccatgggggattcagtccccagagcaggccgtaccctgctgtagtgcctcttatcccttccccgtctgccctgggtcagaggagcccccttgggcttcccagtcttgcctggctctcctccttggcccaggagctcaggatccctggggctggggaactcccaacttcgtgccctagatcctgcacctccccactcgaaagtgggtatccgaaaactaagccagggaagcggttaacttatctttgccaacatttgagggagccttgggccgctgcatgtcgttatgcagatcagactcatcagggggagccctcacctctgcctcaagcctcccgtggaaggcgagatggtcctggaggcagtcctcacctctgcctccctcgctcctccaacagctgccttctcccgggttccagcctctcagtgtgttggagaggtaggggtgcggggtgggggggagctgaatcttcaatcggaataaaagcagccctccccttcccc

SEQ ID NO: 23188 - DNA, 496 bp, Homo sapiens
  misc_feature (17)..(17): n is a, c, g, or t
ggtttgctctgagcatncgaagcgcggcagggcgggacggactttcaaagacttggagttcccacgggtgtgggttcgagaccttcctctgccagttcccagctccgctaccctgagcaaatgacttacgctccattggattttccgcaatgtggctgaaggtggggggcctacttcgggggaccggtggacagctgggccagactgttggttggccttgtggggccctggggcctgggccccaccgctggggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaaggtgcctgcctcccgcatcagccgcttggccaactttggggcggcccctcgaactgtacataaggtctgcacaatccgctcggcattggcctccgacag

SEQ ID NO: 23189 - DNA, 353 bp, Homo sapiens
gaagacgggcagacataagaacccatccaatggtggttacattgattatatccttcctgaggcatctgaaatagtataaaataataaggagagaacaccaaaaatgtatcaacttccatgtaactagtgtgtattagcccatttttgctttgttgtaaaagaatatctgaaatttagaaatttagtaatttagaaagaaaagaggtttatttagttcgtggttctgcaggctgtacaagcttggcaccagcatctggtgaagcctcaggaagctttcactcatggcagaaggcgaatagggagcaggtgtgtcacatagcaagagaggaagcaaaggagtggggaggatgtgc

SEQ ID NO: 23190 - DNA, 315 bp, Homo sapiens
gcagtggtgggatctcggtgtgagccaccatgcctggcctgttcatttctattatttttatctttgaaaaatgttttattaaaatgctatataatattctttaacattttaatgctgtggaaattgcttatgatgtatgataatctataaacaacccatttccttaggatttgacttgtaaaatttgggcttcctaatttaggtatttttccgtattatgcatacagttttgtacaatatacatttaaagatatgttgttaaatatttgaaaaatgagcacttatatttgaagaatgtaaatttctgggtttttt

SEQ ID NO: 23191 - DNA, 309 bp, Homo sapiens
tcatatgctgtgttctagagattaaggtggaacttgtcaaagagataatttacttaacaaatatgcaacttgttttcagtagattcatgatttaataactgtactaaataccatacccacatgattcttatttaatcctcacaacaattttgtgaggcaaaaatcagacagattaaattacttgcccaaggtcacaaagctagtgcctatgccatcagacttcaaacccaggcagtctcaaatctggtagtgctggacaccgctatctcaggtatcctctctgacttttgcctggcttgcatagcatta

SEQ ID NO: 23192 - DNA, 573 bp, Homo sapiens
ctactgcctgtccaagctcactacttttcaagaggccaatccctgggtaaatcttagtgaatagcagtcgactgtgttatttatctgtgccccatgctggaggtgcagactcggtgagaccagcagagcagctgaggttagactcagtggaaaatccagaagtgcagatgtggatccaaattgggctgaaaaaatctcatgagatcaggctttcttggacttcctgcttttagcctaagcactatgttcaacataaacgaactttcggtattttgaaacttccgtttctgatctcagaacctggaagtaaagagctgttgtgaacatttccacaaattttgtcatggttattctggaggcagagttgaaccctgtaattacggagctttgggactcactacacccacagtggcctgcctggattgcagtatgggagaggggaaggcattttggtggagagtccaggctttggagacaggcaggaccctgttcaaattctagctctgccatttccggccatgtgactggacctgtcagagtctcagtttcctcatcagttagattaaaaaaaaa

SEQ ID NO: 23193 - DNA, 189 bp, Homo sapiens
atgaattgtaatctattgtgatcgatttcttttgctcaaaataatgtttttatattgtagcatgtatattcattcttattgccaaataatattccattgtgtggatatacatgtgtacatcttactgattttttggttgatgaatatttgggttgttttcactttttggctactgtattatgaaaaatg

SEQ ID NO: 23194 - DNA, 504 bp, Homo sapiens
tttgaaattcactcaaagaaaagtaaccattttgaaaaatgcccagaacattctgttttccataacaaaggccttccatccaggaaaactactttatcagaaccttatctggccaagggaaaaggaaaacttgaaaaatgaagcctccagtagctttctggataacttaatggggtgggtgggtcagggcaggaagagagaaagaaaggagggaagaggaggcggagggagagggaagagaggcccggggggcgggaggaagacaggcaggcaggcaaagaaacttctgaagttcacagtccaggaactcagacttactaaaaaactgagactcacaggattacaggacattttccttccctaataccttaccaccacatcaacagggctgtagtataatcacagtgaattacaatggaggggcaagataaaaacttcacttgtaatggttaatttttggtgtcatcttgactgaataaagaaatacgtagaaacccaaaaaaa

SEQ ID NO: 23195 - DNA, 578 bp, Homo sapiens
tttggctagagtgacaatagggagagtggttccattagttagtttccaggggcagtggtaggggaggtaaccattgtgagagagagctgccaccagccatcatcctcatgaggaagtgaataaaagatgagcagacatgtttcctctggtgatttgccagcctctgccacagagaacctgagacccctcgggccttccccagggctgggggtgtgccaaggttgggcttttgtccattcaccaccagatcctgggcagctgtcagctctcaggataagaacgtttctgcacctgggcatgctggcccaaagcccagcaggcagggcattctgactgtttggagacacctggtttgttagagaaaacagtccttaatggtccagaacacagctgcttccactcagatccagttagaatagtttcacttggtagctagtttgcttctattaagacaccattcatgcgtcagacaagtactgcctctttttaaaatattaggtttgagtccatctaaaggcaaagtcattatgtgttttgagaggatggttttattaaatataaatgtaaatgacaagaga

SEQ ID NO: 23196 - DNA, 784 bp, Homo sapiens
gcccgagccgccgctttggtcacagtgaccgccaccgttgcccggggatgggtccctgagacttggcgaagtaggagccctgtgtgatcgtgcgtcagagtcggggctgagaccagccctggccaggcagttaccaggacggtctccggaggccgggattcgcggagggtccaccagcaggaagaaaccccaggaggaagaaacctcagacagatcgccggggaggcagcgcgggatcccagcctcaggcgtgcgcggacggtgtgcggagtctagctttgtaccaggctgcagtgcagtagtgccatctcagctcactgcaacctctgcctcccgggttcaagcgattgtcctgcctcagcctcccgagtagctgggattacagccacatgccaccacacccagctaatgtttgtatttttagtagatacggggtttcatcatgttgcccaggatggtcttaatttcctgacctcgtgatccgcccatctcggcctcccaaaatgctgggattacaggcatgagccaccagaaccggacatgctttgcttaaaagctaaatattttaggcttgtgtgccattaggctctgttacaactacttaattctgcttttgtaattctatagcacccattgataatacataaacaaatgagcatgaatgtgtctcagtaaaaatttgttcacataaacaggcagtccacccatgaagctatagcttgctgaccccttgtttaaacaatcaattgaattcaaacagaaataaaaggatcttatatattta

SEQ ID NO: 23197 - DNA, 886 bp, Homo sapiens
cgagccgcgctttggtcacagtgaccgccaccgttgcccgggtatgggtccctgagacttggcgaagtaggagccctgtgtgatcgtgcgtcagagtcggggctgagaccagccctggccagggcagttaccaggacggtctccggaggccgggattcgcggagggtccaccagcaggaagaaaccccaggaggaagaaacctcagacagatcgccggggaggcagcgcgggatcccagcctcaggcgtgcgcggacggtgtgcggctacccaaggtgcgaaaaagaaaaaaggccaaagggaagaaggtggtgctaacccttgcggtcttgaaaaagcaggagaccatgaaagtggtgaatcttccatttgagaaatttggcactggacaggacattttggcattggacagaacatccagcccaaaagggacctcacttgctttgtcaaatggccccattatactaggttgcagcagcagagagccatcctctataagcagctagaagtgccttctgtgattagtcagttcaccagggccttggaccaccaaacagctgctcaatggggtaagctggctggcaagtacagaccagagacaaagcaagagaagcagcagagactgttggcctgggctgagaaaaaagcaaaggagacatccccactaagagatcacctgtccttttaatgggggttaacgctgtcaccaccttagtggagaaaaagaaggatcagctggtgatgactgcacaggacagagatcccattgagttggttgtcttcctgcctgccctgtgttgtaaactgggggttccttactgcattatctaatggaaggcaagcttgagacatctaggattaaaaacaaacaaacaaacaacaactc

SEQ ID NO: 23198 - DNA, 1393 bp, Homo sapiens
  misc_feature (1393)..(1393): n is a, c, g, or t
gcccgagccgccgctttggtcacagtgaccgccaccgttgcccggggatgggtccctgagacttggcgaagtaggagccctgtgtgatcgtgcgtcagagtcggggctgagaccagccctggccaggcagttaccaggacggtctccggaggccgggattcgcggagggtccaccagcaggaagaaaccccaggaggaagaaacctcagacagatcgccggggaggcagcgcgggatcccagcctcaggcgtgcgcggacggtgtgcggagtctagctttgtaccaggctgcagtgcagtagtgccatctcagctcactgcaacctctgcctcccgggttcaagcgattgtcctgcctcagcctcccgagtagctgggattacagccacatgccaccacacccagctaatgtttgtatttttagtagatacggggtttcatcatgttgcccaggatggtcttaatttcctgacctcgtgatccgcccatctcggcctcccaaaatgctgggattacaggcatgagccaccagaaccggacatgctttgcttaaaagctaaatattttaggcttgtgtgccattaggctctgttacaactacttaattctgcttttgtaattctatagcacccattgataatacataaacaaatgagcatgaatgtgtctcagtaaaaatttgttcacataaacaggcagtccacccatgaagctatagcttgctgaccccttgtttaaacaatcaattgaattcaaacagaaataaaaggatcttatatatttaaccatgttgataccatttccagtgcttttcattcttctatgtagatccaaatttccttttgatattattttacttctgcctgaaacattttctttaacattttttatagtgttgttttactggtgatgatttctttcaggttctaagtgcctgaacaaaatctttatttcacctacatcttgaaagatagtttctctgagtctacaattcccagctgacaatgtttatcttccagtactttaaagatgttgcttcattatcttctaattttctttgtttccaataaaatgtttgctggcaaaaaaaaaaaaaaacaaaaaaaaaaaaaattgttgtgggcgcgccatcgggccgccaaggaaaaaagcgttttcctaagagaccatctcttttgttggggggccgccgggcgcccatgaggtggatagtgcaacaaccgggggcaatcaacggtgcgtcccacaagaagagacccggcgcaagacagacaggcgcgtggggtccccccccaaatataaaaaagccgcgggggagaccaggctcttcgtgagcaaatcccaacgggtgccaggggcccacgggctctatcacgggtccaaggagccaatn

SEQ ID NO: 23199 - DNA, 409 bp, Homo sapiens
ccatgttgataccatttccagtgcttttcattcttctatgtagatccaaatttccttttgatattattttacttctgcctgaaacattttctttaacattttttatagtgttgttttactggtgatgatttctttcaggttctaagtgcctgaacaaaatctttatttcacctacatcttgaaagatagtttctctgagtctacaattcccagctgacaatgtttatcttccagtactttaaagatgttgcttcattatcttctaattttctttgtttccaataaaatgtttgctggcattttttgttcctctgtgcaaactgtgtttttgtcattggccactttgagaatttttctttatcactagttttaagcaattttattttagtgtattttgtgcacaagacaa

SEQ ID NO: 23200 - DNA, 1062 bp, Homo sapiens
cgagccgcgctttggtcacagtgaccgccaccgttgcccgggtatgggtccctgagacttggcgaagtaggagccctgtgtgatcgtgcgtcagagtcggggctgagaccagccctggccagggcagttaccaggacggtctccggaggccgggattcgcggagggtccaccagcaggaagaaaccccaggaggaagaaacctcagacagatcgccggggaggcagcgcgggatcccagcctcaggcgtgcgcggacggtgtgcggaagtgggtttcaccatgttggccaggctggtctcgaactcctgacttcaagtgattggactcccaaagtgctggaattacagacataagccaccatgcctggcctcccctaattcgcttctttaaacctctctacatcatcacaagatgggtgttactatgatcactattttacagctacccaaggtgcgaaaaagaaaaaaggccaaagggaagaaggtggtgctaacccttgcggtcttgaaaaagcaggagaccatgaaagtggtgaatcttccatttgagaaatttggcactggacaggacattttggcattggacagaacatccagcccaaaagggacctcacttgctttgtcaaatggccccattatactaggttgcagcagcagagagccatcctctataagcagctagaagtgccttctgtgattagtcagttcaccagggccttggaccaccaaacagctgctcaatggggtaagctggctggcaagtacagaccagagacaaagcaagagaagcagcagagactgttggcctgggctgagaaaaaagcaaaggagacatccccactaagagatcacctgtccttttaatgggggttaacgctgtcaccaccttagtggagaaaaagaaggatcagctggtgatgactgcacaggacagagatcccattgagttggttgtcttcctgcctgccctgtgttgtaaactgggggttccttactgcattatctaatggaaggcaagcttgagacatctaggattaaaaacaaacaaacaaacaacaactc

SEQ ID NO: 23201 - DNA, 344 bp, Homo sapiens
aaaacccaatacagatcaatgaaatgaaaagttgtgcttttttaagaaagataaaattggcaaacctttagctagactaaggaaaaaaagtgacccaaataaataaaataaaaaatgaaaaaggagacataacaactgagaaatacaaagaataattagagactattgtgaacaactacatgctaacaaattggaaaacctagaagaaatggataagttcctggacacatacaaactaccaagatgaaccatggagaacgagaaaacctcaacaaatgagtaacaagtaatgagattgtcttagtccattttgcattgctgtaaaggaatacataaggctaggt

SEQ ID NO: 23202 - DNA, 617 bp, Homo sapiens
atatgttaaaattatttttaaatatgtaggtctgagtgcattaaaatgataacagattctattctctccaattaaatactaattttcctactcatgtcatcccacgcattcctataaaaatgtcctgagctaccattaaatttcactgacttatatattggccaggaaagctaaatttgtttttggtttctaggtcatattcccttgcacatttgagtgtgtgtagtagtttaaaacatttgtaatttgtaaactgaccaaaattgtagacacaaatgttttcatatacaaaggtgtcaaaaaactgttaaatgttatttttacttattttaaaatgttaagtttaaaagaattatagtttaatcttttcagaagactgacattgtcacaaggctttaagtttctctgggggttggaaagtgtatgtgttaataaaatatgcaaggtcattaggctggcatgatttaaagaaccttggtaagttattccctcccttcatcctcccccttcattccacacataactttctgctctactcatgacatttttcccacccatccatttattttctacaacaaaaagaatgatagtaactgcctctgataaatatctggaaa

SEQ ID NO: 23203 - DNA, 1547 bp, Homo sapiens
atttggacacattgctgatgaaattactgatttaattctaagactatcaaaactaattcgtcaaggtccccaccacctctttgcttaaaggaaaacaaaggcagattttaactgtgagcctcttctctagaatatgctgtagacatttgcccctccgtgaggtgataaagcaataaaaataaatttaattatgtgtggtctaaagaagttctacctctgtccattggcctccagagtcacacaaaattatttcttgattcctacatcagaggttttcaggcagagcctttgtaccaagaattccttttatattttggacaccaaagattatggcatgatatatcctgatgattaacaatttagcagtgggcacatttatttgagtcctgctcttggatttatttcccacctttgggtcttacgtacattttgtatttctgtcctgaggactttttgcctcaggcagtttttaaatcaaaaaaatatatatatatttattaggtttctaatttatagagtttccaatttctcccacaattttaaatgttttcactgccaaagttagcagtagatttgctaggttaatgccatggtcagtaatagtttgtaccttttatgttgtagcctgaaaatgtaactctaaccccgtaggcctgaaacctggtgggaagatgattgaaagtgttttagattcaacagattgactatgtatgacttatctattaaaatgaagaacttccatggtttaatagaatgaatgctgtattcaacaaggtcttccatccttcttataaatcttaagactgtgtttaagctttctttcacttttactctatcccttggaagttaattgggaataaaaagatttatcaatttagtcactataatttaaggccaggcatctgcttggaaatacaataaccacaattaatacttagagaaaattgtttcaacagattaactctgctattttaaaaactatagtagtgttctttgaggatgcatttacttttccccaaatttgatagatagttatttttatatattttttctggccacttggcttctaactgattaacatgaaaaacgcacgtgtgcctgtttcactcaaatcatattttacaactttttaaaagctgctacagttatagtttgtgaaagaggagaaaggtgaattgcaacagagggaaattactgttactgtgtcaaatatgtgactgatgcttttggtcagataatctgctgcctgtcaatatttgtaataacagaattttttgttaagagtactctcatctttattttgctgctcactgattttttacactaagatgttctcatctttgtcgactcactgtttttgcttcatatttgtctgtgtacttgtgctctaaataaaaatctagttttatgtctagtttattccattgtgtgtataatgtttgcctctgatgtagtgtaattttctattgtttttgatgtttgttggtacagcctaaaacttatggaaataagaaaagcaatccaataaagtcagctaatgagtgtca

SEQ ID NO: 23204 - DNA, 1493 bp, Homo sapiens
atttggacacattgctgatgaaattactgatttaattctaagactatcaaaactaattcgtcaaggtccccaccacctctttgcttaaaggaaaacaaaggcagattttaactgtgagcctcttctctagaatatgctgtagacatttgcccctccgtgaggtgataaagcaataaaaataaatttaattatgtgtggtctaaagaagttctacctctgtccattggcctccagagtcacacaaaattatttcttgattcctacatcagaggttttcaggcagagcctttgtaccaagaattccttttatattttggacaccaaagattatggcatgatatatcctgatgattaacaatttagcagtgggcacatttatttgagtcctgctcttggatttatttcccacctttgggtcttacgtacattttgtatttctgtcctgaggactttttgcctcaggcagtttttaaatcaaaaaaatatatatatatttattaggtttctaatttatagagtttccaatttctcccacaattttaaatgttttcactgccaaagttagcagtagatttgctaggttaatgccatggtcagtaatagtttgtaccttttatgttgtagcctgaaaatgtaactctaaccccgtaggcctgaaacctggtgggaagatgattgaaagtgttttagattcaacagattgactatgtatgacttatctatttccatccttcttataaatcttaagactgtgtttaagctttctttcacttttactctatcccttggaagttaattgggaataaaaagatttatcaatttagtcactataatttaaggccaggcatctgcttggaaatacaataaccacaattaatacttagagaaaattgtttcaacagattaactctgctattttaaaaactatagtagtgttctttgaggatgcatttacttttccccaaatttgatagatagttatttttatatattttttctggccacttggcttctaactgattaacatgaaaaacgcacgtgtgcctgtttcactcaaatcatattttacaactttttaaaagctgctacagttatagtttgtgaaagaggagaaaggtgaattgcaacagagggaaattactgttactgtgtcaaatatgtgactgatgcttttggtcagataatctgctgcctgtcaatatttgtaataacagaattttttgttaagagtactctcatctttattttgctgctcactgattttttacactaagatgttctcatctttgtcgactcactgtttttgcttcatatttgtctgtgtacttgtgctctaaataaaaatctagttttatgtctagtttattccattgtgtgtataatgtttgcctctgatgtagtgtaattttctattgtttttgatgtttgttggtacagcctaaaacttatggaaataagaaaagcaatccaataaagtcagctaatgagtgtca

SEQ ID NO: 23205 - DNA, 399 bp, Homo sapiens
gttatattttctttccctggagttgtccggtcaaatttagttctattttgtatttatatgtagaggcaaggctccatttaaaaaaaaaaaaaaaaaagaactacctttaaacaaaggtcatagagattctctgaacatttccatttctttatacaaaggagtccagggccacctttaattatcataaagcccatcctttatgttgagttactggctgcctagttacctgcatttcactccgagccatcgacttctgttctgaatgttaaaatgcaggtggctgtgagggagtcttctgagtcatgccagcgtttaaggcgcttgctcttctttgtgcacattcctgcttttctcaaagcctattgaaagcaagggccatgtttgctgttttctttgaca

SEQ ID NO: 23206 - DNA, 457 bp, Homo sapiens
agtgaagaaggcagtatacagccaggaagaggagtgagagagggcctgttcctatgctgttttaattatgaccttttccttgatttccttgattaggatattttgaacatgttcaagtatagacaggacaaaattcaagacataggaaagaaaacaggtaatgaataggtaaatttcctgaaaggcaggaggagatgggaaccagaaaagcagagttggctcctatgtgtcaagaaaagaagaacagaggatggatgtgtgtttgggtgggttcatatgtttcagttatcagaggtgaaggagcttggccacaaagttgagcacagactgagtatcccctatctccttatctgaaatgcttggaaccagtagtgtttcgggtttctgattttttttttttttgattttggaatatttgcattatacttactggtctaccatctctaatctgaaaatc

SEQ ID NO: 23207 - DNA, 278 bp, Homo sapiens
acattgataatagtttttttaattcatcatctctaaaactctaaaactttagtgagaaagataataaatagaaaattaccctggaaattaaaatttttagcaatattgaatacagtagtataattttttgtggctcttgatttcctaagaaaaatagtgatttttatttaatgaaaatttctcaatttggttaatattctaagaaaagattgatatatttaagcatggtgattagaaaaatatgcatatttcctgctcataataaattttaaaacaac

SEQ ID NO: 23208 - DNA, 440 bp, Homo sapiens
agcctccctagtagctgtgattacaggcgcccgccaccatgcctggctaatttttgtatttttagtagagatgggtttcaccatgttggccagggtggtcttgaactcctgaccttaggtgagcccgcctcggcctcccaaaatgctgggattacaggtgtgagccaccgtgcctggccctgtcttgtaatttagaagagcaagtttaaatacttgggatgatgtattaaaaagcctcatccatgctgacaagagcagggcctgtagtagcctttgttgtttatccccttcatcctgttctgtacttcattttctctcattactgaattagctggcagcattccttatttgccacagagctatttcttaaaagctgtacttacactcaggatacagttttccttggtatagaactcttccatggcattgctctttcactg

SEQ ID NO: 23209 - DNA, 337 bp, Homo sapiens
gacccccttcattcggtttaacgaatggaaatactcaagattcaggtcactatgggcccttttccctactcaaaaagagaccctccctattaataaccattagaatgctccacatttttaagtttgcaacatcatggcctcattgcaaattgggtatttagggaaaactacatttccttccaaggaaaatgttttaaaaatgcacaatttctctatcacgcattttttaaataagaagaagagaaaatctaactgttttgcaactaggctcaggcaactgcccaggcagcctatagaactgatatcaacagttttatgcctgtcagaaaatcattct

SEQ ID NO: 23210 - DNA, 386 bp, Homo sapiens
ctgtcgtggagactgagacttctttgggtcttatcttgtctttatatccccttaacagcaggtcctcttatttcttgctcgttcaagggaatagccacagaggccaattagagcatggttttgctgaatgttttggccacagcacaatctatgcaataataaaaaaaaaaggcctactttttttttttcttttgagacagagtctcgctctgccatttaggctggagtgcagtggcacaatctcggctcactgcaacttccgcctccttggttcaggcgattctcctgacccagctactcaggaggctgaaacaggagaaccgcttgaacctgcgaggcagggggcaggggtttcagtgagccgagagtgtgccactgtactagcc

SEQ ID NO: 23211 - DNA, 212 bp, Homo sapiens
tctcaaaagaacaaacaaacaaaagaaatcaatcattttgaaagatagtcaccaaaacttttaaaatttaattgaatctaacaaccaactaaattcaatgtatacagttgtctaaatatttaaaattggaaaatggacatatgtgcaatttcttattaattcattaagtagtaagttctaatggtagtaaagtaaaaaggagctctaacagt

SEQ ID NO: 23212 - DNA, 308 bp, Homo sapiens
ggaaattgtctacctgacttcctgtaccccaaacatcaattctctactgtaatattatggtagtttccatagaataatcatagctaaccaagaggtccaaggccctcataacacatttaatgcactgaaaccacacaacagcaggaaacaacagactactgccttgggccaggtgctgttcaaagcacttaacatatattaattaactaattaatcctcacaaccttatgagtaaatacaattattgttgctattttaccagtaagaaaactgagacacagctagtggagtgagccagagagtctagc

SEQ ID NO: 23213 - DNA, 395 bp, Homo sapiens
cttttttttgctaggttatttgttgtaggttaaatgtacctctcaagtttagctccagtttttgtgttccatgtaaaaatgtataatgaggcctagaaacagtaatacagattttgtgtttaaaactgatttcttatgctgaaaaccgtagaggaattacaaccatcatgtagattacttaggaaatagatcttccttttagaatgtaatttgttactctgaagcttgaaaaaaaagaaaaaggaaagttctggtagtgtgtcatttctgaatattcccttggaattgactatattttgagttttaaatttttctcttcttagtataataaaaacagcatgtaaaagtatttttgatcctgataacatttcctggtttcatttccgttagtactt

SEQ ID NO: 23214 - DNA, 441 bp, Homo sapiens
cctgccccatccctatgtgtattagggactatctgcttccttctcctgcttccttttcatcctcccaggggctcacgtacccaccatcccaaccctgttagcaactcaatcctcaggaaacttgagctgatataggagctggccacagcacgggtgtcaggtgttggggagcacagtgtcattgcctacttcagggaatggagggaaagaacagggaccagaggagaaaagttgaagaatatgagaggctggccttatcccaatgactcctctcctttagatcattccttccatggccctggcctgggacagacctaagttcctggccagctttgcctctgactagctttgtggatggacagtcatttgccctgtctggatctcactttcctcacctgtaacacacgaggagaggggataatgccatctgcccaattaacc

SEQ ID NO: 23215 - DNA, 318 bp, Homo sapiens
gcagtttgttgaaagcaggttcctgtgctgggtcctgggatgctgactcactgggttctatgtgggatggacttcagggttctgcaaagcttccctgaggaaatatggtgcacacctgaaactggaactgacttctctttcaagaaacttgatagagataaagagggaaggcatggagtggaatctggagaaatgcaagcatccccctcagtggccaaatcaatgggagagagggaagggatggagctgtagtgaggctccagaggaagtttctgggaagggtgttgggtcaaggtggagaggttgtccttgaacagg

SEQ ID NO: 23216 - DNA, 413 bp, Homo sapiens
gtctgtgaattacttagggactcttttgatgtcttcgttttggaaactctctgttgttggtttttgttattttagccttgtcgggttttcctcatactggtctaactgctagtatcttttattggcccctctttcttggatatcctttacatgtttatatttgttagtgtttcttccttgacttgtctcacttctcgtgtttccttgggtttgcctccattactaagtcttcatccagcccctatgtcattggttctcaaagtgtggtccccagaccagcagcagcagcatcacctgggaacttgctggaaatgcctgaactaaacttaagacactatataaaacaggaaaaggcattttacattttgatacacattgtcaaaaacattgtactggtttcatggtatgcatta

SEQ ID NO: 23217 - DNA, 569 bp, Homo sapiens
ggaaggagacctgggagaatccaaccttcgattagatcaggaagaggagaagaatccagtaaaaaactctgagaagtctctgggaaggaagtcttccttccttcccctgtaccaggagaggtgctatcccagaaattagtaaagaaacagtttttgatggggagaacaggatcacctttgtcaactgctgctgcgagacttggaaaaataaggactgggaagagagcaatagaaactttgaaagccattggttatcttgataagagttgtttctgtgggggtggtgagaactggagcctgactggatgggttcaagagagaatggggagttctagccaagaaggctgatgaggatgagtcaaattaaaaatgttttctttttatgagtcctctcatatttactgatacaactgatatattgggtctccattctgccacattactttatattgatcatgtattgtatctgctatgcaattgtattgcatgtatctgcatggcaattgtattgccatgcaatgtatttttttttactttaaaaattatatttataaaggtttgtaatttta

SEQ ID NO: 23218 - DNA, 2181 bp, Homo sapiens
cacatgacccgaggccccggtccaatatggcgacctccacgggtcgctggcttctcctccggcttgcactattcggcttcctctgggaagcgtccggcggcctcgactcgggggcctcccgcgacgacgacttgctactgccctatccacgcgcgcgcgcgcgcctcccccgggactgcacacgggtgcgcgccggcaaccgcgagcacgagagttggcctccgcctcccgcgactcccggcgccggcggtctggccgtgcgcaccttcgtgtcgcacttcagggaccgcgcggtggccggccacctgacgcgggccgttgagcccctgcgcaccttctcggtgctggagcccggtgggcccggcggctgcgcggcgagacgacgcgccaccgtggaggagacggcgcgggcggccgactgccgtgtcgcccagaacggcggcttcttccgcatgaactcgggcgagtgcctggggaacgtggtgagcgacgagcggcgggtgagcagctccggggggctgcagaacgcgcagttcgggatccgccgcgacgggaccctggtcaccgggtacctgtctgaggaggaggtgctggacactgagaacccatttgtgcagctgctgagtggggtcgtgtggctgattcgtaatggaagcatctacatcaacgagagccaagccacagagtgtgacgagacacaggagacaggttcctttagcaaatttgtgaatgtgatatcagccaggacggccattggccacgaccggaaagggcagctggtgctctttcatgcagacggccaaacggagcagcgtggcatcaacctgtgggaaatggcggagttcctgctgaaacaggacgtggtcaacgccatcaacctggatgggggtggctctgccacctttgtgctcaacgggaccttggccagttacccgtcagatcactgccaggacaacatgtggcgctgtccccgccaagtgtccaccgtggtgtgtgtgcacgaaccccgctgccagccgcctgactgccacggccacgggacctgcgtggacgggcactgccaatgcaccgggcacttctggcggggtcccggctgtgatgagctggactgtggcccctctaactgcagccagcacggactgtgcacggagaccggctgccgctgtgatgccggatggaccgggtccaactgcagtgaagagtgtccccttggctggcatgggccgggctgccagaggccttgtaagtgtgagcaccattgtccctgtgaccccaagactggcaactgcagcgtctccagagtaaagcagtgtctccagccacctgaagccaccctgagggcgggagaactctcctttttcaccaggaccgcctggctagccctcaccctggcgctggccttcctcctgctgatcagcactgcagcaaacctgtccttgctcctgtccagagcagagaggaaccggcgcctgcatggggactatgcataccacccgctgcaggagatgaacggggagcctctggccgcagagaaggagcagccagggggcgcccacaaccccttcaaggactgaagcctcaagctgcccggggtggcacgtcgcgaaagcttgtttccccacggtctggcttctgcaggggaaatttcaaggccactggcgtggaccatctgggtgtcctcagcccctgtggggcagccaagttcctgatagcacttgtgcctcagcccctcacctggccacctgccagggcacctgcaaccctagcaataccatgctcgctggagaggctcagctgcctgcttctcgcctgcctgtgtctgctgccgagaagcccgtgcccccgggagggctgccgcactgccaaagagtctccctcctcctggggaaggggctgccaacgaaccagactcagtgaccacgtcatgacagaacagcacatcctggccagcacccctggctggagtgggttaaagggacgagtctgccttcctggctgtgacacgggaccccttttctacagacctcatcactggatttgccaactagaattcgatttcctgtcataggaagctccttggaagaagggatggggggatgaaatcatgtttacagacctgttttgtcatcctgctgccaagaagttttttaatcacttgaataaattgatataataaaagga

SEQ ID NO: 23219 - DNA, 2283 bp, Homo sapiens
cacatgacccgaggccccggtccaatatggcgacctccacgggtcgctggcttctcctccggcttgcactattcggcttcctctgggaagcgtccggcggcctcgactcgggggcctcccgcgacgacgacttgctactgccctatccacgcgcgcgcgcgcgcctcccccgggactgcacacgggtgcgcgccggcaaccgcgagcacgagagttggcctccgcctcccgcgactcccggcgccggcggtctggccgtgcgcaccttcgtgtcgcacttcagggaccgcgcggtggccggccacctgacgcgggccgttgagcccctgcgcaccttctcggtgctggagcccggtgggcccggcggctgcgcggcgagacgacgcgccaccgtggaggagacggcgcgggcggccgactgccgtgtcgcccagaacggcggcttcttccgcatgaactcgggcgagtgcctggggaacgtggtgagcgacgagcggcgggtgagcagctccggggggctgcagaacgcgcagttcgggatccgccgcgacgggaccctggtcaccgggtacctgtctgaggaggaggtgctggacactgagaacccatttgtgcagctgctgagtggggtcgtgtggctgattcgtaatggaagcatctacatcaacgagagccaagccacagagtgtgacgagacacaggagacaggttcctttagcaaatttgtgaatgtgatatcagccaggacggccattggccacgaccggaaagggcagctggtgctctttcatgcagacggccaaacggagcagcgtggcatcaacctgtgggaaatggcggagttcctgctgaaacaggacgtggtcaacgccatcaacctggatgggggtggctctgccacctttgtgctcaacgggaccttggccagttacccgtcagatcactggcaggcgtgatggtgcacaccttacggttacagctgctcaggaggctcgggtggaaggatcgcaatacctcatctcaaaaatagatagacgccatcttgtagccaggacaacatgtggcgctgtccccgccaagtgtccaccgtggtgtgtgtgcacgaaccccgctgccagccgcctgactgccacggccacgggacctgcgtggacgggcactgccaatgcaccgggcacttctggcggggtcccggctgtgatgagctggactgtggcccctctaactgcagccagcacggactgtgcacggagaccggctgccgctgtgatgccggatggaccgggtccaactgcagtgaagagtgtccccttggctggcatgggccgggctgccagaggccttgtaagtgtgagcaccattgtccctgtgaccccaagactggcaactgcagcgtctccagagtaaagcagtgtctccagccacctgaagccaccctgagggcgggagaactctcctttttcaccaggaccgcctggctagccctcaccctggcgctggccttcctcctgctgatcagcactgcagcaaacctgtccttgctcctgtccagagcagagaggaaccggcgcctgcatggggactatgcataccacccgctgcaggagatgaacggggagcctctggccgcagagaaggagcagccagggggcgcccacaaccccttcaaggactgaagcctcaagctgcccggggtggcacgtcgcgaaagcttgtttccccacggtctggcttctgcaggggaaatttcaaggccactggcgtggaccatctgggtgtcctcagcccctgtggggcagccaagttcctgatagcacttgtgcctcagcccctcacctggccacctgccagggcacctgcaaccctagcaataccatgctcgctggagaggctcagctgcctgcttctcgcctgcctgtgtctgctgccgagaagcccgtgcccccgggagggctgccgcactgccaaagagtctccctcctcctggggaaggggctgccaacgaaccagactcagtgaccacgtcatgacagaacagcacatcctggccagcacccctggctggagtgggttaaagggacgagtctgccttcctggctgtgacacgggaccccttttctacagacctcatcactggatttgccaactagaattcgatttcctgtcataggaagctccttggaagaagggatggggggatgaaatcatgtttacagacctgttttgtcatcctgctgccaagaagttttttaatcacttgaataaattgatataataaaagga

SEQ ID NO: 23220 - DNA, 272 bp, Homo sapiens
cacctttagcccggctctgtacacatgggcaggggcaggtatcctgtcctgtcgagaaaggctctgacactggaggccccaacctttctcctccctcctccctttttctacagacctcatcactggatttgccaactagaattcgatttcctgtcataggaagctccttggaagaagggatggggggatgaaatcatgtttacagacctgttttgtcatcctgctgccaagaagttttttaatcacttgaataaattgatataataaaagga

SEQ ID NO: 23221 - DNA, 2079 bp, Homo sapiens
cacatgacccgaggccccggtccaatatggcgacctccacgggtcgctggcttctcctccggcttgcactattcggcttcctctgggaagcgtccggcggcctcgactcgggggcctcccgcgacgacgacttgctactgccctatccacgcgcgcgcgcgcgcctcccccgggactgcacacgggtgcgcgccggcaaccgcgagcacgagagttggcctccgcctcccgcgactcccggcgccggcggtctggccgtgcgcaccttcgtgtcgcacttcagggaccgcgcggtggccggccacctgacgcgggccgttgagcccctgcgcaccttctcggtgctggagcccggtgggcccggcggctgcgcggcgagacgacgcgccaccgtggaggagacggcgcgggcggccgactgccgtgtcgcccagaacggcggcttcttccgcatgaactcgggcgagtgcctggggaacgtggtgagcgacgagcggcgggtgagcagctccggggggctgcagaacgcgcagttcgggatccgccgcgacgggaccctggtcaccgggtacctgtctgaggaggaggtgctggacactgagaacccatttgtgcagctgctgagtggggtcgtgtggctgattcgtaatggaagcatctacatcaacgagagccaagccacagagtgtgacgagacacaggagacaggttcctttagcaaatttgtgaatgtgatatcagccaggacggccattggccacgaccggaaagggcagctggtgctctttcatgcagacggccaaacggagcagcgtggcatcaacctgtgggaaatggcggagttcctgctgaaacaggacgtggtcaacgccatcaacctggatgggggtggctctgccacctttgtgctcaacgggaccttggccagttacccgtcagatcactgccaggacaacatgtggcgctgtccccgccaagtgtccaccgtggtgtgtgtgcacgaaccccgctgccagccgcctgactgccacggccacgggacctgcgtggacgggcactgccaatgcaccgggcacttctggcggggtcccggctgtgatgagctggactgtggcccctctaactgcagccagcacggactgtgcacggagaccggctgccgctgtgatgccggatggaccgggtccaactgcagtgaagtaaagcagtgtctccagccacctgaagccaccctgagggcgggagaactctcctttttcaccaggaccgcctggctagccctcaccctggcgctggccttcctcctgctgatcagcactgcagcaaacctgtccttgctcctgtccagagcagagaggaaccggcgcctgcatggggactatgcataccacccgctgcaggagatgaacggggagcctctggccgcagagaaggagcagccagggggcgcccacaaccccttcaaggactgaagcctcaagctgcccggggtggcacgtcgcgaaagcttgtttccccacggtctggcttctgcaggggaaatttcaaggccactggcgtggaccatctgggtgtcctcagcccctgtggggcagccaagttcctgatagcacttgtgcctcagcccctcacctggccacctgccagggcacctgcaaccctagcaataccatgctcgctggagaggctcagctgcctgcttctcgcctgcctgtgtctgctgccgagaagcccgtgcccccgggagggctgccgcactgccaaagagtctccctcctcctggggaaggggctgccaacgaaccagactcagtgaccacgtcatgacagaacagcacatcctggccagcacccctggctggagtgggttaaagggacgagtctgccttcctggctgtgacacgggaccccttttctacagacctcatcactggatttgccaactagaattcgatttcctgtcataggaagctccttggaagaagggatggggggatgaaatcatgtttacagacctgttttgtcatcctgctgccaagaagttttttaatcacttgaataaattgatataataaaagga

SEQ ID NO: 23222 - DNA, 2638 bp, Homo sapiens
  misc_feature (2267)..(2267): n is a, c, g, or t
  misc_feature (2336)..(2338): n is a, c, g, or t
  misc_feature (2352)..(2352): n is a, c, g, or t
  misc_feature (2356)..(2356): n is a, c, g, or t
  misc_feature (2359)..(2360): n is a, c, g, or t
  misc_feature (2375)..(2375): n is a, c, g, or t
  misc_feature (2378)..(2378): n is a, c, g, or t
  misc_feature (2389)..(2389): n is a, c, g, or t
  misc_feature (2391)..(2391): n is a, c, g, or t
  misc_feature (2397)..(2397): n is a, c, g, or t
  misc_feature (2400)..(2400): n is a, c, g, or t
  misc_feature (2413)..(2413): n is a, c, g, or t
  misc_feature (2415)..(2415): n is a, c, g, or t
  misc_feature (2425)..(2425): n is a, c, g, or t
  misc_feature (2448)..(2450): n is a, c, g, or t
  misc_feature (2456)..(2456): n is a, c, g, or t
  misc_feature (2458)..(2458): n is a, c, g, or t
  misc_feature (2460)..(2460): n is a, c, g, or t
  misc_feature (2467)..(2467): n is a, c, g, or t
  misc_feature (2480)..(2481): n is a, c, g, or t
  misc_feature (2486)..(2486): n is a, c, g, or t
  misc_feature (2496)..(2496): n is a, c, g, or t
  misc_feature (2499)..(2499): n is a, c, g, or t
  misc_feature (2502)..(2502): n is a, c, g, or t
  misc_feature (2508)..(2508): n is a, c, g, or t
  misc_feature (2515)..(2516): n is a, c, g, or t
  misc_feature (2526)..(2526): n is a, c, g, or t
  misc_feature (2529)..(2529): n is a, c, g, or t
  misc_feature (2533)..(2533): n is a, c, g, or t
  misc_feature (2539)..(2540): n is a, c, g, or t
  misc_feature (2543)..(2543): n is a, c, g, or t
  misc_feature (2551)..(2551): n is a, c, g, or t
  misc_feature (2558)..(2558): n is a, c, g, or t
  misc_feature (2561)..(2562): n is a, c, g, or t
  misc_feature (2579)..(2579): n is a, c, g, or t
  misc_feature (2593)..(2594): n is a, c, g, or t
  misc_feature (2602)..(2602): n is a, c, g, or t
  misc_feature (2621)..(2621): n is a, c, g, or t
cacatgacccgaggccccggtccaatatggcgacctccacgggtcgctggcttctcctccggcttgcactattcggcttcctctgggaagcgtccggcggcctcgactcgggggcctcccgcgacgacgacttgctactgccctatccacgcgcgcgcgcgcgcctcccccgggactgcacacgggtgcgcgccggcaaccgcgagcacgagagttggcctccgcctcccgcgactcccggcgccggcggtctggccgtgcgcaccttcgtgtcgcacttcagggaccgcgcggtggccggccacctgacgcgggccgttgagcccctgcgcaccttctcggtgctggagcccggtgggcccggcggctgcgcggcgagacgacgcgccaccgtggaggagacggcgcgggcggccgactgccgtgtcgcccagaacggcggcttcttccgcatgaactcgggcgagtgcctggggaacgtggtgagcgacgagcggcgggtgagcagctccggggggctgcagaacgcgcagttcgggatccgccgcgacgggaccctggtcaccgggtacctgtctgaggaggaggtgctggacactgagaacccatttgtgcagctgctgagtggggtcgtgtggctgattcgtaatggaagcatctacatcaacgagagccaagccacagagtgtgacgagacacaggagacaggttcctttagcaaatttgtgaatgtgatatcagccaggacggccattggccacgaccggaaagggcagctggtgctctttcatgcagacggccaaacggagcagcgtggcatcaacctgtgggaaatggcggagttcctgctgaaacaggacgtggtcaacgccatcaacctggatgggggtggctctgccacctttgtgctcaacgggaccttggccagttacccgtcagatcactgccaggacaacatgtggcgctgtccccgccaagtgtccaccgtggtgtgtgtgcacgaaccccgctgccagccgcctgactgccacggccacgggacctgcgtggacgggcactgccaatgcaccgggcacttctggcggggtcccggctgtgatgagctggactgtggcccctctaactgcagccagcacggactgtgcacggagaccggctgccgctgtgatgccggatggaccgggtccaactgcagtgaagagtgtccccttggctggcatgggccgggctgccagaggccttgtaagtgtgagcaccattgtccctgtgaccccaagactggcaactgcagcgtctccagagtaaagcagtgtctccagccacctgaagccaccctgagggcgggagaactctcctttttcaccaggaccgcctggctagccctcaccctggcgctggccttcctcctgctgatcagcactgcagcaaacctgtccttgctcctgtccagagcagagaggaaccggcgcctgcatggggactatgcataccacccgctgcaggagatgaacggggagcctctggccgcagagaaggagcagccagggggcgcccacaaccccttcaaggactgaagcctcaagctgcccggggtggcacgtcgcgaaagcttgtttccccacggtctggcttctgcaggggaaatttcaaggccactggcgtggaccatctgggtgtcctcagcccctgtggggcagccaagttcctgatagcacttgtgcctcagcccctcacctggccacctgccagggcacctgcaaccctagcaataccatgctcgctggagaggctcagctgcctgcttctcgcctgcctgtgtctgctgccgagaagcccgtgcccccgggagggctgccgcactgccaaagagtctccctcctcctggggaaggggctgccaacgaaccagactcagtgaccacgtcatgacagaacagcacatcctggccagcacccctggctggagtgggttaaagggacgagtctgccttcctggctgtgacacgggaccccttttctacagacctcatcactggatttgccaactagaattcgatttcctgtcataggaagctccttggaagaagggatggggggatgaaatcatgtttacagacctgttttgtcatcctgctgccaagaagttttttaatcacttgaataaattgatataataaaaggaaaaaaaaaaaaaaaaaaaaaaaaaaaaaaaaaaaaaaaaaaaaaaaaaaaaaaaaaaaaaaaaaaaaaaaaaaaaaaaaaaaaaanaaaaaaaaaaaaaaaaaaaaaatttggggcccctttgccccaatggttttttaatttgggaaagttttnnnttggggccaaattngggntcnnttggccaattccccnttngggggggggtntnaaaatnccngggccggggtttnanaagggggggnggggaaaaccccgggggttcccnnnttaaancncnttggganaaatccccttttnnggggnggggaaaaanganaanggcccnccccgtnnccctttccanaanttgncaaccnntangggaaaangaaattnaannctttaatttttttaaantcgcgtaaattttnnaaacaacncatttttaaccaaagggcnaaatgggaaatcccttt

SEQ ID NO: 23223 - DNA, 1970 bp, Homo sapiens
cacatgacccgaggccccggtccaatatggcgacctccacgggtcgctggcttctcctccggcttgcactattcggcttcctctgggaagcgtccggcggcctcgactcgggggcctcccgcgacgacgacttgctactgccctatccacgcgcgcgcgcgcgcctcccccgggactgcacacgggtgcgcgccggcaaccgcgagcacgagagttggcctccgcctcccgcgactcccggcgccggcggtctggccgtgcgcaccttcgtgtcgcacttcagggaccgcgcggtggccggccacctgacgcgggccgttgagcccctgcgcaccttctcggtgctggagcccggtgggcccggcggctgcgcggcgagacgacgcgccaccgtggaggagacggcgcgggcggccgactgccgtgtcgcccagaacggcggcttcttccgcatgaactcgggcgagtgcctggggaacgtggtgagcgacgagcggcgggtgagcagctccggggggctgcagaacgcgcagttcgggatccgccgcgacgggaccctggtcaccgggtacctgtctgaggaggaggtgctggacactgagaacccatttgtgcagctgctgagtggggtcgtgtggctgattcgtaatggaagcatctacatcaacgagagccaagccacagagtgtgacgagacacaggagacagcatcaacctgtgggaaatggcggagttcctgctgaaacaggacgtggtcaacgccatcaacctggatgggggtggctctgccacctttgtgctcaacgggaccttggccagttacccgtcagatcactgccaggacaacatgtggcgctgtccccgccaagtgtccaccgtggtgtgtgtgcacgaaccccgctgccagccgcctgactgccacggccacgggacctgcgtggacgggcactgccaatgcaccgggcacttctggcggggtcccggctgtgatgagctggactgtggcccctctaactgcagccagcacggactgtgcacggagaccggctgccgctgtgatgccggatggaccgggtccaactgcagtgaagtaaagcagtgtctccagccacctgaagccaccctgagggcgggagaactctcctttttcaccaggaccgcctggctagccctcaccctggcgctggccttcctcctgctgatcagcactgcagcaaacctgtccttgctcctgtccagagcagagaggaaccggcgcctgcatggggactatgcataccacccgctgcaggagatgaacggggagcctctggccgcagagaaggagcagccagggggcgcccacaaccccttcaaggactgaagcctcaagctgcccggggtggcacgtcgcgaaagcttgtttccccacggtctggcttctgcaggggaaatttcaaggccactggcgtggaccatctgggtgtcctcagcccctgtggggcagccaagttcctgatagcacttgtgcctcagcccctcacctggccacctgccagggcacctgcaaccctagcaataccatgctcgctggagaggctcagctgcctgcttctcgcctgcctgtgtctgctgccgagaagcccgtgcccccgggagggctgccgcactgccaaagagtctccctcctcctggggaaggggctgccaacgaaccagactcagtgaccacgtcatgacagaacagcacatcctggccagcacccctggctggagtgggttaaagggacgagtctgccttcctggctgtgacacgggaccccttttctacagacctcatcactggatttgccaactagaattcgatttcctgtcataggaagctccttggaagaagggatggggggatgaaatcatgtttacagacctgttttgtcatcctgctgccaagaagttttttaatcacttgaataaattgatataataaaagga

SEQ ID NO: 23224 - DNA, 893 bp, Homo sapiens
cacatgacccgaggccccggtccaatatggcgacctccacgggtcgctggcttctcctccggcttgcactattcggcttcctctgggaagcgtccggcggcctcgactcgggggcctcccgcgacgacgacttgctactgccctatccacgcgcgcgcgcgcgcctcccccgggactgcacacgggtgcgcgccggcaaccgcgagcacgagagttggcctccgcctcccgcgactcccggcgccggcggtctggccgtgcgcaccttcgtgtcgcacttcagggaccgcgcggtggccggccacctgacgcgggccgttgagcccctgcgcaccttctcggtgctggagcccggtgggcccggcggctgcgcggcgagacgacgcgccaccgtggaggagacggcgcgggcggccgactgccgtgtcgcccagaacggcggcttcttccgcatgaactcgggcgagtgcctggggaacgtggtgagcgacgagcggcgggtgagcagctccggggggctgcagaacgcgcagttcgggatccgccgcgacgggaccctggtcaccgggtacctgtctgaggaggaggtgctggacactgagaacccatttgtgcagctgctgagtggggtcgtgtggctgattcgtaatggaagcatctacatcaacgagagccaagccacagagtggacgagtctgccttcctggctgtgacacgggaccccttttctacagacctcatcactggatttgccaactagaattcgatttcctgtcataggaagctccttggaagaagggatggggggatgaaatcatgtttacagacctgttttgtcatcctgctgccaagaagttttttaatcacttgaataaattgatataataaaagga

SEQ ID NO: 23225 - DNA, 2214 bp, Homo sapiens
cacatgacccgaggccccggtccaatatggcgacctccacgggtcgctggcttctcctccggcttgcactattcggcttcctctgggaagcgtccggcggcctcgactcgggggcctcccgcgacgacgacttgctactgccctatccacgcgcgcgcgcgcgcctcccccgggactgcacacgggtgcgcgccggcaaccgcgagcacgagagttggcctccgcctcccgcgactcccggcgccggcggtctggccgtgcgcaccttcgtgtcgcacttcagggaccgcgcggtggccggccacctgacgcgggccgttgagcccctgcgcaccttctcggtgctggagcccggtgggcccggcggctgcgcggcgagacgacgcgccaccgtggaggagacggcgcgggcggccgactgccgtgtcgcccagaacggcggcttcttccgcatgaactcgggcgagtgcctggggaacgtggtgagcgacgagcggcgggtgagcagctccggggggctgcagaacgcgcagttcgggatccgccgcgacgggaccctggtcaccgggtacctgtctgaggaggaggtgctggacactgagaacccatttgtgcagctgctgagtggggtcgtgtggctgattcgtaatggaagcatctacatcaacgagagccaagccacagagtgtgacgagacacaggagacaggttcctttagcaaatttgtgaatgtgatatcagccaggacggccattggccacgaccggaaagggcagctggtgctctttcatgcagacggccaaacggagcagcgtggcatcaacctgtgggaaatggcggagttcctgctgaaacaggacgtggtcaacgccatcaacctggatgggggtggctctgccacctttgtgctcaacgggaccttggccagttacccgtcagatcactgccaggacaacatgtggcgctgtccccgccaagtgtccaccgtggtgtgtgtgcacgaaccccgctgccagccgcctgactgccacggccacgggacctgcgtggacgggcactgccaatgcaccgggcacttctggcggggtcccggctgtgatgagctggactgtggcccctctaactgcagccagcacggactgtgcacggagaccggctgccgctgtgatgccggatggaccgggtccaactgcagtgaagagtgtccccttggctggcatgggccgggctgccagaggccttgtaagtgtgagcaccattgtccctgtgaccccaagactggcaactgcagcgtctccagagtaaagcagtgtctccagccacctgaagccaccctgagggcgggagaactctcctttttcaccaggaccgcctggctagccctcaccctggcgctggccttcctcctgctgatcagcactgcagcaaacctgtccttgctcctgtccagagcagagaggaaccggcgcctgcatggggactatgcataccacccgctgcaggagatgaacggggagcctctggccgcagagaaggagcagccagggggcgcccacaaccccttcaaggactgaagcctcaagctgcccggggtggcacgtcgcgaaagcttgtttccccacggtctggcttctgcaggggaaatttcaaggccactggcgtggaccatctgggtgtcctcagcccctgtggggcagccaagttcctgatagcacttgtgcctcagcccctcacctggccacctgccagggcacctgcaaccctagcaataccatgctcgctggagaggctcagctgcctgcttctcgcctgcctgtgtctgctgccgagaagcccgtgcccccgggagggctgccgcactgccaaagagtctccctcctcctggggaaggggctgccaacgaaccagactcagtgaccacgtcatgacagaacagcacatcctggccagcacccctggctggagtgggttaaagggacgagtctgccttcctggctgtgacacgggaccccttttctacagacctcatcactggatttgccaactagaattcgatttcctgtcataggaagctccttggaagaagggatggggggatgaaatcatgtttacagacctgttttgtcatcctgctgccaagaagttttttaatcacttgaataaattgatataataaaaggagccaccaggtggtgtgtggattctgaaaaaaaa

SEQ ID NO: 23226 - DNA, 2160 bp, Homo sapiens
cacatgacccgaggccccggtccaatatggcgacctccacgggtcgctggcttctcctccggcttgcactattcggcttcctctgggaagcgtccggcggcctcgactcgggggcctcccgcgacgacgacttgctactgccctatccacgcgcgcgcgcgcgcctcccccgggactgcacacgggtgcgcgccggcaaccgcgagcacgagagttggcctccgcctcccgcgactcccggcgccggcggtctggccgtgcgcaccttcgtgtcgcacttcagggaccgcgcggtggccggccacctgacgcgggccgttgagcccctgcgcaccttctcggtgctggagcccggtgggcccggcggctgcgcggcgagacgacgcgccaccgtggaggagacggcgcgggcggccgactgccgtgtcgcccagaacggcggcttcttccgcatgaactcgggcgagtgcctggggaacgtggtgagcgacgagcggcgggtgagcagctccggggggctgcagaacgcgcagttcgggatccgccgcgacgggaccctggtcaccgggtacctgtctgaggaggaggtgctggacactgagaacccatttgtgcagctgctgagtggggtcgtgtggctgattcgtaatggaagcatctacatcaacgagagccaagccacagagtgtgacgagacacaggagacaggttcctttagcaaatttgtgaatgtgatatcagccaggacggccattggccacgaccggaaagggcagctggtgctctttcatgcagacggccaaacggagcagcgtggcatcaacctgtgggaaatggcggagttcctgctgaaacaggacgtggtcaacgccatcaacctggatgggggtggctctgccacctttgtgctcaacgggaccttggccagttacccgtcagatcactggcaggcgtgatggtgcacaccttacggttacagctgctcaggaggctcgggtggaaggatcgcaatacctcatctcaaaaatagatagacgccatcttgtagcgggcacttctggcggggtcccggctgtgatgagctggactgtggcccctctaactgcagccagcacggactgtgcacggagaccggctgccgctgtgatgccggatggaccgggtccaactgcagtgaagagtgtccccttggctggcatgggccgggctgccagaggccttgtaagtgtgagcaccattgtccctgtgaccccaagactggcaactgcagcgtctccagagtaaagcagtgtctccagccacctgaagccaccctgagggcgggagaactctcctttttcaccaggaccgcctggctagccctcaccctggcgctggccttcctcctgctgatcagcactgcagcaaacctgtccttgctcctgtccagagcagagaggaaccggcgcctgcatggggactatgcataccacccgctgcaggagatgaacggggagcctctggccgcagagaaggagcagccagggggcgcccacaaccccttcaaggactgaagcctcaagctgcccggggtggcacgtcgcgaaagcttgtttccccacggtctggcttctgcaggggaaatttcaaggccactggcgtggaccatctgggtgtcctcagcccctgtggggcagccaagttcctgatagcacttgtgcctcagcccctcacctggccacctgccagggcacctgcaaccctagcaataccatgctcgctggagaggctcagctgcctgcttctcgcctgcctgtgtctgctgccgagaagcccgtgcccccgggagggctgccgcactgccaaagagtctccctcctcctggggaaggggctgccaacgaaccagactcagtgaccacgtcatgacagaacagcacatcctggccagcacccctggctggagtgggttaaagggacgagtctgccttcctggctgtgacacgggaccccttttctacagacctcatcactggatttgccaactagaattcgatttcctgtcataggaagctccttggaagaagggatggggggatgaaatcatgtttacagacctgttttgtcatcctgctgccaagaagttttttaatcacttgaataaattgatataataaaagga

SEQ ID NO: 23227 - DNA, 2585 bp, Homo sapiens
  misc_feature (2267)..(2267): n is a, c, g, or t
  misc_feature (2283)..(2285): n is a, c, g, or t
  misc_feature (2299)..(2299): n is a, c, g, or t
  misc_feature (2303)..(2303): n is a, c, g, or t
  misc_feature (2306)..(2307): n is a, c, g, or t
  misc_feature (2322)..(2322): n is a, c, g, or t
  misc_feature (2325)..(2325): n is a, c, g, or t
  misc_feature (2336)..(2336): n is a, c, g, or t
  misc_feature (2338)..(2338): n is a, c, g, or t
  misc_feature (2344)..(2344): n is a, c, g, or t
  misc_feature (2347)..(2347): n is a, c, g, or t
  misc_feature (2360)..(2360): n is a, c, g, or t
  misc_feature (2362)..(2362): n is a, c, g, or t
  misc_feature (2372)..(2372): n is a, c, g, or t
  misc_feature (2395)..(2397): n is a, c, g, or t
  misc_feature (2403)..(2403): n is a, c, g, or t
  misc_feature (2405)..(2405): n is a, c, g, or t
  misc_feature (2407)..(2407): n is a, c, g, or t
  misc_feature (2414)..(2414): n is a, c, g, or t
  misc_feature (2427)..(2428): n is a, c, g, or t
  misc_feature (2433)..(2433): n is a, c, g, or t
  misc_feature (2443)..(2443): n is a, c, g, or t
  misc_feature (2446)..(2446): n is a, c, g, or t
  misc_feature (2449)..(2449): n is a, c, g, or t
  misc_feature (2455)..(2455): n is a, c, g, or t
  misc_feature (2462)..(2463): n is a, c, g, or t
  misc_feature (2473)..(2473): n is a, c, g, or t
  misc_feature (2476)..(2476): n is a, c, g, or t
  misc_feature (2480)..(2480): n is a, c, g, or t
  misc_feature (2486)..(2487): n is a, c, g, or t
  misc_feature (2490)..(2490): n is a, c, g, or t
  misc_feature (2498)..(2498): n is a, c, g, or t
  misc_feature (2505)..(2505): n is a, c, g, or t
  misc_feature (2508)..(2509): n is a, c, g, or t
  misc_feature (2526)..(2526): n is a, c, g, or t
  misc_feature (2540)..(2541): n is a, c, g, or t
  misc_feature (2549)..(2549): n is a, c, g, or t
  misc_feature (2568)..(2568): n is a, c, g, or t
cacatgacccgaggccccggtccaatatggcgacctccacgggtcgctggcttctcctccggcttgcactattcggcttcctctgggaagcgtccggcggcctcgactcgggggcctcccgcgacgacgacttgctactgccctatccacgcgcgcgcgcgcgcctcccccgggactgcacacgggtgcgcgccggcaaccgcgagcacgagagttggcctccgcctcccgcgactcccggcgccggcggtctggccgtgcgcaccttcgtgtcgcacttcagggaccgcgcggtggccggccacctgacgcgggccgttgagcccctgcgcaccttctcggtgctggagcccggtgggcccggcggctgcgcggcgagacgacgcgccaccgtggaggagacggcgcgggcggccgactgccgtgtcgcccagaacggcggcttcttccgcatgaactcgggcgagtgcctggggaacgtggtgagcgacgagcggcgggtgagcagctccggggggctgcagaacgcgcagttcgggatccgccgcgacgggaccctggtcaccgggtacctgtctgaggaggaggtgctggacactgagaacccatttgtgcagctgctgagtggggtcgtgtggctgattcgtaatggaagcatctacatcaacgagagccaagccacagagtgtgacgagacacaggagacaggttcctttagcaaatttgtgaatgtgatatcagccaggacggccattggccacgaccggaaagggcagctggtgctctttcatgcagacggccaaacggagcagcgtggcatcaacctgtgggaaatggcggagttcctgctgaaacaggacgtggtcaacgccatcaacctggatgggggtggctctgccacctttgtgctcaacgggaccttggccagttacccgtcagatcactgccaggacaacatgtggcgctgtccccgccaagtgtccaccgtggtgtgtgtgcacgaaccccgctgccagccgcctgactgccacggccacgggacctgcgtggacgggcactgccaatgcaccgggcacttctggcggggtcccggctgtgatgagctggactgtggcccctctaactgcagccagcacggactgtgcacggagaccggctgccgctgtgatgccggatggaccgggtccaactgcagtgaagagtgtccccttggctggcatgggccgggctgccagaggccttgtaagtgtgagcaccattgtccctgtgaccccaagactggcaactgcagcgtctccagagtaaagcagtgtctccagccacctgaagccaccctgagggcgggagaactctcctttttcaccaggaccgcctggctagccctcaccctggcgctggccttcctcctgctgatcagcactgcagcaaacctgtccttgctcctgtccagagcagagaggaaccggcgcctgcatggggactatgcataccacccgctgcaggagatgaacggggagcctctggccgcagagaaggagcagccagggggcgcccacaaccccttcaaggactgaagcctcaagctgcccggggtggcacgtcgcgaaagcttgtttccccacggtctggcttctgcaggggaaatttcaaggccactggcgtggaccatctgggtgtcctcagcccctgtggggcagccaagttcctgatagcacttgtgcctcagcccctcacctggccacctgccagggcacctgcaaccctagcaataccatgctcgctggagaggctcagctgcctgcttctcgcctgcctgtgtctgctgccgagaagcccgtgcccccgggagggctgccgcactgccaaagagtctccctcctcctggggaaggggctgccaacgaaccagactcagtgaccacgtcatgacagaacagcacatcctggccagcacccctggctggagtgggttaaagggacgagtctgccttcctggctgtgacacgggaccccttttctacagacctcatcactggatttgccaactagaattcgatttcctgtcataggaagctccttggaagaagggatggggggatgaaatcatgtttacagacctgttttgtcatcctgctgccaagaagttttttaatcacttgaataaattgatataataaaaggaaaaaaaaaaaaaaaaaaaaaaaaaaaaaaaaaaaaaaaaaaaaaaaaaaaaaaaaaaaaaaaaaaaaaaaaaaaaaaaaaaaaaanaaaaaaaaaaattttnnnttggggccaaattngggntcnnttggccaattccccnttngggggggggtntnaaaatnccngggccggggtttnanaagggggggnggggaaaaccccgggggttcccnnnttaaancncnttggganaaatccccttttnnggggnggggaaaaanganaanggcccnccccgtnnccctttccanaanttgncaaccnntangggaaaangaaattnaannctttaatttttttaaantcgcgtaaattttnnaaacaacncatttttaaccaaagggcnaaatgggaaatcccttt

SEQ ID NO: 23228 - DNA, 2011 bp, Homo sapiens
cacatgacccgaggccccggtccaatatggcgacctccacgggtcgctggcttctcctccggcttgcactattcggcttcctctgggaagcgtccggcggcctcgactcgggggcctcccgcgacgacgacttgctactgccctatccacgcgcgcgcgcgcgcctcccccgggactgcacacgggtgcgcgccggcaaccgcgagcacgagagttggcctccgcctcccgcgactcccggcgccggcggtctggccgtgcgcaccttcgtgtcgcacttcagggaccgcgcggtggccggccacctgacgcgggccgttgagcccctgcgcaccttctcggtgctggagcccggtgggcccggcggctgcgcggcgagacgacgcgccaccgtggaggagacggcgcgggcggccgactgccgtgtcgcccagaacggcggcttcttccgcatgaactcgggcgagtgcctggggaacgtggtgagcgacgagcggcgggtacctgtctgaggaggaggtgctggacactgagaacccatttgtgcagctgctgagtggggtcgtgtggctgattcgtaatggaagcatctacatcaacgagagccaagccacagagtgtgacgagacacaggagacaggttcctttagcaaatttgtgaatgtgatatcagccaggacggccattggccacgaccggaaagggcagctggtgctctttcatgcagacggccaaacggagcagcgtggcatcaacctgtgggaaatggcggagttcctgctgaaacaggacgtggtcaacgccatcaacctggatgggggtggctctgccacctttgtgctcaacgggaccttggccagttacccgtcagatcactgccaggacaacatgtggcgctgtccccgccaagtgtccaccgtggtgtgtgtgcacgaaccccgctgccagccgcctgactgccacggccacgggacctgcgtggacgggcactgccaatgcaccgggcacttctggcggggtcccggctgtgatgagctggactgtggcccctctaactgcagccagcacggactgtgcacggagaccggctgccgctgtgatgccggatggaccgggtccaactgcagtgaagtaaagcagtgtctccagccacctgaagccaccctgagggcgggagaactctcctttttcaccaggaccgcctggctagccctcaccctggcgctggccttcctcctgctgatcagcactgcagcaaacctgtccttgctcctgtccagagcagagaggaaccggcgcctgcatggggactatgcataccacccgctgcaggagatgaacggggagcctctggccgcagagaaggagcagccagggggcgcccacaaccccttcaaggactgaagcctcaagctgcccggggtggcacgtcgcgaaagcttgtttccccacggtctggcttctgcaggggaaatttcaaggccactggcgtggaccatctgggtgtcctcagcccctgtggggcagccaagttcctgatagcacttgtgcctcagcccctcacctggccacctgccagggcacctgcaaccctagcaataccatgctcgctggagaggctcagctgcctgcttctcgcctgcctgtgtctgctgccgagaagcccgtgcccccgggagggctgccgcactgccaaagagtctccctcctcctggggaaggggctgccaacgaaccagactcagtgaccacgtcatgacagaacagcacatcctggccagcacccctggctggagtgggttaaagggacgagtctgccttcctggctgtgacacgggaccccttttctacagacctcatcactggatttgccaactagaattcgatttcctgtcataggaagctccttggaagaagggatggggggatgaaatcatgtttacagacctgttttgtcatcctgctgccaagaagttttttaatcacttgaataaattgatataataaaagga

SEQ ID NO: 23229 - DNA, 339 bp, Homo sapiens
ttttgcaaaagtatagctgtgcaatggattagaataataatattaaaactggtccttcactcagttttagaggcactggcctacaaagtaggaagtaaaatgaggtgatagctgcaaaaactgtaaaaatgacaaagctctgcatcttttgttataaaaggtagcaacaaaagaatacaactgtgtacaatctgggataaccatggtaacacccacgatgtatatggccctttatgcatgtcagtttggggccatgtatcttacatgtgttatttcacatggcacgtaagggactggcagagtgacgctcaggtcagcctgacagcagggtgattgaag

SEQ ID NO: 23230 - DNA, 464 bp, Homo sapiens
ggacgaagcacattgaccaacagacagttcaatcatgaccaaatccaataaagaagtcttccagaaagcaattgcaaatcaggaagatgttatcagaagaaagggatcctgggctggcaccataaaggatttgtgccttgcttttttcaggttaagacagcagggacttgccacggagactctaaagtctgttcctccaacctttcccattgcagtgagagcaataatttccctgaccctataaaaggcatgcaaagtgtatccaggtcaagagcttgggtaacatcaacactgtgaaatgtggggacagatatcttggtggaaaaagcactgagacttctgtttccatcagcaaagaagactaaacaccaagggaaacaactaaactatctgaataaaatatcccttaaaatgcattgcttagtaggcaattttttaaaattttttaaaatccacagaggccc

SEQ ID NO: 23231 - DNA, 410 bp, Homo sapiens
atatttatatcatagaatatctcttgagtataatatctcgagtgaggctgttgtgaggattagaggtaataactcgtacaaaagtgcctggcatacagtgggttctaagaaaatgtccaggccaggcgcagtggttcatgcctgtaatctcagcactctgggaggccaaggcaggcagattgcatgagcccaggaattcgagacaagcctgggcaacatggcaaaaccccatctctacaaaaaaaaataccaaaaaaaaattagccgggtgtggtgcacgtgcctgtactcccagctactcgggaaactaaagcggcaggatcacttgagcccaggagagagagacttcagggagctgtgattgtgccactgtactccagcctaagtgacgagagtgagaccctgtctcc

SEQ ID NO: 23232 - DNA, 2521 bp, Homo sapiens
  misc_feature (13)..(16): n is a, c, g, or t
aagggggggggcnnnnaaaaacttacggctaggtacgaggctgcggtgaaatcggcagaggtcctttcaagctcgaccgttgaggtccttgtcatgcccagcctcagaactcgccgtgaggaggcagagatggagctctcagttccaggaccatccccctggacccctgcagcccaggcccgtgtgagagatgctcctgctgtgacccaccctggatctgcagcctgtggtaccccctgctgtagtgatactgagctggaagccatctgccctcactatcagcagccagattgtgacaccaggactgaagacaaggagtttcttcacaaggaagacattcatgaagatttggaatcacaggcagaaatatcagaaaactatgctggtgatgtttcccaggtacccgagcttggagatctgtgtgatgatgtatcagaaagagactggggagtccccgaaggcaggaggctgccacagtccctctcccaggagggggacttcacaccagctgccatggggctccttaggggccccttaggggagaaagatctggactgtaatggttttgacagtcgcttcagtctgagcccaaacctgatggcatgtcaggaaatccctacagaagagaggccacatccatatgacatgggtggccagagtttccagcacagtgtggacctaactggtcatgagggggttcccacagctgaaagtccactcatatgtaatgagtgtgggaaaaccttccaaggaaatcctgaccttattcagcgtcaaatagtccacactggggaggcttcctttatgtgtgatgattgtgggaaaaccttcagccagaactcagttcttaaaaaccgtcatcgatctcatatgagtgagaaagcttaccagtgcagcgaatgtgggaaagccttccgagggcactcagacttttctaggcatcagagtcaccacagcagtgagaggccttatatgtgtaatgaatgtggaaaagccttcagccagaactcgagccttaaaaagcaccaaaagtctcacatgagtgagaagccctatgaatgcaatgaatgtgggaaggcttttaggcggagctcaaacctcatccaacatcaaagaatccattctggggagaaaccgtatgtgtgcagtgagtgtgggaaggccttcaggcgaagctcaaacctcatcaaacaccacaggactcacacaggagagaagccttttgagtgtggcgagtgtgggaaagccttcagccagagtgcacacctgaggaagcaccagagggtccacactggagagaagccttatgagtgtaatgattgtggcaagcccttcagtcgggtctccaacctcattaagcaccacagggttcacactggagagaagccctataagtgcagtgactgtgggaaagcatttagtcagagctccagccttattcagcatcggagaattcacactggagaaaagcctcacgtgtgtaatgtatgtggaaaagcctttagttatagctcagtgctccgaaagcaccagatcatccacacgggagagaagccgtacagatgcagtgtctgtgggaaggccttcagccacagctcagccctcattcagcaccagggcgtgcacacaggcgacaagccctacgcctgccacgagtgtgggaagacctttggtcgcagctccaacctcatccttcaccagcgagtccacactggagagaagccctatgaatgtactgaatgtggaaaaaccttcagccagagctcaaccctcattcagcatcagaggattcataatgggctgaagccccatgaatgtaaccagtgtggtaaagccttcaaccgaagctcaaatctcattcaccaccagaaagttcatactggggaaaaaccctacacctgtgttgaatgtggtaagggcttcagccagagctcacacctcattcagcatcagataatccacacgggcgagcgcccctacaaatgcagtgagtgtgggaaagccttcagtcagcgttcggtcctcatccagcaccagaggattcacactggggtgaagccctatgactgtgctgcttgtgggaaagccttcagccagcgatcaaagttgatcaaacaccagttgattcacaccagggaataggctgttgggctggcaggagtgaaaccgagcatagtttcctctccaactcctctttggccattgtctcagcctctgccacttcccagaccgaaagcctggactcagctcactgcctacatccagtggccacatagcctgggaccctcctttgaaacatcctttacaggctcccttctcactgccactgctcttgcctcttgtgatgtcttgggtttgggcttgtttttacagcttgtgaacggactgcacgtttgttacaagggagaagattatggaggctgcatattcatgaatagagtttattattataatgaaaagttaccaaaaaagtaaagtgacgtttggtttgagataaccatagtagtttgtttgattggta

SEQ ID NO: 23233 - DNA, 2517 bp, Homo sapiens
cccctttgcagatccccttgaccacaccctcattctcagctggtgctcatgaaggacagaagagtcaatgtcagtacaatgtccttgtcatgcccagcctcagaactcgccgtgaggaggcagagatggagctctcagttccaggaccatccccctggacccctgcagcccaggcccgtgtgagagatgctcctgctgtgacccaccctggatctgcagcctgtggtaccccctgctgtagtgatactgagctggaagccatctgccctcactatcagcagccagattgtgacaccaggactgaagacaaggagtttcttcacaaggaagacattcatgaagatttggaatcacaggcagaaatatcagaaaactatgctggtgatgtttcccaggtacccgagcttggagatctgtgtgatgatgtatcagaaagagactggggagtccccgaaggcaggaggctgccacagtccctctcccaggagggggacttcacaccagctgccatggggctccttaggggccccttaggggagaaagatctggactgtaatggttttgacagtcgcttcagtctgagcccaaacctgatggcatgtcaggaaatccctacagaagagaggccacatccatatgacatgggtggccagagtttccagcacagtgtggacctaactggtcatgagggggttcccacagctgaaagtccactcatatgtaatgagtgtgggaaaaccttccaaggaaatcctgaccttattcagcgtcaaatagtccacactggggaggcttcctttatgtgtgatgattgtgggaaaaccttcagccagaactcagttcttaaaaaccgtcatcgatctcatatgagtgagaaagcttaccagtgcagcgaatgtgggaaagccttccgagggcactcagacttttctaggcatcagagtcaccacagcagtgagaggccttatatgtgtaatgaatgtggaaaagccttcagccagaactcgagccttaaaaagcaccaaaagtctcacatgagtgagaagccctatgaatgcaatgaatgtgggaaggcttttaggcggagctcaaacctcatccaacatcaaagaatccattctggggagaaaccgtatgtgtgcagtgagtgtgggaaggccttcaggcgaagctcaaacctcatcaaacaccacaggactcacacaggagagaagccttttgagtgtggcgagtgtgggaaagccttcagccagagtgcacacctgaggaagcaccagagggtccacactggagagaagccttatgagtgtaatgattgtggcaagcccttcagtcgggtctccaacctcattaagcaccacagggttcacactggagagaagccctataagtgcagtgactgtgggaaagcatttagtcagagctccagccttattcagcatcggagaattcacactggagaaaagcctcacgtgtgtaatgtatgtggaaaagcctttagttatagctcagtgctccgaaagcaccagatcatccacacgggagagaagccgtacagatgcagtgtctgtgggaaggccttcagccacagctcagccctcattcagcaccagggcgtgcacacaggcgacaagccctacgcctgccacgagtgtgggaagacctttggtcgcagctccaacctcatccttcaccagcgagtccacactggagagaagccctatgaatgtactgaatgtggaaaaaccttcagccagagctcaaccctcattcagcatcagaggattcataatgggctgaagccccatgaatgtaaccagtgtggtaaagccttcaaccgaagctcaaatctcattcaccaccagaaagttcatactggggaaaaaccctacacctgtgttgaatgtggtaagggcttcagccagagctcacacctcattcagcatcagataatccacacgggcgagcgcccctacaaatgcagtgagtgtgggaaagccttcagtcagcgttcggtcctcatccagcaccagaggattcacactggggtgaagccctatgactgtgctgcttgtgggaaagccttcagccagcgatcaaagttgatcaaacaccagttgattcacaccagggaataggctgttgggctggcaggagtgaaaccgagcatagtttcctctccaactcctctttggccattgtctcagcctctgccacttcccagaccgaaagcctggactcagctcactgcctacatccagtggccacatagcctgggaccctcctttgaaacatcctttacaggctcccttctcactgccactgctcttgcctcttgtgatgtcttgggtttgggcttgtttttacagcttgtgaacggactgcacgtttgttacaagggagaagattatggaggctgcatattcatgaatagagtttattattataatgaaaagttaccaaaaaagtaaagtgacgtttggtttgagataaccatagtagtttgtttgattggta

SEQ ID NO: 23234 - DNA, 2522 bp, Homo sapiens
ggcgggacttccgggggtcagccggcgttggctgagacgtcttcgtgccacggtgctgcctcctttccaagcgcgacccgttgaggtccttgtcatgcccagcctcagaactcgccgtgaggaggcagagatggagctctcagttccaggaccatccccctggacccctgcagcccaggcccgtgtgagagatgctcctgctgtgacccaccctggatctgcagcctgtggtaccccctgctgtagtgatactgagctggaagccatctgccctcactatcagcagccagattgtgacaccaggactgaagacaaggagtttcttcacaaggaagacattcatgaagatttggaatcacaggcagaaatatcagaaaactatgctggtgatgtttcccaggtacccgagcttggagatctgtgtgatgatgtatcagaaagagactggggagtccccgaaggcaggaggctgccacagtccctctcccaggagggggacttcacaccagctgccatggggctccttaggggccccttaggggagaaagatctggactgtaatggttttgacagtcgcttcagtctgagcccaaacctgatggcatgtcaggaaatccctacagaagagaggccacatccatatgacatgggtggccagagtttccagcacagtgtggacctaactggtcatgagggggttcccacagctgaaagtccactcatatgtaatgagtgtgggaaaaccttccaaggaaatcctgaccttattcagcgtcaaatagtccacactggggaggcttcctttatgtgtgatgattgtgggaaaaccttcagccagaactcagttcttaaaaaccgtcatcgatctcatatgagtgagaaagcttaccagtgcagcgaatgtgggaaagccttccgagggcactcagacttttctaggcatcagagtcaccacagcagtgagaggccttatatgtgtaatgaatgtggaaaagccttcagccagaactcgagccttaaaaagcaccaaaagtctcacatgagtgagaagccctatgaatgcaatgaatgtgggaaggcttttaggcggagctcaaacctcatccaacatcaaagaatccattctggggagaaaccgtatgtgtgcagtgagtgtgggaaggccttcaggcgaagctcaaacctcatcaaacaccacaggactcacacaggagagaagccttttgagtgtggcgagtgtgggaaagccttcagccagagtgcacacctgaggaagcaccagagggtccacactggagagaagccttatgagtgtaatgattgtggcaagcccttcagtcgggtctccaacctcattaagcaccacagggttcacactggagagaagccctataagtgcagtgactgtgggaaagcatttagtcagagctccagccttattcagcatcggagaattcacactggagaaaagcctcacgtgtgtaatgtatgtggaaaagcctttagttatagctcagtgctccgaaagcaccagatcatccacacgggagagaagccgtacagatgcagtgtctgtgggaaggccttcagccacagctcagccctcattcagcaccagggcgtgcacacaggcgacaagccctacgcctgccacgagtgtgggaagacctttggtcgcagctccaacctcatccttcaccagcgagtccacactggagagaagccctatgaatgtactgaatgtggaaaaaccttcagccagagctcaaccctcattcagcatcagaggattcataatgggctgaagccccatgaatgtaaccagtgtggtaaagccttcaaccgaagctcaaatctcattcaccaccagaaagttcatactggggaaaaaccctacacctgtgttgaatgtggtaagggcttcagccagagctcacacctcattcagcatcagataatccacacgggcgagcgcccctacaaatgcagtgagtgtgggaaagccttcagtcagcgttcggtcctcatccagcaccagaggattcacactggggtgaagccctatgactgtgctgcttgtgggaaagccttcagccagcgatcaaagttgatcaaacaccagttgattcacaccagggaataggctgttgggctggcaggagtgaaaccgagcatagtttcctctccaactcctctttggccattgtctcagcctctgccacttcccagaccgaaagcctggactcagctcactgcctacatccagtggccacatagcctgggaccctcctttgaaacatcctttacaggctcccttctcactgccactgctcttgcctcttgtgatgtcttgggtttgggcttgtttttacagcttgtgaacggactgcacgtttgttacaagggagaagattatggaggctgcatattcatgaatagagtttattattataatgaaaagttaccaaaaaagtaaagtgacgtttggtttgagataaccatagtagtttgtttgattggta

SEQ ID NO: 23235 - DNA, 844 bp, Homo sapiens
ggaatgcagacatgtcagtgccaagtcaatgcagaggatggtgacagtcccagtggtagtgaatgtggaaaaaccttcagccagagctcaaccctcattcagcatcagaggattcataatgggctgaagccccatgaatgtaaccagtgtggtaaagccttcaaccgaagctcaaatctcattcaccaccagaaagttcatactggggaaaaaccctacacctgtgttgaatgtggtaagggcttcagccagagctcacacctcattcagcatcagataatccacacgggcgagcgcccctacaaatgcagtgagtgtgggaaagccttcagtcagcgttcggtcctcatccagcaccagaggattcacactggggtgaagccctatgactgtgctgcttgtgggaaagccttcagccagcgatcaaagttgatcaaacaccagttgattcacaccagggaataggctgttgggctggcaggagtgaaaccgagcatagtttcctctccaactcctctttggccattgtctcagcctctgccacttcccagaccgaaagcctggactcagctcactgcctacatccagtggccacatagcctgggaccctcctttgaaacatcctttacaggctcccttctcactgccactgctcttgcctcttgtgatgtcttgggtttgggcttgtttttacagcttgtgaacggactgcacgtttgttacaagggagaagattatggaggctgcatattcatgaatagagtttattattataatgaaaagttaccaaaaaagtaaagtgacgtttggtttgagataaccatagtagtttgtttgattggta

SEQ ID NO: 23236 - DNA, 475 bp, Homo sapiens
  misc_feature (399)..(399): n is a, c, g, or t
  misc_feature (407)..(407): n is a, c, g, or t
  misc_feature (455)..(455): n is a, c, g, or t
atctccacttaagagcctgacataataaacatttacactgcttaatgtgtaaatatagtctaatcttagaaagcacttcttacatagattaagaaaatttaaaaaaagtttttcttcatgacaaaaaaaattgctttcagctctagatgcaacaaatcatgatagaaattggtactaggctgggtgccgtgcctcatgcctgaaatcctagcactttgggaggccaaggtgggtgcactgcttggagtctaggagttcaagaccaggctgggcaacatggcaaaaacctgtttctacaaaaaatacacacacacacacacacacacacacacacacacacacacacacacaattaagttgctggcaaattccaaagctttagagagaataagcttcttnggtgggtngaaacttacaactctcacgtggtggctccagtttcctaaaattaaccnggtggcctgggtctctggaa

SEQ ID NO: 23237 - DNA, 485 bp, Homo sapiens
ggtcaccctgtgccctgttgcacacttgaggggcctggcattcggaatcttgccagctcaggctgggacaggccaccaacccccagggtccccctcctccaaaccccaggaccagagcctaagaggacaacacaaggcaggggcgggggttccactgctgtgccaagggcctggagaacacgggccttgctctccgctcagcagccaccagcgcccttctctcccggacagctcccgaggggctgctctcatggacaccatcaggtgctgggaagcaggaaccaccaggacctggacagagtccccagtgaccagcctggcagacagaggagccctcagctacagcatcacaaacaacgggtggggtaggtctgatgcaattctgtgggtgctgttgccaggcaggaggaggccatctccacagagacagccgcgagacacacgcgtccgcagtcagggagcgcaggagcaatgtggccccgagg

SEQ ID NO: 23238 - DNA, 914 bp, Homo sapiens
tctcactgccctggaggcccctctgtggcttagaacctggcatatggtgggagttctgagtttgccagtcctgccttccttccctccctctccttcggcccccttggtctctttcagcagtgttctcaagctttagcaagcatcagagtcacctggaaggcctgtcaaaacacacattgctgggccccacccccagggtttcctattcagtgcaggggaggagtagatgatttgcaattctaacaatttcccagatgataatgacccactctgagagccactgctttagagaagggtgtttcaatccaggcactatggacatgctgggctggataattccttgttgtgtgccctgtcctgtgcactgtaggatgttgggcagcatccctggcctctacccaccagatgccagtagtaaccctcctccacatgccacaaccagaaatgtctccaaacctggccagatatctcctatgggggcaaaatcaccccaacattgagaaccactgctctagaactctttgtcctgggggtggagtggactctgtggggacttggcaaggccaagttctaaattactgtcctcaagccaaatcaggccagccacctgtttttataaataagggctcactggaacacacagccccacccattcattgtcatcttctttctgctgctttcttgctacaagggtggaactgagtagttgcgacagaggccatctggtctgcaaagtctgagacattcactatctggctcttttcagaaaaagtctaccgacccctttcagaccctgaaggggtctggtagaatgtgatgtggtagaaggaccggggcaggtgggcccacccactctcttccatccaaaggaagggtagtcctccaggctgaagctaaataaagggcgtcttcta

SEQ ID NO: 23239 - DNA, 410 bp, Homo sapiens
aaatggaaaatatattgggctttatattctatacgaatttgtgtagactttagacatgtgagttaaaattccaggcagtttgcctcccaaagtgcagggattacagccgtgagccaccaagcccggcaggagttggttaatattaattcaccaaccatttcatttctattcactaaaaacttaaaaaatttaccccaggttccaagctgttggcaataaccaactgtagaatagagctttagctactattaagaataaagtttttagggctgagcttggtggctcatgcctgtaatcccagcactttgggaagccaaggcaggaagattgcttgagccccaggagttcaagaccagccttggcgacacagtgagaccctgtatcaaaaaaagaaaaaaatatatttttag

SEQ ID NO: 23240 - DNA, 360 bp, Homo sapiens
aaatggaaaatatattgggctttatattctatacgaatttgtgtagactttagacatgtgagttaaaattccaggcagtttggccgggtgcggtggtttggttcactcctgtaatcccagcactttgggaggccgaggcgggcggatcatgaggtcaggagatcgagaccatcctggctaacatggtgaaaccccgtctctactaaaaaaatacaaaaaattagcccggcgtggtggcgggtgcctttcacccaggctggagtgcagtggcgtgatcttggctcactgcaagctccgcctcccgggttcacgccattctcctgcctcagcctcccgagcagccaggactaaaggtcgacg

SEQ ID NO: 23241 - DNA, 282 bp, Homo sapiens
ggactagcatataattggaagattgaaggcagaagcccttatcttctcggcattctttagaattcttctgtatgtagatttcagaacacacagagccagagcaaaagaccttacttggcattaacaccaggatccacctgcccctcccttcctggcattaatgtccagtgctcccctaatgcactttaagctgtgaagttatcccaggtttatttacactgtaactaatttactcttggctggactgtcagcctggaaaataggatgtcactgcaccccccc

SEQ ID NO: 23242 - DNA, 4049 bp, Homo sapiens
acgcgccaatcggcatggctcttagagagagcagcttagtttttgaatcggttgtggcggccgccggcgaggaatggcggtatttgtgagaggagtcggcgtttgaagaggtggaactcctagggcttttttgagagtgctgatttagaagaatacaaatcatggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttataaaagccttaaaggacattaaagtgggctttgtaaagatggagtcagtggaagaatttgaaggtttggattctccggaatttgaaaatgtatttgtagtcacggactttcaggattctgtctttaatgacctctacaaggctgattgtagagttattggaccaccagttgtattaaattgttcacaaaaaggagagcctttgccattttcatgtcgcccgttgtattgtacaagtatgatgaatctagtactatgctttactggatttaggaaaaaagaagaactagtcaggttggtgacattggtccatcacatgggtggagttattcgaaaagactttaattcaaaagttacacatttggtggcaaattgtacacaaggagaaaaattcagggttgctgtgagtctaggtactccaattatgaagccagaatggatttataaagcttgggaaaggcggaatgaacaggatttctatgcagcagttgatgactttagaaatgaatttaaagttcctccatttcaagattgtattttaagtttcctgggattttcagatgaagagaaaaccaatatggaagaaatgactgaaatgcaaggaggtaaatatttaccgcttggagatgaaagatgcactcaccttgtagttgaagagaatatagtaaaagatcttccctttgaaccttcaaagaaactttatgttgtcaagcaagagtggttctggggaagcattcaaatggatgcccgagctggagaaactatgtatttatatgaaaaggcaaatactcctgagctcaagaaatcagtgtcaatgctttctctaaatacccctaacagcaatcgcaaacgacgtcgtttaaaagaaacacttgctcagctttcaagagagacagacgtgtcaccatttccaccccgtaagcgcccatcagctgagcattccctttccatagggtcactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaacgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgt

SEQ ID NO: 23243 - DNA, 3952 bp, Homo sapiens
ctcggtacccggatcattttcttcttccggtccttaaagcagctgatttagaagaatacaaatcatggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttataaaagccttaaaggacattaaagtgggctttgtaaagatggagtcagtggaagaatttgaaggtttggattctccggaatttgaaaatgtatttgtagtcacggactttcaggattctgtctttaatgacctctacaaggctgattgtagagttattggaccaccagttgtattaaattgttcacaaaaaggagagcctttgccattttcatgtcgcccgttgtattgtacaagtatgatgaatctagtactatgctttactggatttaggaaaaaagaagaactagtcaggttggtgacattggtccatcacatgggtggagttattcgaaaagactttaattcaaaagttacacatttggtggcaaattgtacacaaggagaaaaattcagggttgctgtgagtctaggtactccaattatgaagccagaatggatttataaagcttgggaaaggcggaatgaacaggatttctatgcagcagttgatgactttagaaatgaatttaaagttcctccatttcaagattgtattttaagtttcctgggattttcagatgaagagaaaaccaatatggaagaaatgactgaaatgcaaggaggtaaatatttaccgcttggagatgaaagatgcactcaccttgtagttgaagagaatatagtaaaagatcttccctttgaaccttcaaagaaactttatgttgtcaagcaagagtggttctggggaagcattcaaatggatgcccgagctggagaaactatgtatttatatgaaaaggcaaatactcctgagctcaagaaatcagtgtcaatgctttctctaaatacccctaacagcaatcgcaaacgacgtcgtttaaaagaaacacttgctcagctttcaagagagacagacgtgtcaccatttccaccccgtaagcgcccatcagctgagcattccctttccatagggtcactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaacgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgt

SEQ ID NO: 23244 - DNA, 3376 bp, Homo sapiens
ttaagaagcatacagctgatgaaaatccagacaaaagcactttagaaaaagctattggatcactgaaggaagtaatgacgttgctgtgagtctaggtactccaattatgaagccagaatggatttataaagcttgggaaaggcggaatgaacaggatttctatgcagcagttgatgactttagaaatgaatttaaagttcctccatttcaagattgtattttaagtttcctgggattttcagatgaagagaaaaccaatatggaagaaatgactgaaatgcaaggaggtaaatatttaccgcttggagatgaaagatgcactcaccttgtagttgaagagaatatagtaaaagatcttccctttgaaccttcaaagaaactttatgttgtcaagcaagagtggttctggggaagcattcaaatggatgcccgagctggagaaactatgtatttatatgaaaaggcaaatactcctgagctcaagaaatcagtgtcaatgctttctctaaatacccctaacagcaatcgcaaacgacgtcgtttaaaagaaacacttgctcagctttcaagagagacagacgtgtcaccatttccaccccgtaagcgcccatcagctgagcattccctttccatagggtcactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaacgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgt

SEQ ID NO: 23245 - DNA, 479 bp, Homo sapiens
gtaaggactctgtgtgagtgagagaggtgcaagtgggcgagcggctccagagccaagggctcttttgcctgcggtcgacgtccccgcccctagtgaccgcgaattccggagcgccccagctcaggcttcccggatccgggaactccctcgccgcaccccacccccagcagccgggccctgacgcggagtgggagaccgaagcccccagtattgctgggcatcttcgccctcacctgttggctcttttggacagaagagtgtgggtgaagggagggagttgggaaagggattttggcaagccgcgcagccctgtggctttgggggccggcacttgcagcctttgggggcttatctcagagtgcgccgtggttttattctaggattcatcctggcttctttgcgggaagtttaatttttcgtttttgcaagataaatccaggccatccgcccctcgtcctccccagccacccggcacagat

SEQ ID NO: 23246 - DNA, 273 bp, Homo sapiens
actattaaaataatggaagtccctgttataaagataaaagaaagttgtcctggaaaatcggatgaaaaattaataaaaagtgttattaatatggtaggtcaaagtaactcattgcatgtggcatgctgcacttcccttgattgtattattctactttctggtgattggaattaggcacaaggtgtattgtgtgcaatctgaagcttaatgaatagaaactgttttatactttttaactccttagcttcttttttctcattcattttatattta

SEQ ID NO: 23247 - DNA, 4142 bp, Homo sapiens
acgcgccaatcggcatggctcttagagagagcagcttagtttttgaatcggttgtggcggccgccggcgaggaatggcggtatttgtgagaggagtcggcgtttgaagaggtggaactcctagggcttttttgagagtgctgatttagaagaatacaaatcatggctgaaaatagtgtattaacatccactactgggaggactagcttggcagactcttccatttttgattctaaagttactgagatttccaaggaaaacttacttattggatctacttcatatgtagaagaagagatgcctcagattgaaacaagagtgatattggttcaagaagctggaaaacaagaagaacttataaaagccttaaagactattaaaataatggaagtccctgttataaagataaaagaaagttgtcctggaaaatcggatgaaaaattaataaaaagtgttattaatatggacattaaagtgggctttgtaaagatggagtcagtggaagaatttgaaggtttggattctccggaatttgaaaatgtatttgtagtcacggactttcaggattctgtctttaatgacctctacaaggctgattgtagagttattggaccaccagttgtattaaattgttcacaaaaaggagagcctttgccattttcatgtcgcccgttgtattgtacaagtatgatgaatctagtactatgctttactggatttaggaaaaaagaagaactagtcaggttggtgacattggtccatcacatgggtggagttattcgaaaagactttaattcaaaagttacacatttggtggcaaattgtacacaaggagaaaaattcagggttgctgtgagtctaggtactccaattatgaagccagaatggatttataaagcttgggaaaggcggaatgaacaggatttctatgcagcagttgatgactttagaaatgaatttaaagttcctccatttcaagattgtattttaagtttcctgggattttcagatgaagagaaaaccaatatggaagaaatgactgaaatgcaaggaggtaaatatttaccgcttggagatgaaagatgcactcaccttgtagttgaagagaatatagtaaaagatcttccctttgaaccttcaaagaaactttatgttgtcaagcaagagtggttctggggaagcattcaaatggatgcccgagctggagaaactatgtatttatatgaaaaggcaaatactcctgagctcaagaaatcagtgtcaatgctttctctaaatacccctaacagcaatcgcaaacgacgtcgtttaaaagaaacacttgctcagctttcaagagagacagacgtgtcaccatttccaccccgtaagcgcccatcagctgagcattccctttccatagggtcactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaacgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgt

SEQ ID NO: 23248 - DNA, 3641 bp, Homo sapiens
tccatagctcactcctgagggtaaaactagggccagagagacgtaaagactcggactttcaggattctgtctttaatgacctctacaaggctgattgtagagttattggaccaccagttgtattaaattgttcacaaaaaggagagcctttgccattttcatgtcgcccgttgtattgtacaagtatgatgaatctagtactatgctttactggatttaggaaaaaagaagaactagtcaggttggtgacattggtccatcacatgggtggagttattcgaaaagactttaattcaaaagttacacatttggtggcaaattgtacacaaggagaaaaattcagggttgctgtgagtctaggtactccaattatgaagccagaatggatttataaagcttgggaaaggcggaatgaacaggatttctatgcagcagttgatgactttagaaatgaatttaaagttcctccatttcaagattgtattttaagtttcctgggattttcagatgaagagaaaaccaatatggaagaaatgactgaaatgcaaggaggtaaatatttaccgcttggagatgaaagatgcactcaccttgtagttgaagagaatatagtaaaagatcttccctttgaaccttcaaagaaactttatgttgtcaagcaagagtggttctggggaagcattcaaatggatgcccgagctggagaaactatgtatttatatgaaaaggcaaatactcctgagctcaagaaatcagtgtcaatgctttctctaaatacccctaacagcaatcgcaaacgacgtcgtttaaaagaaacacttgctcagctttcaagagagacagacgtgtcaccatttccaccccgtaagcgcccatcagctgagcattccctttccatagggtcactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaacgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgt

SEQ ID NO: 23249 - DNA, 1507 bp, Homo sapiens
  misc_feature (1507)..(1507): n is a, c, g, or t
gttggcaagcggaccaccagcaacagacaacatcttcattcggctctccctgaagctgtactgcctcgctgagaggatgaaggtctccgaggctgccctgtctctccttgtcctcatccttatcattacttcggcttctcgcagccagccaaaagttcctgagtgggtgaacaccccatccacctgctgcctgaagtattatgagaaagtgttgccaaggagactagtggtgggatacagaaaggccctcaactgtcacctgccagcaatcatcttcgtcaccaagaggaaccgagaagtctgcaccaaccccaatgacgactgggtccaagagtacatcaaggatcccaacctacctttgctgcctaccaggaacttgtccacggttaaaattattacagcaaagaatggtcaaccccagctcctcaactcccagtgatgaccaggctttagtggaagcccttgtttacagaagagaggggtaaacctatgaaaacaggggaagccttattaggctgaaactagccagtcacattgagagaagcagaacaatgatcaaaataaaggagaagtatttcgaatattttctcaatcttaggaggaaataccaaagttaagggacgtgggcagaggtacgctcttttatttttatatttatatttttatttttttgagatagggtcttactctgtcacccaggctggagtgcagtggtgtgatcttggctcacttgatcttggctcactgtaacctccacctcccaggctcaagtgatcctcccaccccagcctcccgagtagctgggactacaggcttgcgccaccacacctggctaatttttgtatttttggtagagacgggattctaccatgttgcccaggctggtctcaaactcgtgtgcccaagcaatccacctgcctcagccttccaaaagtgctgggattacaggcgtgagccaccacatccggccagtgcactcttaatacacagaaaaatatatttcacatccttctcctgctctctttcaattcctcacttcacaccagtacacaagccattctaaatacttagccagtttccagccttccagatgatctttgccctctgggtcttgacccattaagagccccatagaactcttgatttttcctgtccatctttatggatttttctggatctatattttcttcaattattctttcattttataatgcaactttttcataggaagtccggatgggaatattcacattaatcatttttgcagagactttgctagatcctctcatattttgtcttcctcagggtggcaggggtacagagagtgcctgattggaaaaaaaaaaaaaagagagagagagagaagaagaagaagaagagacacaaatctctacctcccatgttaagctttgcaggacagggaaagaaagggtatgagacacggctaggggtaaactcttagtccaaaacccaagcatgcaataaataaaactcccttatttgacan

SEQ ID NO: 23250 - DNA, 1536 bp, Homo sapiens
ttaaataattagaatttcagatcggtcaaaatactttggcatctgaaagcaggagcttagaaccagaattccttctcagacataatcccagcatccccagcccagtgcttttgctctttcgcaccaggccagataactctgtgatcatggacgtatgcaggaatttgtaaatatttggtggatgatagtcagattgccaaatggcagaaaggtttctggttttgcagtttgaaaaggattatagagcggggaacaaggtaaatatctgaaggtctgcatgatagtacttcttttcctattgctttggagttattttttatacctctttacacaatgtgtgagactaccaaatttacattgcactgttccaggtgacttgtgcagttgacaaactatgacccagcatagcaacctaggcaagaggagcctatataattcattcttattcctattttgctatttcaacttgtttctgttttataactgcaaatggcctcccaggggtagcaactgttggcaacttaaagttaagccagtagttctcctcactccatatctatgctgcttgtctttgcatataagtgagtggatgctgggggcatggaaaaacaaaactatttaagtgtgggagaggcctgtgacttttgtagtcctttggggaatttttcacatgaccagggccaaatagttctgactgctcttgtgccatcctgggaatagagcagtgggatgtaaggagtgaaaggggccatggatcagtggttctcaaagtgtggtcctcagacctgcagcatcagcatcaccagggagcatgttagaaatgcagatcctcaggccctggccccaacctactgaattaaaaccttttcaggcgggcccacgagtctgttataacaaggtcttcggatgatgactgtgcatagtgaaatgtgagaagtaccgcttgattcatcatccagccagatctgtccagcccatttttgtgattgtggaaattgagggcaagagtgggcaggtcactttcccaccatgaaacagctagctcagggtaggtgctggccttctgattcccagtccagacctctgctagtcacagtgcccagccaggtatgctgtggggatgtcagtggcctcagaaagagtgacgacttgggactgatgtccccacatgctggggtcacaggacaaaggaaagggtttgtgactttgagctctcttcttaccctgggcaacctctctctctgtttaaaagcctggtgaccctgctgtgaacttcctcttttaaatgaacagctccctagagcatccttggctgagcttagcaacaaggggggagggagtgaggaggggtgggaggaaaatgggctcccccgttatcatgtcagtgcaatcactgggaattatggttgaggattaagagtcacttggggataattcagccaggctggagagggaaacacacacaaatacacacacactcacaacataaacagattgctaaagctcatggcagaaaacaaacagcataggaaagaa

SEQ ID NO: 23251 - DNA, 307 bp, Homo sapiens
gctgagattgtgccactgctctccatcctgggcaagacagaacaagactgtctcaaaaaaaaaaaaaaaaaaaaaaaccagtaaccttgttcaccttttgtggttttctgtctagtctgagtttttctctctagcctgtcccctaagctctcctctcttctacttttctgccttccccttcatttctgacaccctcctagctctactttaccacccaattgttccagccactaccctccctcccaacacactacacacacacacacacacacacacacacacacacacacacacacagaaaaaaaaa

SEQ ID NO: 23252 - DNA, 791 bp, Homo sapiens
tttttttttttagaaaaagaccatatggaaaacattcatcttagcaacttctgataaaaagaaaaaaaaaaaaaaaaccctgattttaacttaccactgatttttactaaacttttaatctttagtttatgcaacaggaccacaatttcttttcccagttattaacacccagattgtttcaaaccctgaaaggaaagtgcaaaacatcatgctgcagaatttctatgccttagcttctgcagtgtttctctgtaaagtggccaggatggccctgtcattcactttcggagctgtcttcactgtcttcactctcggagtgtcttcactcttggagctgtacaaattatgcttttcgatgtattcttggacaagatctagtaccaagtagtggatgctctggccccttctgagggctcttcagatttttgtggatgagatgtcattagtgatccattcattcaccacatgaatgttgctccagtctttccatagcacatcagattcatagatgaatttctgagcagcatttccagcttgagtaatgcatatgagcccatagtctgccatgatttgggtgatgtcttcactcttccagaaattgggaacaccaaaggactccagtaaatctgccccacacagcagcttgacttttggtgcaccttttgtttttggctctagggatctcttttgactagaagcttgtctttgttcagctcatggaattcctctttcgtccaggcctttctagtgtaggtgagttctgctgttgatcacagtcactagcctccagt

SEQ ID NO: 23253 - DNA, 158 bp, Homo sapiens
gggactggatatacacatcagcattagatgtaatattgatgtctagcatttctcaagcaaataacatgcgatgaaaataacaaagtttgtatactgacaattagattaatttagagattccaggttaactattagaggttttgaagaaatcataaaga

SEQ ID NO: 23254 - DNA, 472 bp, Homo sapiens
gatctatatttgtgcaactgcgtccttaacattgactaagaccatcactgaaaaataaggtgaggaatgacattttagataaaaattttgttggagagcaatgtcatgagtggaatgcatgcattttgtgagtaagatatgtgtctacagatgaagacacacacacacagaaacacacatacacacacacttgcaaagacaaatattggattttttggaacatttgaatgaaaacattattctcttgttttcattgcatacatcattgctgtattatggtggcttctttcgctctctagttgaccttagtttcctgagagacatcccatagcgtgggtatgaggctagtgacctgcaccccttcttgaggggaatgtaggtagctgctaagccctgcatgctctggcatatctaacaaatgcctgtgagaattgtgaataggttaaaggcatagatgatagaaaaaaaatac

SEQ ID NO: 23255 - DNA, 237 bp, Homo sapiens
ctgttcaggcctcccctacctcacctgtaaagagtccctggaaattagactctgtcttgggctagccagcaggttggcactggagcctcagatggaagctacgtgctaccagacacagagataccatcaggagccaggacccgagaggagaagagggctgtgagctgccctgggactctgggggtggaccttggaggcagagcagtgatggaggtgaagggaaagtttgcaaagtct

SEQ ID NO: 23256 - DNA, 368 bp, Homo sapiens
ctaaattttaaaatcctcttgttattcttctgaaagagttgctttatgtattttgggcattgcaaacttgtcttgtgaaagagcttttcttggaaaatattaaacagtaaaattaaattgtgtggcgccttcgttggcttgatgtgaaagaatggatagagggtgagctgggaggatgaaaatgaaatctgtggagctacaaaagaaattgatgtaaaatccttgtactggtcccctgaggctacttagttgggtcttaccaagaactataaccgttacttccaaaatttgtacagagtaaatgagcctgataggaggatgtgataaggttcaacattgggtcttgaaatctagcaattagttcagta

SEQ ID NO: 23257 - DNA, 368 bp, Homo sapiens
gtggattggatcaaggaggcagattggacacagtgtcccatggaatcttctgtgctttggcttacattcaaccacaattttgcgtttgaaattccagagcccttttttctacagcagtgaaaatctaaatagtttccactagtttgctgaacgcagtttaaaattttcatcattcaggaaatttatgagctaccatattgtaaaatagcaaagggcttgttatggagctaagagagtcctaaaaacaagaaaatgtgaatattctgattcctacaaactaaaatttgcaagaatgttttataatatttttataggacatttctcaatatcatacatatgagatctcccttgtaaaatcatttttgctt

SEQ ID NO: 23258 - DNA, 197 bp, Homo sapiens
ggagagaaagaagggggagagagagacagggagtctgggagggagaggggaaagtctcacaagattattttatttttaggtggtgatgttttaaattctaatcttaagaagaaatgctgttgttccttaggtcaaattgactatatagattatgtactttgatgtgatatatgaagataggaatttcagtgtcaaac

SEQ ID NO: 23259 - DNA, 571 bp, Homo sapiens
ctgtaatcccagcacttcgagaggctgaggcgagagtattgcttgagcccaggagttcaagaccagcctcagcaacatgtcaagacctcatccctggctaattttgtttttgtatttttggtagagacgggatttcaccatgttagtcaggatggtctcaatctcctgagaactctgaaataattaaatacttgcatacgtcatagtttattttagctttactttgcctgaaaccgtaaaatgtcatctcaaggaaagatatctgatcttcactctggaattttaataaatggttttcaaccaaaatatttgaactaatgttagttggtatcagcttaatattaaatacttagctgatatgatttgattaacctaattttacagtttgtaatttccattaagaacccagtaggaaagtgtagtatattcatattaaagaaagtttggaaaatgtagaaatattagaaaaaagaaaagaaacctcacaatgtactaccatgatccaaatgcaaacactgtgtgaatccatgtcattcacaaggactatatatagctcaagatttttggtatc

SEQ ID NO: 23260 - DNA, 640 bp, Homo sapiens
ctgtaatcccagcacttcgagaggctgaggcgagagtattgcttgagcccaggagttcaagaccagcctcagcaacatgtcaagacctcatccctacaaaattaaaaaattagccaggcatgcctcccgagtagctgggactaaaggtgcctgccaccatgcctggctaattttgtttttgtatttttggtagagacgggatttcaccatgttagtcaggatggtctcaatctcctgagaactctgaaataattaaatacttgcatacgtcatagtttattttagctttactttgcctgaaaccgtaaaatgtcatctcaaggaaagatatctgatcttcactctggaattttaataaatggttttcaaccaaaatatttgaactaatgttagttggtatcagcttaatattaaatacttagctgatatgatttgattaacctaattttacagtttgtaatttccattaagaacccagtaggaaagtgtagtatattcatattaaagaaagtttggaaaatgtagaaatattagaaaaaagaaaagaaacctcacaatgtactaccatgatccaaatgcaaacactgtgtgaatccatgtcattcacaaggactatatatagctcaagatttttggtatc

SEQ ID NO: 23261 - DNA, 248 bp, Homo sapiens
taactatcgggtaccaggcttagtacctgagtgacaagataatttgtaaaacaaacccccatgacatgagtttacctatataacaaatctgcacatatacgcagaacctaaaataaaagttaaagaaaagaaagatgtatttaaattcgtgaaatgtagcaaaagcaatccctagagaaaatgttatagcttttaatgtttagattaccaaagaggaatgatctcaacttggtagccaagattctgtt

SEQ ID NO: 23262 - DNA, 498 bp, Homo sapiens
gaaaaaatcaggagagctggaagtttttgaagctgtcaaattgtggagatttacagatgtagtagggatagcgtctagagtagacacagtatggcagctggtcctgtctctaggagtacactcagtatgaccatgcagggaagtcctttcctatggggcagataagcacccttccaggaatgaacttcatagacattttagagatgaggttaaagaaaaagatggaacagacagcaaatgttgaaattatattgggggaaaatggctaataaaggcattattaatttgatagcaatcttactaatatagatggctagagacctaaaatagacctgttatagacttacagattaatgattaaaaatttgttttttttctgaggcttttgtggtacttctaattcatgtttatgctgtaggactcacgttaatgtctgaaagtcatattctccttttctcttagagataatacagaacacctcttatgaaagagtctcct

SEQ ID NO: 23263 - DNA, 448 bp, Homo sapiens
ccgggggggtcctggccgcctgctctatgggcccctgctggtactggaactgcatcccaaggactgtgtgtgtctctgtccacgtggaagagctccccacaactcactttgccctattggctccctgtgccactacttgacccagtacaccagtgactggggaagttccctgcggatggcactgtccctggcccagggcctggcatttctccatgaggagcgctggcagaatggccaatataaaccaggtattgcccaccgagatctgagcagccagaatgtgctcattcgggaagatggatcgtgtgccattggagacctgggccttgccttggtgctccctggcctcactcagccccctgcctggacccctactcctgtgtaaatatgcagtttatgtgtcatcaatgtacatgccaacataaatatggcgattgtatagctgtct

SEQ ID NO: 23264 - DNA, 423 bp, Homo sapiens
gccttggcagtgcaggagaggaggcgtccctacatcccatccacctggcgctgctttgccacagaccctgatgggctgagggagctcctagaagactgttgggatgcagacccagaagcacggctgacagctgagtgtgtacagcagcgcctggctgccttggcccatcctcaagagagccacccctttccagagagctgtccacgtggctgcccacctctctgcccagaagactgtacttcaattcctgcccctaccatcctcccctgtaggcctcagcggagtgcctgccacttcagcgttcagcaaggcccttgttccaggaatcctcagcctgcctgtaccctttctcctgtgtaaatatgcagtttatgtgtcatcaatgtacatgccaacataaatatggcgattgtatagctgtct

SEQ ID NO: 23265 - DNA, 701 bp, Homo sapiens
attcttgccttgatgtccagccctgctacagcgaaagaactacagagtgcgagggctccctgtgccactacttgacccagtacaccagtgactggggaagttccctgcggatggcactgtccctggcccagggcctggcatttctccatgaggagcgctggcagaatggccaatataaaccaggtattgcccaccgagatctgagcagccagaatgtgctcattcgggaagatggatcgtgtgccattggagacctgggccttgccttggtgctccctggcctcactcagccccctgcctggacccctactcaaccacaaggcccagctgccatcatggaagaccctgatgggctgagggagctcctagaagactgttgggatgcagacccagaagcacggctgacagctgagtgtgtacagcagcgcctggctgccttggcccatcctcaagagagccacccctttccagagagctgtccacgtggctgcccacctctctgcccagaagactgtacttcaattcctgcccctaccatcctcccctgtaggcctcagcggagtgcctgccacttcagcgttcagcaaggcccttgttccaggaatcctcagcctgcctgtaccctttctcctgtgtaaatatgcagtttatgtgtcatcaatgtacatgccaacataaatatggcgattgtatagctgtct

SEQ ID NO: 23266 - DNA, 4715 bp, Homo sapiens
tgctgcgaggatgctgcctgggcggctgtgctgggtgccgctcctgctggcgctgggcgtggggagcggcagcggcggtggcggggacagccggcagcgccgcctcctcgcggctaaagtcaataagcacaagccatggatcgagacttcatatcatggagtcataactgagaacaatgacacagtcattttggacccaccactggtagccctggataaagatgcaccggttccttttgcaggggaaatctgtgcgttcaagatccatggccaggagctgccctttgaggctgtggtgctcaacaagacatcaggagagggccggctccgtgccaagagccccattgactgtgagttgcagaaggagtacacattcatcatccaggcctatgactgtggtgctgggccccacgagacagcctggaaaaagtcacacaaggccgtggtccatatacaggtgaaggatgtcaacgagtttgctcccaccttcaaagagccagcctacaaggctgttgtgacggagggcaagatctatgacagcattctgcaggtggaggccattgacgaggactgctccccacagtacagccagatctgcaactatgaaatcgtcaccacagatgtgccttttgccatcgacagaaatggcaacatcaggaacactgagaagctgagctatgacaaacaacaccagtatgagatcctggtgaccgcctacgactgtggacagaagcccgctgctcaggacaccctggtgcaggtggatgtgaagccagtttgcaagcctggctggcaagactggaccaagaggattgagtaccagcctggctccgggagcatgcccctgttccccagcatccacctggagacgtgcgatggagccgtgtcttccctccagatcgtcacagagctgcagactaattacattgggaagggttgtgaccgggagacctactctgagaaatcccttcagaagttatgtggagcctcctctggcatcattgacctcttgccatcccctagcgctgccaccaactggactgcaggactgctggtggacagcagtgagatgatcttcaagtttgacggcaggcagggtgccaaaatccccgatgggattgtgcccaagaacctgaccgatcagttcaccatcaccatgtggatgaaacacggccccagccctggtgtgagagccgagaaggaaaccatcctctgcaactcagacaaaaccgaaatgaaccggcatcactatgccctgtatgtgcacaactgccgcctcgtctttctcttgcggaaggacttcgaccaggctgacacctttcgccccgcggagttccactggaagctggatcagatttgtgacaaagagtggcactactatgtcatcaatgtggagtttcctgtggtaaccttatacatggatggagcaacatatgaaccatacctggtgaccaacgactggcccattcatccatctcacatagccatgcaactcacagtcggcgcttgttggcaaggaggagaagtcaccaaaccacagtttgctcagttctttcatggaagcctggccagtctcaccatccgccctggcaaaatggaaagccagaaggtgatctcctgcctgcaggcctgcaaggaagggctggacattaattccttggaaagccttggccaaggaataaagtatcacttcaacccctcgcagtccatcctggtgatggaaggtgacgacattgggaacattaaccgtgctctccagaaagtctcctacatcaactccaggcagttcccaacggcgggtgtgcggcgcctcaaagtatcctccaaagtccagtgctttggggaagacgtatgcatcagtatccctgaggtagatgcctatgtgatggtcctccaggccatcgagccccggatcaccctccggggcacagaccacttctggagacctgctgcccagtttgaaagtgccaggggagtgaccctcttccctgatatcaagattgtgagcaccttcgccaaaaccgaagcccccggggacgtgaaaaccacagaccccaaatcagaagtcttagaggaaatgcttcataacttagatttctgtgacattttggtgatcggaggggacttggacccaaggcaggagtgcttggagctcaaccacagtgagctccaccaacgacacctggatgccactaattctactgcaggctactccatctacggtgtgggctccatgagccgctatgagcaggtgctacatcacatccgctaccgcaactggcgtccggcttcccttgaggcccggcgtttccggattaagtgctcagaactcaatgggcgctacactagcaatgagttcaacttggaggtcagcatccttcatgaagaccaagtctcagataaggagcatgtcaatcatctgattgtgcagcctcccttcctccagtctgtccatcatcctgagtcccggagtagcatccagcacagttcagtggtcccaagcattgccacagtggtcatcatcatctccgtgtgcatgcttgtgtttgttgtggccatgggtgtgtaccgggtccggatcgcccaccagcacttcatccaggagactgaggctgccaaggaatctgagatggactgggacgattctgcgctgactatcacagtcaaccccatggagaaacatgaaggaccagggcatggggaagatgagactgagggagaagaggaggaagaagccgaggaagaaatgagctccagcagtggctctgacgacagcgaagaggaggaggaggaggaagggatgggcagaggcagacatgggcagaatggagccaggcaagcccagctggagtgggatgactccaccctcccctactagtgcccaggggtctgctgcccggcccacatgtcccttttgtaaaccctgacccagtgtatgcccatgtctatcatacctcacctctgatgtctgtgacatgtctgggaaggccttctccagcttcctggagcccaccctttaagccttgggcactccctgtgtttcatccatggggaagttccaagaagcccagcatggccatcagtgaggacttcagggtagactttgtcctgtagcctccacttctgccctaagttccccagcatcctgactacctgtctgcagagtttgcctttgttttttcctgcagggaagaaggcccacctttgtgtcactcacctccccaggctcagagtccccaaggccctggggttccaactcactgtgcgtctcctccacacagaccagtaggttctcctatgctgactccaggttgcttcatacaaggagggtggttgaacttcacacacgtaaggtcttagtgcttaacagtttaaaggaaagtccttgttgaggcagaactaagtttacagggaaaggtacacacattctctctctctctctctctctctctgtctatctagttccccagcttggagagcctttccccttgcttctttctgaggccatataagcttataagaaaagtcccaaaccaagaataggtccttggccacaagcagggtctgatcccccatcagagctatctgagcctgcctgtctgggcacctgctgcaaccatgcagctaccctgccaggggcactcagcaaacagaaccacagggcccaggaggcattccacacaggcactgccccaggacaacacaacaaggacagtcacaacaaggacaacaaggacacaacacaacacacaacaaggacagtcacaacaagcctagagccagaaagcagatggaaatgctaatgaggtcaaacgtaggcttcatggtgggtggagtgggggtggctgggctcccccaggacagaggggaccctgaggttggcaaggctctcaccactcagccttatggtcccttatctcctatcttccctcttgagaaaatacacgctttctgcatgtattagaaacgcacgagctccaccaagtctacaatgaaagtttgaaatttaactgcaaggaattagaagcatatttgcaatcattgcagcttcttctttcttctgctcataaaaggaggaacactttagatagagggcaaatatatctgaaaacctaatttctttctttttttgataaggaaatcttttccatctccatcctaacatgcacaacctgtgaagagaattgtttctatagtaactggtctgtgatcttttgtggccaagagaatagcaggcaagaattagggccttgacagaatttccacgaagctctgagaacatgtttgtttcgaatgtctgattcctctttgtcatcaatgtgtatgctctgtccccatccttcactcctcctcaagctcacaccaattggtttggcacaggcacagagctggtccctagttaagtggcatttatgttaaaaaaaaatagttcagaatctcagccttttctttgtgtcatcaaaacagcttaagaaggggactactgccaatgtcctctagtctgacctccacccagggaggacccatggcaggtcttttcaactttctgattcatgagaacaaccttgtgaagcttttcccacctcctaaagtgttttctgcatctgttccttcctttggacctcacaacaaatcctgtgaagtaactgagacatctgttgttagatacatttttgtgatgagtaaactgaggcttcgtgattcaaaaaaaagtt

SEQ ID NO: 23267 - DNA, 3408 bp, Homo sapiens
tgctgcgaggatgctgcctgggcggctgtgctgggtgccgctcctgctggcgctgggcgtggggagcggcagcggcggtggcggggacagccggcagcgccgcctcctcgcggctaaagtcaataagcacaagccatggatcgagacttcatatcatggagtcataactgagaacaatgacacagtcattttggacccaccactggtagccctggataaagatgcaccggttccttttgcaggggaaatctgtgcgttcaagatccatggccaggagctgccctttgaggctgtggtgctcaacaagacatcaggagagggccggctccgtgccaagagccccattgactgtgagttgcagaaggagtacacattcatcatccaggcctatgactgtggtgctgggccccacgagacagcctggaaaaagtcacacaaggccgtggtccatatacaggtgaaggatgtcaacgagtttgctcccaccttcaaagagccagcctacaaggctgttgtgacggagggcaagatctatgacagcattctgcaggtggaggccattgacgaggactgctccccacagtacagccagatctgcaactatgaaatcgtcaccacagatgtgccttttgccatcgacagaaatggcaacatcaggaacactgagaagctgagctatgacaaacaacaccagtatgagatcctggtgaccgcctacgactgtggacagaagcccgctgctcaggacaccctggtgcaggtggatgtgaagccagtttgcaagcctggctggcaagactggaccaagaggattgagtaccagcctggctccgggagcatgcccctgttccccagcatccacctggagacgtgcgatggagccgtgtcttccctccagatcgtcacagagctgcagactaattacattgggaagggttgtgaccgggagacctactctgagaaatcccttcagaagttatgtggagcctcctctggcatcattgacctcttgccatcccctagcgctgccaccaactggactgcaggactgctggtggacagcagtgagatgatcttcaagtttgacggcaggcagggtgccaaaatccccgatgggattgtgcccaagaacctgaccgatcagttcaccatcaccatgtggatgaaacacggccccagccctggtgtgagagccgagaaggaaaccatcctctgcaactcagacaaaaccgaaatgaaccggcatcactatgccctgtatgtgcacaactgccgcctcgtctttctcttgcggaaggacttcgaccaggctgacacctttcgccccgcggagttccactggaagctggatcagatttgtgacaaagagtggcactactatgtcatcaatgtggagtttcctgtggtaaccttatacatggatggagcaacatatgaaccatacctggtgaccaacgactggcccattcatccatctcacatagccatgcaactcacagtcggcgcttgttggcaaggaggagaagtcaccaaaccacagtttgctcagttctttcatggaagcctggccagtctcaccatccgccctggcaaaatggaaagccagaaggtgatctcctgcctgcaggcctgcaaggaagggctggacattaattccttggaaagccttggccaaggaataaagtatcacttcaacccctcgcagtccatcctggtgatggaaggtgacgacattgggaacattaaccgtgctctccagaaagtctcctacatcaactccaggcagttcccaacggcgggtgtgcggcgcctcaaagtatcctccaaagtccagtgctttggggaagacgtatgcatcagtatccctgaggtagatgcctatgtgatggtcctccaggccatcgagccccggatcaccctccggggcacagaccacttctggagacctgctgcccagtttgaaagtgccaggggagtgaccctcttccctgatatcaagattgtgagcaccttcgccaaaaccgaagcccccggggacgtgaaaaccacagaccccaaatcagaagtcttagaggaaatgcttcataacttagatttctgtgacattttggtgatcggaggggacttggacccaaggcaggagtgcttggagctcaaccacagtgagctccaccaacgacacctggatgccactaattctactgcaggctactccatctacggtgtgggctccatgagccgctatgagcaggtgctacatcacatccgctaccgcaactggcgtccggcttcccttgaggcccggcgtttccggattaagtgctcagaactcaatgggcgctacactagcaatgagttcaacttggaggtcagcatccttcatgaagaccaagtctcagataaggagcatgtcaatcatctgattgtgcagcctcccttcctccagtctgtccatcatcctgagtcccggagtagcatccagcacagttcagtggtcccaagcattgccacagtggtcatcatcatctccgtgtgcatgcttgtgtttgttgtggccatgggtgtgtaccgggtccggatcgcccaccagcacttcatccaggagactgaggctgccaaggaatctgagatggactgggacgattctgcgctgactatcacagtcaaccccatggagaaacatgaaggaccagggcatggggaagatgagactgagggagaagaggaggaagaagccgaggaagaaatgagctccagcagtggctctgacgacagcgaagaggaggaggaggaggaagggatgggcagaggcagacatgggcagaatggagccaggcaagcccagctggagtgggatgactccaccctcccctactagtgcccaggggtctgctgcccggcccacatgtcccttttgtaaaccctgacccagtgtatgcccatgtctatcatacctcacctctgatgtctgtgacatgtctgggaaggccttctccagcttcctggagcccaccctttaagccttgggcactccctgtgtttcatccatggggaagttccaagaagcccagcatggccatcagtgaggacttcagggtagactttgtcctgtagcctccacttctgccctaagttccccagcatcctgactacctgtctgcagagtttgcctttgttttttcctgcagggaagaaggcccacctttgtgtcactcacctccccaggctcagagtccccaaggccctggggttccaactcactgtgcgtctcctccacacagaccagtaggttctcctatgctgactccaggttgcttcatacaaggagggtggttgaacttcacacatctgttgttagatacatttttgtgatgagtaaactgaggcttcgtgattcaaaaaaaagtt

SEQ ID NO: 23268 - DNA, 357 bp, Homo sapiens
caacaaagttcagtgactgagagggctgagcggaggctgctgaaggggagaaaggagtgaggagctgctgggcagagagggactgtccggctcccagatgctgggcctcctggggagcacagccctcgtgggatggatcacaggtgctgctgtggcggtcctgctgctgctgctgctgctggccacctgccttttccacggacggcaggactgtgacgtggagaggaaccgtacagctgcagggggaaaccgagtccgccgggcccagccttggcccttccggcggcggggccacctgggaatctttcaccatcaccgtcatcctggccacgtatctcatgtgccgaatgtgggcct

SEQ ID NO: 23269 - DNA, 550 bp, Homo sapiens
caaatccgagactttagggtgagagccgtttgttaaacatcttccagaacaaaactgctattgccttcattcacagatgggtaaactggggcacagaaaaattgagtaatttgcccgtaatcatgcaactagtagttggtggagttgaaattttatcctaggcaacaccacctgggagcccaagctttcagtcatcatgttacactgcttatgatatgactaaaatgcattggctagatttacaaagcctgggtcccaatttgtacttgtctggtactcactgttaaagctgtctgtctcaagacatttcataagagaatgcttcacatttatctctgctatatcataaataaaatatattatgtgaaaatgcaaaataagccttgattcttttcattcctttctttccttttcctttcttcttctttctccttcccttcccttctcttttctttccctccctccctctctcctaccctccctcttttctttccttctttcctcttttctttccttttttctccttccttcgttccttccttcctccctc

SEQ ID NO: 23270 - DNA, 491 bp, Homo sapiens
ctctaaaacaaatcactgactagttttgattatttaaatgagtgaatggttttaatgatcataaaaggagacttgagctttgatgtatgctagttaaatttcagctgatttttttcaagtggagaagtgcatgctttacaggcatgcacatgcacatgcacactcatgattacggttatataatataagtgcttgaaatttattttactgtgttgttccatcatttgatttgtagtctagcatatagaattcaatatattaatcaacttgtaattttaattgctataatgctaccttatttatttaacgtagaataaaactcaactgttgtgacctctgatgcctttggtataatatatttaaaatatcagacttctaaatgctggtttgttggcatactacggctggcaagctaagtccagtctgtggcctgtttttatgtggttctgagctaagaaatctgaaaaatattcccaaagagttattaacaa

SEQ ID NO: 23271 - DNA, 5321 bp, Homo sapiens
gcctctctgggtgggtgaggggcgcgcggatccggagagggggctccgggagcggcgggaccacgcagccacctgtgagccttcggcagctgcgggcggcggcggcgtacccggcccgagacgggaggagacgctcggcggcccccgcccgccggcccgccgggcgcacacactcgcacccgcgcacgcaccgccagcaggcagcggccaccgccgcgatgctcgcccgcgggttggggaagtttcccgccggcctcggccgcgggcacccgtgctcccaggtgtagcgcccccgcgcggcgcgggcggccggcgcctccagcatgaccggccagagcctgtgggacgtgtcggaggctaacgtcgaggacggggagatccgcatcaatgtgggcggcttcaagaggaggctgcgctcgcacacgctgctgcgcttccccgagacgcgcctgggccgcttgctgctctgccactcgcgcgaggccattctggagctctgcgatgactacgacgacgtccagcgggagttctacttcgaccgcaaccctgagctcttcccctacgtgctgcatttctatcacaccggcaagcttcacgtcatggctgagctatgtgtcttctccttcagccaggagatcgagtactggggcatcaacgagttcttcattgactcctgctgcagctacagctaccatggccgcaaagtagagcccgagcaggagaagtgggacgagcagagtgaccaggagagcaccacgtcttccttcgatgagatccttgccttctacaacgacgcctccaagttcgatgggcagcccctcggcaacttccgcaggcagctgtggctggcgctggacaaccccggctactcagtgctgagcagggtcttcagcatcctgtccatcctggtggtgatggggtccatcatcaccatgtgcctcaatagcctgcccgatttccaaatccctgacagccagggcaaccctggcgaggaccctaggttcgaaatcgtggagcactttggcattgcctggttcacatttgagctggtggccaggtttgctgtggcccctgacttcctcaagttcttcaagaatgccctaaaccttattgacctcatgtccatcgtccccttttacatcactctggtggtgaacctggtggtggagagcacacctactttagccaacttgggcagggtggcccaggtcctgaggctgatgcggatcttccgcatcttaaagctggccaggcactccactggcctccgctccctgggggccactttgaaatacagctacaaagaagtagggctgctcttgctctacctctccgtggggatttccatcttctccgtggtggcctacaccattgaaaaggaggagaacgagggcctggccaccatccctgcctgctggtggtgggctaccgtcagtatgaccacagtggggtacggggatgtggtcccagggaccacggcaggaaagctgactgcctctgcctgcatcttggcaggcatcctcgtggtggtcctgcccatcaccttgatcttcaataagttctcccacttttaccggcgccaaaagcaacttgagagtgccatgcgcagctgtgactttggagatggaatgaaggaggtcccttcggtcaatttaagggactattatgcccataaagttaaatcccttatggcaagcctgacgaacatgagcaggagctcaccaagtgaactcagtttaaatgattccctacgttagccgggaggacttgtcaccctccaccccacattgctgagctgcctcttgtgcctctggcacagcccaggcaccttatggttatggtgtaaggagtatgcccagcccctgaggggagagatgcatgggatatgcacccaggtttcttttacagtttttagaatcgtttttagagggtggtgtgtctgacaccatgcctttgcacctttccatgaaatgacactcactggtctttgcatcgtgggcataaaatgttcaccttttttccagatgagtacacccagaatgctaatttttctgtccatcgtgtacgctattctagtgcttgtggcccagtactgtctatgagttgtcgtgctcctgtttctgaggttgtcgtgtgagttctgtacaaaaagcccccacaagtcgtccagtagaaatgcatctatgaggtcagcaaggatatgatgagattttgctcacagtcatgtgaaaacaaaatctcagctctttatccattgctttcacttagttttagtaccaaaacaaagagaatgcaaagttaagcagacttgaccaatgcaagtctctaagttgtttttataaatgatctgtagttccgtggcttgcatgggtgcaccaatcatctttagaacgatgtacactgatgttcatctcataaatgtcactctttagagaatgttacttagttaaacatgcagtgaagatcgaatttttttcccaagaacagatgtgttagggagaggggcttcagctaaatagtccaaaccctagggtgcttaaagccaagttagtgcaggctgagccccttggttcacagtcaagcctccttgtttcctagggtgactgtagagaaatgtatttccggatgaggtttctgatctaggccatttgaccaaactttgctgtgtctaagatattagcatgtttttgaaatatttattttttaagatgtttaggagtaaggtcgtgttgtcttcctcaactaaaaagaagtttactgttgtatcgtctccctgaggtgaacgttgttgggttgctagcaagggcagtagcttaaatacttttgttgcctactctgaaagctcatcaaatgagagccccttttatttccaagcagaatttagtcagataattttgcttctaggatatagtatgttgtatatgatgctgtgattgccctggagttcctgcccatgacatggaaacctggtggtatggaagcatgtactcaaaatatagacgtgcacgatggtggtgtggcttacccaggatggaaacactgcagttcttacttgcattcccactgcctttcatggggggtgactgggtagaggccaggagaaaggaaagagttgtaaaataaaaaactgctagttcataaaatgtcataaaaaattgtaaacttgaaaagcttaatgctattcaaaagaccttcaagcttccaaacttgtattgaagggagacgactgtttcctcctccaaaatgctcctgctcctcttgttcggttaaccagcacataacattgtgatggggaacctgggttcctctataagataattcttctccatcatctttaaggtaatctgatggttttccaggtggctttcattattgttccatctttgaaaaggcaatagaacccaggggtctgagcatggagctatccagggttttcatccaaaggttgggcctcttcttaagaggtccttttgtgtttcagttgattgaagatgatacttacctcattggaggtgtggcaaggatcttatcagaaggctttgtgttcttgtagttgtcatggctactacagtgtgggtgatttattgaatgaattcactagccacttgtgtcctggagcccccagttcaaatctttccattggactggaggcttgtgggaggctgggaggtggctgtctcctagtgtctacatccgtgtctctgaagcatcaggaaaagtgagatgacttagaggcaactgggcactgaatcagaggagcagagttatttttcagaatttgcacatggaacacttagatttggctggtgcttccagccctggaaggcataacatttacggactcatccccagctgcactgaaggcaggtggtggtacagacttatgaggacggatcagtttgccaaggctgatggtattgggtcactgagcctggtatccatggccgctgaccaggaagcttatgcaaagtggaagcaaggaacaaggcagaataactcagtcactttcatgaagatttttctaaacaagaaggcttaccaccaaaaaagaggtaccctagtggttaccctttgcagatgtgaaagctggaaaacttgacttttctttttggtaatgacttgcatttatctggtgcctttcgttggaggaatcccaacgtgctttagagactatctttttaacatctcttgtacatacatatatacttatataaaatattatcttgcccaactggacctttactcacttctgagcatgagaatgtcccaatagcattgagtttttcaagtggtggtttcagataagtgggagaaagaacaacccggctggcttaaaccctggagctaattcccacaaggaatgtagactgaatggtgacccagggagaaataatcttcctctcccctaaagtctcactaaggtttgaagtttacaggtgctctccactgggtctttgatcgaccttgctagataacatctaaccagcagtttcttttagtccctgaagctaaccagggagagtcaggttaattttctgtaaaaatatgaggtgacatctttggcaaccaggctgtcagactgacctgtaaacctcctttagggggacagagtagaaactggagatgacttgtttccagctgtgagcttgagagaagtgtcactcccagcatttgaaggttattgttttcaatgccagtgggccaaatatatgggccaggctttgatatctgtgatgtgcattttggaagtgctgggttgggaagtgacacgtctgttgcacaaatgcatattggttataggtttgtgttttctgccaaacccccacatttctcgggtttgtgagtgaggaagggcatgttgtaatgccaagctgatttgtagctcgtaaggtagtaattggtatttaacatttgcatttgttatttctacttatcttagcactcaaataattgaactacctgctaattcttgccgcatttcaaagaaaataagttgttatgcactttgggatagtggtgatctgtacaggctgtgtgttagctacttgaaggcgtaactggtatttcttgtgtgttttaacagcatgacttcttacagagctgtaatttttaaaattgaggatgccatatttgagatgtcagttttaacactcattaacacactactgtgcaagcattgacacaggctgcactgaaccattatgtctgattgctgcactttcatctctgtgcctcgattcgggaatgggcagtaatactgacacactcgggactccagcctcaaaaagtgtgcagattaaatagacaaaaattatttgcat

SEQ ID NO: 23272 - DNA, 3140 bp, Homo sapiens
gcctctctgggtgggtgaggggcgcgcggatccggagagggggctccgggagcggcgggaccacgcagccacctgtgagccttcggcagctgcgggcggcggcggcgtacccggcccgagacgggaggagacgctcggcggcccccgcccgccggcccgccgggcgcacacactcgcacccgcgcacgcaccgccagcaggcagcggccaccgccgcgatgctcgcccgcgggttggggaagtttcccgccggcctcggccgcgggcacccgtgctcccaggtgtagcgcccccgcgcggcgcgggcggccggcgcctccagcatgaccggccagagcctgtgggacgtgtcggaggctaacgtcgaggacggggagatccgcatcaatgtgggcggcttcaagaggaggctgcgctcgcacacgctgctgcgcttccccgagacgcgcctgggccgcttgctgctctgccactcgcgcgaggccattctggagctctgcgatgactacgacgacgtccagcgggagttctacttcgaccgcaaccctgagctcttcccctacgtgctgcatttctatcacaccggcaagcttcacgtcatggctgagctatgtgtcttctccttcagccaggagatcgagtactggggcatcaacgagttcttcattgactcctgctgcagctacagctaccatggccgcaaagtagagcccgagcaggagaagtgggacgagcagagtgaccaggagagcaccacgtcttccttcgatgagatccttgccttctacaacgacgcctccaagttcgatgggcagcccctcggcaacttccgcaggcagctgtggctggcgctggacaaccccggctactcagtgctgagcagggtcttcagcatcctgtccatcctggtggtgatggggtccatcatcaccatgtgcctcaatagcctgcccgatttccaaatccctgacagccagggcaaccctggcgaggaccctaggttcgaaatcgtggagcactttggcattgcctggttcacatttgagctggtggccaggtttgctgtggcccctgacttcctcaagttcttcaagaatgccctaaaccttattgacctcatgtccatcgtccccttttacatcactctggtggtgaacctggtggtggagagcacacctactttagccaacttgggcagggtggcccaggtcctgaggctgatgcggatcttccgcatcttaaagctggccaggcactccactggcctccgctccctgggggccactttgaaatacagctacaaagaagtagggctgctcttgctctacctctccgtggggatttccatcttctccgtggtggcctacaccattgaaaaggaggagaacgagggcctggccaccatccctgcctgctggtggtgggctaccgtcagtatgaccacagtggggtacggggatgtggtcccagggaccacggcaggaaagctgactgcctctgcctgcatcttggcaggcatcctcgtggtggtcctgcccatcaccttgatcttcaataagttctcccacttttaccggcgccaaaagcaacttgagagtgccatgcgcagctgtgactttggagatggaatgaaggaggtcccttcggtcaatttaagggactattatgcccataaagttaaatcccttatggcaagcctgacgaacatgagcaggagctcaccaagtgaactcagtttaaatgattccctacgttagccgggaggacttgtcaccctccaccccacattgctgagctgcctcttgtgcctctggcacagcccaggcaccttatggttatggtgtaaggagtatgcccagcccctgaggggagagatgcatgggatatgcacccaggtttcttttacagtttttagaatcgtttttagagggtggtgtgtctgacaccatgcctttgcacctttccatgaaatgacactcactggtctttgcatcgtgggcataaaatgttcaccttttttccagatgagtacacccagaatgctaatttttctgtccatcgtgtacgctattctagtgcttgtggcccagtactgtctatgagttgtcgtgctcctgtttctgaggttgtcgtgtgagttctgtacaaaaagcccccacaagtcgtccagtagaaatgcatctatgaggtcagcaaggatatgatgagattttgctcacagtcatgtgaaaacaaaatctcagctctttatccattgctttcacttagttttagtaccaaaacaaagagaatgcaaagttaagcagacttgaccaatgcaagtctctaagttgtttttataaatgatctgtagttccgtggcttgcatgggtgcaccaatcatctttagaacgatgtacactgatgttcatctcataaatgtcactctttagagaatgttacttagttaaacatgcagtgaagatcgaatttttttcccaagaacagatgtgttagggagaggggcttcagctaaatagtccaaaccctagggtgcttaaagccaagttagtgcaggctgagccccttggttcacagtcaagcctccttgtttcctagggtgactgtagagaaatgtatttccggatgaggtttctgatctaggccatttgaccaaactttgctgtgtctaagatattagcatgtttttgaaatatttattttttaagatgtttaggagtaaggtcgtgttgtcttcctcaactaaaaagaagtttactgttgtatcgtctccctgaggtgaacgttgttgggttgctagcaagggcagtagcttaaatacttttgttgcctactctgaaagctcatcaaatgagagccccttttatttccaagcagaatttagtcagataattttgcttctaggatatagtatgttgtatatgatgctgtgattgccctggagttcctgcccatgacatggaaacctggtggtatggaagcatgtactcaaaatatagacgtgcacgatggtggtgtggcttacccaggatggaaacactgcagttcttacttgcattcccactgcctttcatggggggtgactgggtagaggccaggagaaaggaaagagttgtaaaataaaaaactgctagttcata

SEQ ID NO: 23273 - DNA, 1739 bp, Homo sapiens
  misc_feature (581)..(581): n is a, c, g, or t
attttataacccattattttaaaacagtaaacactttttaaacatctaagaattattgttataaaacaatatttaattttttaaaatataaaataattgaattattgtctttctctaagctatttagagaacactactttctttgttttgttttggtttggttttttgagacggagtgtccgtctgtcgcccaggctggagtgccagtggcgcgatctcggctcactgcaagctccacctcttgggttcacaccattctcctgcgtcaacctcgcgagtagctgggactagaggcgcccgccaccacgcctggctaattttttgtatttttagcagagacggggtttcaccgtgttagccactttctttgttaatttaactgttattttaagttcagggatacatgtgcgggtttgttatacaggtaatcttgtgtcatgagagttttttttgcacggattatttcatcacccaggtattaaacctagcaccagttatttttcctgattctctccctcctcctacccagcaccctctgataggccccaatgtgtgttgtttccctctatgtgttcatgtgntctcatcatttagctcccacttataagtgagaacatgtggtatttggttttctcttcctgcattagtttgctaaggataatagcctccagctccatccatgtccctgcaaatgacatgatctcattctttcatatggctggatagtacttcatggtgtatacatacattttctttatccagtctacagttgatgggcatttaggtttattccatgtctttgctactgtgaataatgctgcattgaacatacgtgtgcatgtatctttataataaaacaatttatatttcttgggtatatacccattaatgggattgctggatccagtggtatttctgtttttaggtctttgaggaattgccacactctcacatggctgaactaatttacactcccagtatcagtgtatatgcgttccaattgctccataacttcgccagcatctgctttttttttttgctttttaataatagccattctgactagtgtgagatggtatctcattatggttttgatttgcgtttctctaatgatcagtgatattgaggctttttttcatatcattgttggctgcatgtatgttttcttttgaaaagtgtctgttcatatcctttgcccactttttaatgggatttttttttcttgtaaatttgtttaagtttcttatagatgctggaatattagacttttgtagatgtatagtttgcaaatattttcccccaatctgtaggttgtctgttcactctgttgataggttcctttgctctgacaaagctctagagtttaattagatcccatttgccaatttttgctttcgttgcaaccaccttttgtgtcttcatcatgaaatctttgcctgttagaaaacactactttcagacatttaaatgcatataggcaatgcttaagtacctaaaaaagcaattttaagaaattactgaggtatctctattaagagtgacatattcatattttattttatgtatatattatttctataacatacaagaaattgttgcatttatcattttaatgcaaagtagtatcaagtataatggattagatgcaaaaataactgaggtaggaatctcagttctgtgttttaatgtggaattcttatgcttattaaaatattttgattagctgttgcaaaaaaaaa

SEQ ID NO: 23274 - DNA, 374 bp, Homo sapiens
caggaagccttccatgacttgcccctccctctgccttgccaccaattctttggactcccacagaccctgtatttccttttgtcacagcattgaccctctgtgttacttggaggcacacaagttcgtttgtttttgtctgctgctttttgactgtaagctccttgaggagacccactgtctcttgttacatctatgcccagcatcatgcctgacacacatgaagggctgtggcattgatggaaggggcctatagggactgcaggtctcaaggttatactgtggcaaccagttaatcctcaaatcctgttgtgacttaatacaacaaagatttgtttctccttaacatgatgtcttctgtggagccagcagctctc

SEQ ID NO: 23275 - DNA, 122 bp, Homo sapiens
tggggcaacaggaacactaaagttaaccctttaggtggtcattcaacatgaaggtcttcacacaaactgtaaaaagaggataatggccccagacctgtgcctggctcctaattttttctttt

SEQ ID NO: 23276 - DNA, 183 bp, Homo sapiens
cttatccatcttcatacccaggacagactgacttacccttgcaaaacactttactctggtatctgttaatgatccctcaggccattgctacttgtttattccaagagtatcacggacaatttcctgatttaactcttctaaacttttctcacttacaaaaaacgctgcaagtctggactttgg

SEQ ID NO: 23277 - DNA, 275 bp, Homo sapiens
ttttgaacccttcctttcctacctttagacctgtttcatcacttcctctgtatctgtaatgtagcagtccctccacagggcttgttttccaaagaaaagtaagccctccacagggcttgttttccaaagaaaagtatcatttggaggagcaaagttataagcctacctaagcatgtcgtaaagctgttcaaaaataactcagagctagtcttgtggatggaaatgtagtgcctgagtcacattctgcttaaagttgtaacaaatacagatgagtt

SEQ ID NO: 23278 - DNA, 337 bp, Homo sapiens
gctatgtggcttgctcaaccaacacttgagcaagtttaaatattccagaggctggaagtctgaaatcagagtgtcagcattattgggttctggtgagggccctcctcctgatttcttcatgggggagagtgagagtagggtggaggatggtgtagagaaaaaggaaaagggagagaaagagagagagagaatgcttcagtgcacgttctctcatgcctcttcttataaggacatgaatctcctcatgagggctccaccttcatgacctaagtacttcccaaagcccctatctcttaataccaacccattgggagttagaactacagcatatgaattt

SEQ ID NO: 23279 - DNA, 581 bp, Homo sapiens
cgtctgcctggcttttatcagtgattaatgagagcagtttgctgcttttaaggagaagtggagttttgggaaacagctaaaaattctttggagcaagttctagtgaatgaatgctttaataacgtacttttagtacatttaagtattttttgtttttaaaaacagtgggaataaactaatggctctagtttgtaaacaaagatctctaaaaggaagtggacactctaagtgatatcatcttcttaaggtggctcttgtgtaggctcttttaaaacatcccagtggttgtgtgagtgtgttggttgaaaaaccagtctcctactttgtaggaggctggtctgtcagggcccttctcttgcctggggttcagaatttctgcttttgcattgatggtaaaagttggccttggtcctgctgtttctgccagggtagcatttgtcagagcagagtccaggcagccccaccatgtcccctggagcctgtgggcagcatttctcctggcagcagttctgagattggtggtggtactgttggcagcctgacggttaccagaaaagaggtatagaattttctctctttcc

SEQ ID NO: 23280 - DNA, 433 bp, Homo sapiens
aatttagcagggagtataatgcaggccctgaccaactgaaattcatgctaacatccacctactaagattggaccaatacctaccaagtaaatatcaactgtactcagagggcttcacatcgtcctgtcacctcgggatatttccatctaaacactttcctctgtttggaatgcttttgctccaagcaagagtctcatcttccttaagtctttactaagaaattatcttctcagaaagctttcccctgactactcaacttaaaattgcaggtcttcctgaccccaaatcctggccttccttaggaacactgatcaccaaatgtcatactacacattttacataaatatcttgtttattgtctctcttccccactataatgaatccccacaagaatagactttttttttttactcctatacccatcacttagaac

SEQ ID NO: 23281 - DNA, 464 bp, Homo sapiens
gaccctctttggtggtcaaattagaattcaaccccagttaaatcctgactctcaatccagtattcttcctcctatttcatgaaatccctgcatatatacacacatatacatacatacatacatatgtacataacccacctctctctctagaattgaggctgtagtctccaaacagaatttccaaaaatttgattccagtgtgcccctattagaattccaaaacagcaatcttcccagcacaatcaagggacacaattcctgctatctgggatgatatttttggcagctttgcagtgcagtcccctgtatggcactgctgctgaagaagcgggcaggcagctactctgtattgtcataggcttttgctgtgttggtgaatggcttttttcaggtgctataatttccttcacttgctatatgggccacctgcctctaccttctcattcctccaatccatccaccac

SEQ ID NO: 23282 - DNA, 2501 bp, Homo sapiens
  misc_feature (712)..(712): n is a, c, g, or t
  misc_feature (760)..(760): n is a, c, g, or t
tttatgatgaacgctggaaggaaaagcaggaacagggcttcacttggtggttaaattttatattaacccctgatgacttcactgtaaaaacaaatatttctgaagtaaatgctgctactcttcttttgggaatagagaatcaacataaaataagtgttcctagagcacctacaaaagaggaaatgtctctcagagcttatactgctcggtgtaggttaaacagactacgtcgtgcagcatgccgtttgtttacttctgaaaaaatggttaaagctattaaaaagcttgaaattgaaattgaagctaggcggttaattgttcgaaaagatagacacctatggaaagatgtgggagaacgtcagaaagtcctgaattggctgttgtcctacaatcctttgtggcttcgaattggtctagagacaacttatggagaactcatatctttggaagataacagtgatgtcacagggttggctatgtttattctgaatcgcctactttggaatcctgatatagcagctgagtatagacaccccactgttcctcacctgtatagagatggtcatgaagaagctttgtccaagtttacattgaaaaagttattgttgttggtctgttttcttgattatgctaaaatttccagactcattgatcatgatccttgtctcttctgtaaagatgccgaattcaaggctagtaaagaaatcctttnggctttttcacgagatttcctaagtggtgaaggtgacctttcccgtcnccttggcttattgggattacctgttaaccatgttcagacaccatttgatgaatttgattttgccgttacaaatcttgccgtagacttgcaatgtggagtgcgccttgtgcgaaccatggaacttctcacacagaactgggacctctcaaagaaactcaggattccggcaataagtcgtcttcaaaagatgcacaatgttgacattgttcttcaagttcttaaatcacgaggaattgaattaagtgatgagcatggaaatacaattctatctaaggatattgtggataggcacagagaaaaaactctcaggttgctttggaaaatagcgtttgcttttcaggtggatatttcccttaacttagatcaattaaaggaagaaattgcctttctaaaacacacaaagagtataaagaaaacaatatctctactatcatgccattctgatgatcttattaataagaaaaaaggcaaaagggatagtggttcctttgaacaatatagtgaaaacataaagttattgatggattgggtaaatgctgtttgtgccttctataataaaaaggtggagaattttacagtgtctttctcagacggccgtgtgttatgttacctgatccaccattaccatccttgctatgtgccatttgacgctatatgtcagcgtactactcaaactgtggaatgtacgcaaactggttcagtggtattaaattcatcatctgaatctgatgacagttctctggatatgtcacttaaagcatttgatcatgaaaatacttcagagctatacaaagagctcctagaaaatgaaaagaaaaattttcacttggttaggtctgcagttagagaccttggtggaatacctgctatgattaatcattcagatatgtcaaatacaattccagatgaaaaggtggttattacctatttgtcatttctttgtgcaaggcttttggatcttcgtaaagaaataagagctgctcgactcatacaaacaacatggagaaaatataaactaaaaacagatctcaaacgccatcaggtactcctagaatatgaaactactatagtgtgaattatactttagaaggagagagagaaagctgcaagaattattcaattggctgtaatcaattttctagcaaaacaaagattgagaaaaagagttaatgcagcactcgtcattcagaaatattggcgaagagtcttagcacagagaaaattattaatgttaaaaaaggaaaagctggaaaaagttcaaaataaagcagcatcacttattcagggatattggagaagatattccactagacaaagatttctgaaattgaaatattattcaatcatcctgcaatctaggataagaatgataattgctgttacatcttataaacgatatctttgggctacagttacaattcagaggcattggcgtgcttatttaagaagaaaacaagatcaacaaagatatgaaatgctaaaatcatcaactcttataatccaatctatgttcagaaaatggaagcaacgtaaaatgcaatcacaagtaaaagctacagtaatattgcaaagagcttttagagaatggcatttaagaaaacaagctaaagaagaaaattctgctattatcatacaatcatggtatagaatgcataaagaattacggaaatatatttatattagatcttgtgttgttatcattcagaaaagatttcggtgctttcaagcccaaaagttatat

SEQ ID NO: 23283 - DNA, 2453 bp, Homo sapiens
  misc_feature (712)..(712): n is a, c, g, or t
  misc_feature (760)..(760): n is a, c, g, or t
tttatgatgaacgctggaaggaaaagcaggaacagggcttcacttggtggttaaattttatattaacccctgatgacttcactgtaaaaacaaatatttctgaagtaaatgctgctactcttcttttgggaatagagaatcaacataaaataagtgttcctagagcacctacaaaagaggaaatgtctctcagagcttatactgctcggtgtaggttaaacagactacgtcgtgcagcatgccgtttgtttacttctgaaaaaatggttaaagctattaaaaagcttgaaattgaaattgaagctaggcggttaattgttcgaaaagatagacacctatggaaagatgtgggagaacgtcagaaagtcctgaattggctgttgtcctacaatcctttgtggcttcgaattggtctagagacaacttatggagaactcatatctttggaagataacagtgatgtcacagggttggctatgtttattctgaatcgcctactttggaatcctgatatagcagctgagtatagacaccccactgttcctcacctgtatagagatggtcatgaagaagctttgtccaagtttacattgaaaaagttattgttgttggtctgttttcttgattatgctaaaatttccagactcattgatcatgatccttgtctcttctgtaaagatgccgaattcaaggctagtaaagaaatcctttnggctttttcacgagatttcctaagtggtgaaggtgacctttcccgtcnccttggcttattgggattacctgttaaccatgttcagacaccatttgatgaatttgattttgccgttacaaatcttgccgtagacttgcaatgtggagtgcgccttgtgcgaaccatggaacttctcacacagaactgggacctctcaaagaaactcaggattccggcaataagtcgtcttcaaaagatgcacaatgttgacattgttcttcaagttcttaaatcacgaggaattgaattaagtgatgagcatggaaatacaattctatctaaggatattgtggataggcacagagaaaaaactctcaggttgctttggaaaatagcgtttgcttttcaggtggatatttcccttaacttagatcaattaaaggaagaaattgcctttctaaaacacacaaagagtataaagaaaacaatatctctactatcatgccattctgatgatcttattaataagaaaaaaggcaaaagggatagtggttcctttgaacaatatagtgaaaacataaagttattgatggattgggtaaatgctgtttgtgccttctataataaaaaggtggagaattttacagtgtctttctcagacggccgtgtgttatgttacctgatccaccattaccatccttgctatgtgccatttgacgctatatgtcagcgtactactcaaactgtggaatgtacgcaaactggttcagtggtattaaattcatcatctgaatctgatgacagttctctggatatgtcacttaaagcatttgatcatgaaaatacttcagagctatacaaagagctcctagaaaatgaaaagaaaaattttcacttggttaggtctgcagttagagaccttggtggaatacctgctatgattaatcattcagatatgtcaaatacaattccagatgaaaaggtggttattacctatttgtcatttctttgtgcaaggcttttggatcttcgtaaagaaataagagctgctcgactcatacaaacaacatggagaaaatataaactaaaaacagatctcaaacgccatcaggagagagagaaagctgcaagaattattcaattggctgtaatcaattttctagcaaaacaaagattgagaaaaagagttaatgcagcactcgtcattcagaaatattggcgaagagtcttagcacagagaaaattattaatgttaaaaaaggaaaagctggaaaaagttcaaaataaagcagcatcacttattcagggatattggagaagatattccactagacaaagatttctgaaattgaaatattattcaatcatcctgcaatctaggataagaatgataattgctgttacatcttataaacgatatctttgggctacagttacaattcagaggcattggcgtgcttatttaagaagaaaacaagatcaacaaagatatgaaatgctaaaatcatcaactcttataatccaatctatgttcagaaaatggaagcaacgtaaaatgcaatcacaagtaaaagctacagtaatattgcaaagagcttttagagaatggcatttaagaaaacaagctaaagaagaaaattctgctattatcatacaatcatggtatagaatgcataaagaattacggaaatatatttatattagatcttgtgttgttatcattcagaaaagatttcggtgctttcaagcccaaaagttatat

SEQ ID NO: 23284 - DNA, 225 bp, Homo sapiens
ggcgctttcccgcttctgtgtcgtattaaccacttaacactggtcagggccacccggcggcatctctccaactgcattgcaaatgatgacggctggaaccacagctgcctccccctcccccggcgtctcagcacccagcacgggtgaacgaggtgggaagaccctgttaagccacaagccgtctccctctgatcacaaggcctgctcccgggaacaccaggccac

SEQ ID NO: 23285 - DNA, 301 bp, Homo sapiens
ctgggttcttgtcccagttctgtcatgaaccagctgtgtaactttaggtaaggaacttgacctctctgggccttggcttcctccatgcaaatctggatgctgggtatgacctccaatgacctctagttctaaaaggctacagttctaaatcttaaaattagccattcttgccagtgtcactttgaactttagccattagtctccacagagatagacacattttagcgtagtagcctctagaatgaaatctattaaaaggttcaatatgctaatgcaagcagtggaaagatacaagcctcaa

SEQ ID NO: 23286 - DNA, 404 bp, Homo sapiens
agcctggcaaatcccaactcatccttcacgaattgactcaggtggcagccactgtccctccacatgtcccttgccctctgcacgccagtcctccacacatgataccatcttctggtcagtacaccatcagatggtgggctccagagggtagtgggaaccactgagcgtttctgtctgcagccccagcaccaggtggtgctagtcgaaggatggagaatgcttagcagctgaggtgcacagcatcgtcccgatggcctctcaggctggagctatgggatctggaacccccagcagtaattccccatcagttgagatggggcacaaggcaatgccccctccccggaggccaacctccaggcagcttcttttcctctgaccactgtggctttggcctctttagagga

SEQ ID NO: 23287 - DNA, 2107 bp, Homo sapiens
gctgagacagcaccacccaacttcgttcaacgactgcagagcatgaccgtgagacaaggaagccaagtgagactccaagtgagagtgactggaatccctacacctgtggtgaagttctaccgggatggagccgaaatccagagctcccttgatttccaaatttcacaagaaggcgacctctacagcttactgattgcagaagcataccctgaggactcagggacctattcagtaaatgccaccaatagcgttggaagagctacttcgactgctgaattactggttcaaggtgaagaagaagtacctgctaaaaagacaaagacaattgtttcgactgctcagatctcagaatcaagacaaacccgaattgaaaagaagattgaagcccactttgatgccagatcaattgcaacagttgagatggtcatagatggtgccgctggggaacagctgccacataaaacacctcccaggattcctccgaagccaaagtcaagatccccaacaccaccgtctattgctgccaaagcacagctggctcggcagcagtccccatcgcccataagacactccccttccccggtcagacacgtgcgggcaccgaccccatctccggtcaggtccgtgtctccagcagcaagaatctccacatcccccatcaggtctgttaggtctccattgctcatgcgtaagactcaggcatccaccgtggccacaggtcctgaagtgcctcccccttggaagcaagagggctacgtggcctcctcatctgaggctgagatgagagagacaacgctgacaacctctactcagatcaggacagaagagagatgggaagggagatacggtgtccaggagcaagtgaccatcagtggtgctgcgggtctgccgccagtgtgtcggccagtgcttagctacgcagcagaggctgttgccactggtgctaaagaggtgaaacaagatgctgacaaaagtgcagctgttgcgactgttgttgctgccgttgatatggccagagtgagagaaccagtgatcagcgctgtagagcagactgctcagaggacaaccacgactgctgtgcacatccaacctgctcaagaacaggtaagaaaggaagcggagaagactgctgtaactaaggtagtagtggccgccgataaagccaaggaacaagaattaaaatcaagaaccaaagaagtaattaccacaaagcaagagcagatgcacgtaactcatgagcagataagaaaagaaactgaaaaaacatttgtaccaaaggtagtaatttccgcagctaaagccaaagaacaagaaactagaatttctgaagaaattactaagaaacagaaacaagtaactcaagaagcaatgagaaaggaagccgagaaaactgccttgtctacaatagcagttgctactgctaaagccaaagaacaagaaacaatactgagaactagagaaactatggctactagacaagaacaaatccaagttacccatggaaaggtggacgttggaaaaaaggctgaagctgtagcaacagttgttgctgcagtagaccaggcccgagtcagagagcccagagagcctgggcatcttgaagaatcctatgctcagcagaccactttggagtacggatataaggaacgcatttccgccgcaaaggtagctgagcctccccaacgtccagcctcagaaccccacgttgtccctaaagcagtcaagcctagagtaatccaggctccttctgagactcatatcaaaactactgatcaaaagggaatgcacatatcatcacagatcaagaaaactacagatctaacaacggaaagattagtccatgtggataaacgcccccgcacagctagccctcactttactgtttcaaaaatttctgttcctaagacagaacatggatatgaggcatcaatagccggtagtgctattgccacattacaaaaagagttgtcagccacatcttctgctcagaagatcaccaaatcggtgaaggctcctactgtgaagcccagtgagactagagtaagggcagagcccacacccttgccacagttccccttcgctgacacaccagatacttacaagagtg

SEQ ID NO: 23288 - DNA, 368 bp, Homo sapiens
agcccattcctcaggaaagcagtctatgtattaagcacaagtgtaggcccctgaaatggaaatctgacattttatcgttcaccactaagcatcctgtattttcctgagtgtttcaaggatgtcttcccattgcttttgtatcttttgaaactcaaatctttattttactctaaacatcagataagacaggaaactgagataactgctgcatccatggtggtagttgccactgcaaagtccacaaaactagaaacagtcccgggagctcaagaagaaactaccacacaacaagatcaaatgcacctaagttatgaaaaggtgatgacttcctgccaatgtgaaagtcactcttgcaccatttcatttgc

SEQ ID NO: 23289 - DNA, 2383 bp, Homo sapiens
gctgagacagcaccacccaacttcgttcaacgactgcagagcatgaccgtgagacaaggaagccaagtgagactccaagtgagagtgactggaatccctacacctgtggtgaagttctaccgggatggagccgaaatccagagctcccttgatttccaaatttcacaagaaggcgacctctacagcttactgattgcagaagcataccctgaggactcagggacctattcagtaaatgccaccaatagcgttggaagagctacttcgactgctgaattactggttcaaggtgaagaagaagtacctgctaaaaagacaaagacaattgtttcgactgctcagatctcagaatcaagacaaacccgaattgaaaagaagattgaagcccactttgatgccagatcaattgcaacagttgagatggtcatagatggtgccgctggggaacagctgccacataaaacacctcccaggattcctccgaagccaaagtcaagatccccaacaccaccgtctattgctgccaaagcacagctggctcggcagcagtccccatcgcccataagacactccccttccccggtcagacacgtgcgggcaccgaccccatctccggtcaggtccgtgtctccagcagcaagaatctccacatcccccatcaggtctgttaggtctccattgctcatgcgtaagactcaggcatccaccgtggccacaggtcctgaagtgcctcccccttggaagcaagagggctacgtggcctcctcatctgaggctgagatgagagagacaacgctgacaacctctactcagatcaggacagaagagagatgggaagggagatacggtgtccaggagcaagtgaccatcagtggtgctgcgggtctgccgccagtgtgtcggccagtgcttagctacgcagcagaggctgttgccactggtgctaaagaggtgaaacaagatgctgacaaaagtgcagctgttgcgactgttgttgctgccgttgatatggccagagtgagagaaccagtgatcagcgctgtagagcagactgctcagaggacaaccacgactgctgtgcacatccaacctgctcaagaacaggtaagaaaggaagcggagaagactgctgtaactaaggtagtagtggccgccgataaagccaaggaacaagaattaaaatcaagaaccaaagaagtaattaccacaaagcaagagcagatgcacgtaactcatgagcagataagaaaagaaactgaaaaaacatttgtaccaaaggtagtaatttccgcagctaaagccaaagaacaagaaactagaatttctgaagaaattactaagaaacagaaacaagtaactcaagaagcaataagacaggaaactgagataactgctgcatccatggtggtagttgccactgcaaagtccacaaaactagaaacagtcccgggagctcaagaagaaactaccacacaacaagatcaaatgcacctaagttatgaaaagataatgaaggaaactaggaaaacagttgtacctaaagtcatagttgccacacccaaagtcaaagaacaagatttagtatcaagaggtagagaaggcattactaccaaaagagaacaagtgcaaataactcaggagaagatgagaaaggaagccgagaaaactgccttgtctacaatagcagttgctactgctaaagccaaagaacaagaaacaatactgagaactagagaaactatggctactagacaagaacaaatccaagttacccatggaaaggtggacgttggaaaaaaggctgaagctgtagcaacagttgttgctgcagtagaccaggcccgagtcagagagcccagagagcctgggcatcttgaagaatcctatgctcagcagaccactttggagtacggatataaggaacgcatttccgccgcaaaggtagctgagcctccccaacgtccagcctcagaaccccacgttgtccctaaagcagtcaagcctagagtaatccaggctccttctgagactcatatcaaaactactgatcaaaagggaatgcacatatcatcacagatcaagaaaactacagatctaacaacggaaagattagtccatgtggataaacgcccccgcacagctagccctcactttactgtttcaaaaatttctgttcctaagacagaacatggatatgaggcatcaatagccggtagtgctattgccacattacaaaaagagttgtcagccacatcttctgctcagaagatcaccaaatcggtgaaggctcctactgtgaagcccagtgagactagagtaagggcagagcccacacccttgccacagttccccttcgctgacacaccagatacttacaagagtg

SEQ ID NO: 23290 - DNA, 1969 bp, Homo sapiens
gctgagacagcaccacccaacttcgttcaacgactgcagagcatgaccgtgagacaaggaagccaagtgagactccaagtgagagtgactggaatccctacacctgtggtgaagttctaccgggatggagccgaaatccagagctcccttgatttccaaatttcacaagaaggcgacctctacagcttactgattgcagaagcataccctgaggactcagggacctattcagtaaatgccaccaatagcgttggaagagctacttcgactgctgaattactggttcaaggtgaagaagaagtacctgctaaaaagacaaagacaattgtttcgactgctcagatctcagaatcaagacaaacccgaattgaaaagaagattgaagcccactttgatgccagatcaattgcaacagttgagatggtcatagatggtgccgctggggaacagctgccacataaaacacctcccaggattcctccgaagccaaagtcaagatccccaacaccaccgtctattgctgccaaagcacagctggctcggcagcagtccccatcgcccataagacactccccttccccggtcagacacgtgcgggcaccgaccccatctccggtcaggtccgtgtctccagcagcaagaatctccacatcccccatcaggtctgttaggtctccattgctcatgcgtaagactcaggcatccaccgtggccacaggtcctgaagtgcctcccccttggaagcaagagggctacgtggcctcctcatctgaggctgagatgagagagacaacgctgacaacctctactcagatcaggacagaagagagatgggaagggagatacggtgtccaggagcaagtgaccatcagtggtgctgcgggtctgccgccagtgtgtcggccagtgcttagctacgcagcagaggctgttgccactggtgctaaagaggtgaaacaagatgctgacaaaagtgcagctgttgcgactgttgttgctgccgttgatatggccagagtgagagaaccagtgatcagcgctgtagagcagactgctcagaggacaaccacgactgctgtgcacatccaacctgctcaagaacaggtaagaaaggaagcggagaagactgctgtaactaaggtagtagtggccgccgataaagccaaggaacaagaattaaaatcaagaaccaaagaagtaattaccacaaagcaagagcagatgcacgtaactcatgagcagataagaaaagaaactgaaaaaacatttgtaccaaaggtagtaatttccgcagctaaagccaaagaacaagaaactagaatttctgaagaaattactaagaaacagaaacaagtaactcaagaagcagtggacgttggaaaaaaggctgaagctgtagcaacagttgttgctgcagtagaccaggcccgagtcagagagcccagagagcctgggcatcttgaagaatcctatgctcagcagaccactttggagtacggatataaggaacgcatttccgccgcaaaggtagctgagcctccccaacgtccagcctcagaaccccacgttgtccctaaagcagtcaagcctagagtaatccaggctccttctgagactcatatcaaaactactgatcaaaagggaatgcacatatcatcacagatcaagaaaactacagatctaacaacggaaagattagtccatgtggataaacgcccccgcacagctagccctcactttactgtttcaaaaatttctgttcctaagacagaacatggatatgaggcatcaatagccggtagtgctattgccacattacaaaaagagttgtcagccacatcttctgctcagaagatcaccaaatcggtgaaggctcctactgtgaagcccagtgagactagagtaagggcagagcccacacccttgccacagttccccttcgctgacacaccagatacttacaagagtg

SEQ ID NO: 23291 - DNA, 457 bp, Homo sapiens
atgacaccagtatctaaagttaggccttcccacagaccatccaagcatacatgctgggtgcacgcctgtcggggagggtagactccacagcgtggtcctttgggtaagagcgcccctttctacctgggctaccctctgccttttctggggcagacccttatttccatatccttgaaaatgtccaccagtagaataatttatgcttaattgggtgtcttacaagacatcttgattattttttaacatgtggcaatgcagcacttttcctttggaaggggaaaacaattttttctctgttattgtccaatatttcagaccattttaaaaaaccaagtttgcagtaagaacaacccccacccttccaccacccaccttaaggcatgtcctaaaaaaagacttaaattcatagtaatctggtggaggagatgactcacagcttcccttggagcttgatggc

SEQ ID NO: 23292 - DNA, 311 bp, Homo sapiens
gatcatagtcttcatcagattgaaacacaactggtgaataagttagagcaatatactaacattgatacaagttctgaggatccagggaatactgaatcgggcatcctggagcttaaacttaaagccctaattcttgacattatccataatattgatgtggtaaagcagttaaaccaaattcaggttcatacaactgaagactgggcttggaaaaaacaacttagattctatatgaaaagtgatcatacatgttgtgttcaaatggtggattctgaatttcagtatacttatgaatatcaggtatgagttgt

SEQ ID NO: 23293 - DNA, 491 bp, Homo sapiens
aacaaaatctacaaagttacaacccaaattatacaagacatcaaaacactcagtaaacaaatatatatatttcacctacttaaatcttattcatattaattataggccttttgtttagtacactggttattttttaaggaaccaatttaaactttcaattttaaatacatctatgctgacgatagacttttgggtatatacaaccttcttcttctcttttaaaagttaaatacattccactattaactgaacttccatgaagcaacattaattttagagcatggtagtccataatcagtggttcattgtgatgtgctttatccaacatgtatcttagtgcatggttgaggatgtactatgtgatattttagttaacagtgtggcatttgtgggactatattaaaagcatatccaaactaccaagctataccaagctgaggtaggtaacacctgcatgtgaaaaactgtgatatgaatcttatttataaaaa

SEQ ID NO: 23294 - DNA, 387 bp, Homo sapiens
tacaacaaagaaaatgaacaaatttgagctacatagataataatactcacaaatgtgagaggaattatcaagatggaaaaatacattcagtataatctcatttacataaagttcaagaaaaatatttttaatatattgtaatttgttacattggtgataaaactctacagtgaaacatatgagtgatcatcataacaattgggataatcaggagggaggagataaacgggaaatatcagcaagaagacatatattgggagtgtctggattactggcaaattctattttctgaccaaggtgtggtaacatcgatgttaatgttataattttttctcttactgtttattaggttttattatgctccatatgtaagttatgctccccaat

SEQ ID NO: 23295 - DNA, 2256 bp, Homo sapiens
tctccccgcccgccggcccctccagcctcctccaaggcggcggaccaggccgggccggagttttcggggttcagcccgcgagcgggaggaccggggaggcgagggaggaggaaggcgagaagggccagatcgcgggagagcccaatcacggggcgagctggacctggctgtgatcatttataatccttgactcctccgctccgccacttgtcaagatgacaggggtcatccgtgaataacacttcacgctgatgaatggctcttgccggctttcggctctgatgaggggtctgcccgccgccgattgaaaacactaatgaacttactgcgccatttgaaattcacacgcaccaacaaaatggggggtgggcatttcaggtcagctgagtcacccgaggaggtggcagtgcaagacactgccgggaagacggattccgaggcagaagggtgtaattaaggatttccacccccggtaggcggcccgtcctttgcagagcctctgaaaatgacccgcgccttcctttccacagtgttctttcgtccgagaccgaaaagcgcaaatgacctttggacagggaagggaggcagtaaacactcagacttccttaccagcccctggtgggcactgcagcagaacaattgtctgccccccaggttcaagcacctaggcctccgccccgcatcacctggccaggggcggacccgggagtcctccgaaggctccactccccacttttactactcttctttcctctccattctcccctcagattagcggccggacactgtccctgcctcgattttgtttgctgtgggagggaaaaaaaaagtttgctgctcctcccaagacactggccactttctactcactgaagttcccaccgcagcgctggctcccggctccctagctcccgccccctgtctgcaggaaagccctcccccggagcttccgaaactgctggaggttccagagttttgtagctccgaatgggcgacctgagccgaaccgctctctggctgggtggtcggcgggatccttcaggctcctttcgggtccgggacggggcggcggcagaggtggggcgtgcgtgcttggggctgccgagtgagtgcggctccctggtgcgcgcccgagcatctccccgccctctcctgggaccagcagtctgcccgtggagggctaggagcccgcgaccaggcctgccccggccgtcgccaacctgtccttggaagcgtggcggagactggtgcgctctcagcctcgtcgcgccagccgcctcgcgccaccctccactttcagcttcagagcagaggattccgccgacctccacctgtacctgtactcggccgttaggaaatccacttgcatttttaactaccgtgcagaaccagaaacagatcgagcactgggagaacaaggacgacgcctcctaggaaagcctgaacctttatgttagtttatccaaagtttgggctagaagtgaggagaatccctaaactcgaggtggtgtgcccagacccacagcccgtgttcccgaagttgctaagtgcccgagcgcagcgcgttaagtagagaagtcttggtagtaagcgaacccgacccggctctcggggcgctagtgacggaaagcagcacgcatatctttgcgggaagaatctagagtcgccctgggatagatccatctccttctgccactgaatttcacacttgaaaaagataaggtcatgggggcggatgaatgatatccctcactcatttagccattcttattattatataaaaaaaaggcttgtcaattatgaaggtgtgtcccagatattacatgaagatcatgcaaactacttgaaatttgaatccggacatgatcgtaaggaaactctttcataaagcacttttgtggcctagttcccacacacacacaaaagtattaggtctttaaaacttttccaagtagtaagtgagactccctcttactgtctacgaatacacaataaagagatgagacactgccccaatcctaaagaggccagaactgaagtgctacattgtgggagttaggggatgcttcttttttccagctcttttttctagaatcctcattacagctaacgctggtaataaaggtaggaaaacaatagaactcataaaacttagaaatggtaataaatcttggctcctgtctctagcccagttccttcttacatgagattcaaagtttttcagtatgcaatgctgaacgttcacactatggttgc

SEQ ID NO: 23296 - DNA, 1958 bp, Homo sapiens
tctccccgcccgccggcccctccagcctcctccaaggcggcggaccaggccgggccggagttttcggggttcagcccgcgagcgggaggaccggggaggcgagggaggaggaaggcgagaagggccagatcgcgggagagcccaatcacggggcgagctggacctggctgtgatcatttataatccttgactcctccgctccgccacttgtcaagatgacaggggtcatccgtgaataacacttcacgctgatgaatggctcttgccggctttcggctctgatgaggggtctgcccgccgccgattgaaaacactaatgaacttactgcgccatttgaaattcacacgcaccaacaaaatggggggtgggcatttcaggtcagctgagtcacccgaggaggtggcagtgcaagacactgccgggaagacggattccgaggcagaagggtgtaattaaggatttccacccccgattagcggccggacactgtccctgcctcgattttgtttgctgtgggagggaaaaaaaaagtttgctgctcctcccaagacactggccactttctactcactgaagttcccaccgcagcgctggctcccggctccctagctcccgccccctgtctgcaggaaagccctcccccggagcttccgaaactgctggaggttccagagttttgtagctccgaatgggcgacctgagccgaaccgctctctggctgggtggtcggcgggatccttcaggctcctttcgggtccgggacggggcggcggcagaggtggggcgtgcgtgcttggggctgccgagtgagtgcggctccctggtgcgcgcccgagcatctccccgccctctcctgggaccagcagtctgcccgtggagggctaggagcccgcgaccaggcctgccccggccgtcgccaacctgtccttggaagcgtggcggagactggtgcgctctcagcctcgtcgcgccagccgcctcgcgccaccctccactttcagcttcagagcagaggattccgccgacctccacctgtacctgtactcggccgttaggaaatccacttgcatttttaactaccgtgcagaaccagaaacagatcgagcactgggagaacaaggacgacgcctcctaggaaagcctgaacctttatgttagtttatccaaagtttgggctagaagtgaggagaatccctaaactcgaggtggtgtgcccagacccacagcccgtgttcccgaagttgctaagtgcccgagcgcagcgcgttaagtagagaagtcttggtagtaagcgaacccgacccggctctcggggcgctagtgacggaaagcagcacgcatatctttgcgggaagaatctagagtcgccctgggatagatccatctccttctgccactgaatttcacacttgaaaaagataaggtcatgggggcggatgaatgatatccctcactcatttagccattcttattattatataaaaaaaaggcttgtcaattatgaaggtgtgtcccagatattacatgaagatcatgcaaactacttgaaatttgaatccggacatgatcgtaaggaaactctttcataaagcacttttgtggcctagttcccacacacacacaaaagtattaggtctttaaaacttttccaagtagtaagtgagactccctcttactgtctacgaatacacaataaagagatgagacactgccccaatcctaaagaggccagaactgaagtgctacattgtgggagttaggggatgcttcttttttccagctcttttttctagaatcctcattacagctaacgctggtaataaaggtaggaaaacaatagaactcataaaacttagaaatggtaataaatcttggctcctgtctctagcccagttccttcttacatgagattcaaagtttttcagtatgcaatgctgaacgttcacactatggttgc

SEQ ID NO: 23297 - DNA, 409 bp, Homo sapiens
tgaggcaggagaatggcgtgaacccgggaggcagagcttgcagtgagccgagatcaggccgctgctctccagcctgggcaacagaatgagactccatctcgaaaataataataataataatattaataataataatttataggcatgaggcctggagctttttgttactaaaaaagttctaaaagggacccagaggtaaccagtgacttgtgaagtttccatattgcatgcctgtcagatgtgacaggttcagaacactgtaagacttattgccttttatggccaggtgtggtagctcatatctgtaaccctagcactttggcaggccgaggtgggaggatcacttgaagccaagagttcgagaccagcctgggcaacttagttagacctcatctcttcccccttcaaa

SEQ ID NO: 23298 - DNA, 677 bp, Homo sapiens
agtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgttttttttttttttgagactcgctttgtcacccaggctggagtgcaatgggcacaatctcaacttcaccgcaacctccgcctcccgggttcaagcgattctcctgcctcagccttcccgagtagttgggattacagggcgcctgcctccatgcctggctaattttgtatttttagtagaggcagggtttcttcatgttggtcaggctggtctcaaactcctaacctcgtgatcctcctgcctcgacctcccaaagtgctgggattacaggcatgagccaccatgcccagccaaagatcatttttttatatagacttcagccctttg

SEQ ID NO: 23299 - DNA, 1732 bp, Homo sapiens
aagtgatttgattttgtttttttcccaaagagaaaacctacctgccctgtttctgatcccacccctctgctggcttgaagcaggtaaccctttcccagccctgcagctgcccacctggcctccatgccatcctgcccccacctggctggcagccctggctctccatgtgtgccctccggctctgtgtgaagcctcaagtcagtcccagcattgtttccatagggaagtgtggggtgcccagcaggtaaagcacagggagagagggcagtgggaatgccacctttaggctgcagcaggagccccacactgcccagttttcctccccactgttctacaccaaccaggggagactaacactgtgactctgggattggcaggtgcaacttggagccacttaatttcctggggacgtaagttcttcccaagcttagagcaagctgccctgccaaaggagaccaaaccatgccaaccacgctggcaactgctgctgtccagtccctgtgttttctgaccaccgtcactgtgcaactcatcgcctctgccacttaggaccaggaaagaggctggttttgctcccactcttagttgctgataaagtggggagaaggaaaatggacactctacagagtttggggaagggagagtagggagcccatcttgtccagaaagattcatctgtggtctgtctgttaaacacagctgatttcagtgggctttcccctggccctgggggagcagacactgactgggttgtgggcagaggagccatcctggcggagccctgctgcaggggagctccttcaggagccccatccggacctcttgcactgggctgcctttgcctccatttgccttcctgtatctgcaacaaaccttttaaaagtgttcactcttgctttttccagtatttcggtaatcagccatcttgctgtagtacaggatgacattgtcgaatgctctttgtatgtgtgcacacccccttactcccttactgcttcatacactccacaagtggtacagtattttgtgtcattgtaaaaatcaaaattggctttggatctttgtaatacacctgtacctgaaaaagtaaacaacattcttcaattactagccttcagcttgaaaagacatgctggagaagaaggaagggggaacccataggtgtggcgtggagccaagatgtactattcaactatgtgtttctgtttataaaaaacacataccatggaaccatggtgcttttgttcttagtttttgccgttagatcccttcaaactggaagttccttacaatatctttctcaggaaatattttgggaaatggggtaagagatggcaagtgtgagacgggctgtgtcagaggttgctacgtcatggatacagtgcagttccaagtgccataagtgtatgtacatatagttaataatgacactgttcatcaccattctaaaatactgttcttccaaccctatcttcaatgaccagtccagaaggggttaagctggattcatttgctctggcatgtgcattcccagcagggtgaagaaaggtttaaattaaagaatttattttctctctcccccttcctctttctcccagtctttgcataggagaatgttagacattcagaaattactgtttctgttttaaattgagtattgatttttttatattgactttgtattgagttctttttgaaagaataacaaaataaaatgcaggatctttgtaaa

SEQ ID NO: 23300 - DNA, 3508 bp, Homo sapiens
aagtgatttgattttgtttttttcccaaagagaaaacctacctgccctgtttctgatcccacccctctgctggcttgaagcaggtaaccctttcccagccctgcagctgcccacctggcctccatgccatcctgcccccacctggctggcagccctggctctccatgtgtgccctccggctctgtgtgaagcctcaagtcagtcccagcattgtttccatagggaagtgtggggtgcccagcaggtaaagcacagggagagagggcagtgggaatgccacctttaggctgcagcaggagccccacactgcccagttttcctccccactgttctacaccaaccaggggagactaacactgtgactctgggattggcaggtgcaacttggagccacttaatttcctggggacgtaagttcttcccaagcttagagcaagctgccctgccaaaggagaccaaaccatgccaaccacgctggcaactgctgctgtccagtccctgtgttttctgaccaccgtcactgtgcaactcatcgcctctgccacttaggaccaggaaagaggctggttttgctcccactcttagttgctgataaagtggggagaaggaaaatggacactctacagagtttggggaagggagagtagggagcccatcttgtccagaaagattcatctgtggtctgtctgttaaacacagctgatttcagtgggctttcccctggccctgggggagcagacactgactgggttgtgggcagaggagccatcctggcggagccctgctgcaggggagctccttcaggagccccatccggacctcttgcactgggctgcctttgcctccatttgccttcctgtatctgcaacaaaccttttaaaagtgttcactcttgctttttccagtatttcggtaatcagccatcttgctgtagtacaggatgacattgtcgaatgctctttgtatgtgtgcacacccccttactcccttactgcttcatacactccacaagtggtacagtattttgtgtcattgtaaaaatcaaaattggctttggatctttgtaatacacctgtacctgaaaaagtaaacaacattcttcaattactagccttcagcttgaaaagacatgctggagaagaaggaagggggaacccataggtgtggcgtggagccaagatgtactattcaactatgtgtttctgtttataaaaaacacataccatggaaccatggtgcttttgttcttagtttttgccgttagatcccttcaaactggaagttccttacaatatctttctcaggaaatattttgggaaatggggtaagagatggcaagtgtgagacgggctgtgtcagaggttgctacgtcatggatacagtgcagttccaagtgccataagtgtatgtacatatagttaataatgacactgttcatcaccattctaaaatactgttcttccaaccctatcttcaatgaccagtccagaaggggttaagctggattcatttgctctggcatgtgcattcccagcagggtgaagaaaggtttaaattaaagaatttattttctctctcccccttcctctttctcccagtctttgcataggagaatgttagacattcagaaattactgtttctgttttaaattgagtattgatttttttatattgactttgtattgagttctttttgaaagaataacaaaataaaatgcaggatctttgtaaagcctttgcactttcaacctctttatagcttgagttacttttgcagtgggaacaatgtaaatgacatttaaaagatttaaggtttcagaaagctgcatcccacaattgaacacaatgcatttttatttcaattcttggaactggtaggctattctttttaaaagggggtaaacttcgccctaaggctggtagaatgtatgttcacattatagtagacaggatttcatttgccttatatgtttatagattttttataattttcatcctacgttattaaaattagagcattgagtgttaaagaacttaatgaggagtctatatctgagattgctctcttccctggtgatgttttaactggtagataatttgttcttaaatatgtacttttgaagataggacagtttttatagtccatgaactgaatgttaaaaagttctgtatgcattctcagagaggattttaaagctatatagttcatccatcctttgcattatcaaaatgttaagtcaaatctgtaatactttggctaaaattcataaagtaagccctagagaaaatacttgaccaccaaatttttgcccaactatcatcacctcccttcccccgcctctgttcttgccttttgacatctacatggaagacaagttctttacagcaaatggtaagaggcaggtgacctggtgtgtttgctgtgttgtagttcattgcctggggcttgggactccttttttaatggagagactagctgtgcaggtgtgtgttggatagggataaagtgctcacccctgccctctctacagtagttggtggtagatttctctctcattttgcctcataatcactttcgagtgcatgtatttacctaagggctgtagctctgtgggatgctaccagcatattggactgacagaaattgattaccttgccactccaacctacgtactgagtgagtgctccagccactcagtgaaaccaacaaaagtgagtccttggtttaccttccaatctgggtcctgctgtgtaagtatccctaagtggggatgcatatttgtttgtgcgtttttatttccatatatgtgagcatttctctgagtgtattaccagacggatagcacatttatatgtcagacatcttaacatctgtgttatctgtagcaggtgtgtagctcagcagatacgtgtcattgtgtatatagctgagtgtgtgagggtgtctgtgtttctgcagtcccctgtgtttgagagatgacttaataaccctgtgttttgagaggtcgctctaaaccagtgacttttccctcccctgctttattcctttccctcactgacactggcttctcccgctagagtaaatggctttagcacagcactgtcttctggggagcctgctgtcctgcaggcaagtccattaaactctttcttgctttaggactctgaaaacagcaagaaacaaacaaacaaaggtcaagctctaagaaaattactgctcaaacttcactaccctggaagccttactagatatttcttaaggtaacttaaaaattgggctttatttttaaaaagtgataggttacttacagtagcacagaaatgttagcatatttatttaaatagtcctgcagcagagaccctgcgattgtaaagtgatttaagtatttctgggtagtgtttgtgatttacggatttgttactgaaaaacaaaaaaatcactactgtgaatttactactatgtaaccttgtggtcgtatttcattataaataaaataagaattgctct

SEQ ID NO: 23301 - DNA, 3449 bp, Homo sapiens
aagtgatttgattttgtttttttcccaaagagaaaacctacctgccctgtttctgatcccacccctctgctggcttgaagcaggtaaccctttcccagccctgcagctgcccacctggcctccatgccatcctgcccccacctggctggcagccctggctctccatgtgtgccctccggctctgtgtgaagcctcaagtcagtcccagcattgtttccatagggaagtgtggggtgcccagcaggtaaagcacagggagagagggcagtgggaatgccacctttaggctgcagcaggagccccacactgcccagttttcctccccactgttctacaccaaccaggggagactaacactgtgactctgggattggcaggtgcaacttggagccacttaatttcctggggacgtaagttcttcccaagcttagagcaagctgccctgccaaaggagaccaaaccatgccaaccacgctggcaactgctgctgtccagtccctgtgttttctgaccaccgtcactgtgcaactcatcgcctctgccacttaggaccaggaaagaggctggttttgctcccactcttagttgctgataaagtggggagaaggaaaatggacactctacagagtttggggaagggagagtagggagcccatcttgtccagaaagattcatctgtggtctgtctgttaaacacagctgatttcagtgggctttcccctggccctgggggagcagacactgactgggttgtgggcagaggagccatcctggcggagccctgctgcaggggagctccttcaggagccccatccggacctcttgcactgggctgcctttgcctccatttgccttcctgtatctgcaacaaaccttttaaaagtgttcactcttgctttttccagtatttcggtaatcagccatcttgctgtagtacaggatgacattgtcgaatgctctttgtatgtgtgcacacccccttactcccttactgcttcatacactccacaagtggtacagtattttgtgtcattgtaaaaatcaaaattggctttggatctttgtaatacacctgtacctgaaaaagtaaacaacattcttcaattactagccttcagcttgaaaagacatgctggagaagaaggaagggggaacccataggtgtggcgtggagccaagatgtactattcaactatgtgtttctgtttataaaaaacacataccatggaaccatggtgcttttgttcttagtttttgccgttagatcccttcaaactggaagttccttacaatatctttctcaggaaatattttgggaaatggggtaagagatggcaagtgtgagacgggctgtgtcagaggttgctacgtcatggatacagtgcagttccaagtgccataagtgtatgtacatatagttaataatgacactgttcatcaccattctaaaatactgttcttccaaccctatcttcaatgaccagtccagaaggggttaagctggattcatttgctctggcatgtgcattcccagcagggtgaagaaaggtttaaattaaagaatttattttctctctcccccttcctctttctcccagtctttgcataggagaatgttagacattcagaaattactgtttctgttttaaattgagtattgatttttttatattgactttgtattgagttctttttgaaagaataacaaaataaaatgcaggatctttgtaaagcctttgcactttcaacctctttatagcttgagttacttttgcagtgggaacaatgtaaatgacatttaaaagatttaaggtttcagaaagctgcatcccacaattgaacacaatgcatttttatttcaattcttggaactggtaggctattctttttaaaagggggtaaacttcgccctaaggctggtagaatgtatgttcacattatagtagacaggatttcatttgccttatatgtttatagattttttataattttcatcctacgttattaaaattagagcattgagtgttaaagaacttaatgaggagtctatatctgagattgctctcttccctggtgatgttttaactggtagataatttgttcttaaatatgtacttttgaagataggacagtttttatagtccatgaactgaatgttaaaaagttctgtatgcattctcagagaggattttaaagctatatagttcatccatcctttgcattatcaaaatgttaagtcaaatctgtaatactttggctaaaattcataaagtaagccctagagaaaatacttgaccaccaaatttttgcccaactatcatcacctcccttcccccgcctctgttcttgccttttgacatctacatggaagacaagttctttacagcaaatggtaagaggcaggtgacctggtgtgtttgctgtgttgtagttcattgcctggggcttgggactccttttttaatggagagactagctgtgcaggtgtgtgttggatagggataaagtgctcacccctgccctctctacagtagttggtggtagatttctctctcattttgcctcataatcactttcgagtgcatgtatttacctaagggctgtagctctgtgggatgctaccagcatattggactgacagaaattgattaccttgccactccaacctacgtactgagtgagtgctccagccactcagtgaaaccaacaaaagtgagtccttggtttaccttccaatctgggtcctgctgtgtaagtatccctaagtggggatgcatatttgtttgtgcgtttttatttccatatatgtgagcatttctctgagtgtattaccagacggatagcacatttatatgtcagacatcttaacatctgtgttatctgtagcaggtgtgtagctcagcagatacgtgtcattgtgtatatagctgagtgtgtgagggtgtctgtgtttctgcagtcccctgtgtttgagagatgacttaataaccctgtgttttgagaggtcgctctaaaccagtgacttttccctcccctgctttattcctttccctcactgacactggcttctcccgctagagtaaatggctttagcacagcactgtcttctggggagcctgctgtcctgcaggcaagtccattaaactctttcttgctttaggactctgaaaacagcaagaaacaaacaaacaaaggtcaagctctaagaaaattactgctcaaacttcactaccctggaagcgttacttacagtagcacagaaatgttagcatatttatttaaatagtcctgcagcagagaccctgcgattgtaaagtgatttaagtatttctgggtagtgtttgtgatttacggatttgttactgaaaaacaaaaaaatcactactgtgaatttactactatgtaaccttgtggtcgtatttcattataaataaaataagaattgctct

SEQ ID NO: 23302 - DNA, 4307 bp, Homo sapiens
  misc_feature (4307)..(4307): n is a, c, g, or t
aagtgatttgattttgtttttttcccaaagagaaaacctacctgccctgtttctgatcccacccctctgctggcttgaagcaggtaaccctttcccagccctgcagctgcccacctggcctccatgccatcctgcccccacctggctggcagccctggctctccatgtgtgccctccggctctgtgtgaagcctcaagtcagtcccagcattgtttccatagggaagtgtggggtgcccagcaggtaaagcacagggagagagggcagtgggaatgccacctttaggctgcagcaggagccccacactgcccagttttcctccccactgttctacaccaaccaggggagactaacactgtgactctgggattggcaggtgcaacttggagccacttaatttcctggggacgtaagttcttcccaagcttagagcaagctgccctgccaaaggagaccaaaccatgccaaccacgctggcaactgctgctgtccagtccctgtgttttctgaccaccgtcactgtgcaactcatcgcctctgccacttaggaccaggaaagaggctggttttgctcccactcttagttgctgataaagtggggagaaggaaaatggacactctacagagtttggggaagggagagtagggagcccatcttgtccagaaagattcatctgtggtctgtctgttaaacacagctgatttcagtgggctttcccctggccctgggggagcagacactgactgggttgtgggcagaggagccatcctggcggagccctgctgcaggggagctccttcaggagccccatccggacctcttgcactgggctgcctttgcctccatttgccttcctgtatctgcaacaaaccttttaaaagtgttcactcttgctttttccagtatttcggtaatcagccatcttgctgtagtacaggatgacattgtcgaatgctctttgtatgtgtgcacacccccttactcccttactgcttcatacactccacaagtggtacagtattttgtgtcattgtaaaaatcaaaattggctttggatctttgtaatacacctgtacctgaaaaagtaaacaacattcttcaattactagccttcagcttgaaaagacatgctggagaagaaggaagggggaacccataggtgtggcgtggagccaagatgtactattcaactatgtgtttctgtttataaaaaacacataccatggaaccatggtgcttttgttcttagtttttgccgttagatcccttcaaactggaagttccttacaatatctttctcaggaaatattttgggaaatggggtaagagatggcaagtgtgagacgggctgtgtcagaggttgctacgtcatggatacagtgcagttccaagtgccataagtgtatgtacatatagttaataatgacactgttcatcaccattctaaaatactgttcttccaaccctatcttcaatgaccagtccagaaggggttaagctggattcatttgctctggcatgtgcattcccagcagggtgaagaaaggtttaaattaaagaatttattttctctctcccccttcctctttctcccagtctttgcataggagaatgttagacattcagaaattactgtttctgttttaaattgagtattgatttttttatattgactttgtattgagttctttttgaaagaataacaaaataaaatgcaggatctttgtaaagcctttgcactttcaacctctttatagcttgagttacttttgcagtgggaacaatgtaaatgacatttaaaagatttaaggtttcagaaagctgcatcccacaattgaacacaatgcatttttatttcaattcttggaactggtaggctattctttttaaaagggggtaaacttcgccctaaggctggtagaatgtatgttcacattatagtagacaggatttcatttgccttatatgtttatagattttttataattttcatcctacgttattaaaattagagcattgagtgttaaagaacttaatgaggagtctatatctgagattgctctcttccctggtgatgttttaactggtagataatttgttcttaaatatgtacttttgaagataggacagtttttatagtccatgaactgaatgttaaaaagttctgtatgcattctcagagaggattttaaagctatatagttcatccatcctttgcattatcaaaatgttaagtcaaatctgtaatactttggctaaaattcataaagtaagccctagagaaaatacttgaccaccaaatttttgcccaactatcatcacctcccttcccccgcctctgttcttgccttttgacatctacatggaagacaagttctttacagcaaatggtaagaggcaggtgacctggtgtgtttgctgtgttgtagttcattgcctggggcttgggactccttttttaatggagagactagctgtgcaggtgtgtgttggatagggataaagtgctcacccctgccctctctacagtagttggtggtagatttctctctcattttgcctcataatcactttcgagtgcatgtatttacctaagggctgtagctctgtgggatgctaccagcatattggactgacagaaattgattaccttgccactccaacctacgtactgagtgagtgctccagccactcagtgaaaccaacaaaagtgagtccttggtttaccttccaatctgggtcctgctgtgtaagtatccctaagtggggatgcatatttgtttgtgcgtttttatttccatatatgtgagcatttctctgagtgtattaccagacggatagcacatttatatgtcagacatcttaacatctgtgttatctgtagcaggtgtgtagctcagcagatacgtgtcattgtgtatatagctgagtgtgtgagggtgtctgtgtttctgcagtcccctgtgtttgagagatgacttaataaccctgtgttttgagaggtcgctctaaaccagtgacttttccctcccctgctttattcctttccctcactgacactggcttctcccgctagagtaaatggctttagcacagcactgtcttctggggagcctgctgtcctgcaggcaagtccattaaactctttcttgctttaggactctgaaaacagcaagaaacaaacaaacaaaggtcaagctctaagaaaattactgctcaaacttcactaccctggaagccttactagatatttcttaaggtaacttaaaaattgggctttatttttaaaaagtgataggttacttacagtagcacagaaatgttagcatatttatttaaatagtcctgcagcagagaccctgcgattgtaaagtgatttaagtatttctgggtagtgtttgtgatttacggatttgttactgaaaaacaaaaaaatcactactgtgaatttactactatgtaaccttgtggtcgtatttcattataaataaaataagaattgctctctgaaaaaaaaaacaacaaaaaaaaaaaaaaacaaaaaaaaaaaaaaacaaaacacaaacaaaaaacaacaaaaacaaaaaaaaaaaaaaaaaaagaaaaaaagaaaaaaaccaaaaagaaaacaacaaacgtaacgaggagaagaggcgccacacaaaagacgagtcccaccatgaaacgcacacatgcacagcacacgcacacacatcagaaccggcccgcacaccaaaaacagatagacacaaacacagggaaaggaaaaacataaaacaggagaaacaaaaaataagaaaaacaatacacaagaaaaaaaagaaacagaaacacaaacgacgaaaaaaagaaaaggagcacaaacaaacagaatcaaacccgccagcaaacaagaacactaagacacgacaatatacccacagaaatcacatcaagcaagagacagcagcgacactccgacaacgcactacgacaatcaaaacagaaaaacacagcgagacgcgaaagcgcacagcaacacagagctatacagatagagaacgaagacaacacagcgataccgaagacaggacaggaacatcagagtagaggagtgacggcacggccagcaagccggcgaccgccagcacgaggacgacaggccgcagccgggaacgggagccagccagcagcacgccagccacgcagccacggctagcgaccgatcaacgccagggcagaggcgctcctgagccgagaggcgcgggggcaggagcagacgcggaaaaatcacgctcgcgcgcacgcgcggacggcaagaagtgn

SEQ ID NO: 23303 - DNA, 222 bp, Homo sapiens
agagagaaatggacactacatcactcataccccttattttactgtatttatgtttggaagactgttatgggaacatagaagacagactaaccaagcccggaaaactggagaagagttcaaagagaaggcaaatttagcctgatatgcaccaagaactcactgattcttacaggagaaggattttaccaacagataaaggaaatgacaaagccattctagaat

SEQ ID NO: 23304 - DNA, 242 bp, Homo sapiens
actcttccacttttgtttgaggacttctgggtagacagggttggcttatttagcttccttttctcttaggtcagttccccaggaaacaggttttgggatggaggtttgcatgaaggaagtttcaggggtgctctgatttataagtgagtgaaataagctggatcgggaagagagagaataattaactctgatgcaattcacaattgcagctgagttcttagccagccccatggggagctctg

SEQ ID NO: 23305 - DNA, 266 bp, Homo sapiens
ggaaggagggaggaaggaaggaaggaaagaagagagagagaaggaaggaaggagagagagagagagaaaggaatgggaacgtgggcatctttagatccaaagatatgtagaatttaatcaaatgatagcttgggtacaggttgcaggcccctcccagtgaacagagaataaaagcaaagtgagattagaatccaagtgaccatgggcttctttaagtaatgataaaaggtggctctggacaatcatgatcacaggtaagggtgaca

SEQ ID NO: 23306 - DNA, 657 bp, Homo sapiens
gcaatcataatgagcaccaaacccctgcacttaaaaagttctcctgcctcaggctcctgagtagctgggactacaggcgcttgccaccacacctggctgtttttaaacttgtttgtagggacaaggcctcactatgtcacccaggctggtttagagatcctggtctcaagtgctcctcccactttggccttccagaatattgggattactggtgtgagccaccatgcctggcccttttgcaggttttttttaaaaaaattttatttatttattttttgagacagagtctcactctgtcacccaggctggagtacagtggcacaatttcagctcactgcaactccacctcccaggctcaagcaattctcatgcctcagcctcccgagtagctgggattacaggtgcctaccaccatgcctggctaatttagtagagacgggatttcactatgttggccaagctggtctcgaactcctagcctcaagtgatccacccgcctcagcctcccagagtgttgggattacaggcgtgagccatcacgctaggtctgcttttgcagatttctaaaaggtcaagagttcctaaagattcaactcctaggttggccatggaaatgacccatgtgagcttatcatcattcttttctcttgagcctca

SEQ ID NO: 23307 - DNA, 486 bp, Homo sapiens
aggaatgtggaaagacctttagacttagtttttaccttactgaacacagaagaactcatgcaggtaagaaaccttatgaatgtaaggagtgtgggaaatcatttaatgtgcgtggacagcttaatcggcataaaacaatccatactggtataaaaccttttgcatgtaaggtgtgtgagaaggcttttagttatagtggtgacctcagagtacattctagaattcatactggagagaaaccatatgaatgtaaggaatgcgggaaagcctttatgcttcgttcagtccttactgaacatcagagacttcatactggtgtgaagccctacgaatgtaaggaatgtgggaagacctttcgagttcgttctcaaattagtctacataagaaaattcatactgatgtgaagccctacaaatgtgtacgatgtgggaagacctttagatttggtttctaccttactgaacaccagagaattcacactggtg

SEQ ID NO: 23308 - DNA, 425 bp, Homo sapiens
gggcttccagactccagaactgtgagacaataaattcctgttatttaaggctcaccagtctgcggggctttgccatggcatcctaagaaagtgagcgtgaaacttaattcatcagtacggaaaacatcttggcagtttaaccactattgtaatactcatgtattgatacgtgtttcagaatttttctgctctcttcctcagtatgtatgtacagcaaaagcttcagagagaaactccaggccatgcaaactcatgaactaaactctgggagaggtgctggtgatgacctggaagggaaagatgagtgtttggcacaggacgggaccgaccgaaagtggttgtgtgggagggtttgatggggtggctgctggttgttgttgggagaggaggggcaggtgggttctctcctctggcaaggccacggg

SEQ ID NO: 23309 - DNA, 395 bp, Homo sapiens
ctcccatttgacccttttgcaaaccgagatggtttggagcaaagggaagtgagactgcttggccagccctatggcatgtcttcccaggaggcccaggacctacttgctcaagtggcaaagagacaggctgcagaatgtgtttgccagccctctgaaaagggctgcctcaaaccctctatcagctggggctgttccaagagcctgctgctttaggactggctttgggctcatggtttttatttgagagcattacttctgacctaaggcagaaacacttagaaaacaaatctgtgaaatggctcagagaatgtgtaaggtttggcaacccctccagaggtcactgggttatcaccttcccttcaaactgggctgggagggcatccttgcttctcctc

SEQ ID NO: 23310 - DNA, 395 bp, Homo sapiens
tgtagttccatctacttgagaggctgaggtgggaggatcgcttgagcctgggaggtcaagctgcagggagctatgatcataccactgcaccctcagtgacagagtgagaccctgtctctcaaataaaaataaaaaacttgaagtggatgaaaagatctaatatgaaaggtgaaaatataaagctaatgatgtgtaagtatgagaatagatttgggactttaagctggggaaggacttcttaaatatgattcacaaagcactaaccataggggagaatggatagatttgtctacatcaaaatagaggatttctgttccacgaagctccccacagataaagtaacagacagatgggactgactgaagagagttgccacacaaaaccgaaacaggagt

SEQ ID NO: 23311 - DNA, 384 bp, Homo sapiens
gccataatggataggtgtaagaatcataagtcattttgataacgatctgctatccagtatgcattgctgaatttttagtcatagaaagataatgctaggtattatttcagctttctaatatggacataattcatattatttctaaagtaattgttgatgtgaaatgaaactgctttaatatcaaaggagagttgtatacaattatataacttgatattttaggaatattatcaggctattagtaatattaataaaagtcagaattagaaagcttaagcaactagcttaaagttaatgaaagaaagttaatgactgaacaatatataatataaacaatttatatccgattctttaaattcttgaaaaatgacgttaaaaaattct

SEQ ID NO: 23312 - DNA, 316 bp, Homo sapiens
attcgcacctgcagtgtatgatcaattgctttttagagtaaagaggaaaaaataatcttttatatttaaaaatatatacttagctttgatggtgctctttattccttcttgtagatctgagtttctatctatacaatttcgcttcagcctgaacatcttattatctgaatctgctagcaataaattctggttttatccaaaaatatctttttcttttcttttcttttctttctttcttttcttttcttttcttttctttctttctttctttctttctttctttctttctttctttctttctttctttcttccttct

SEQ ID NO: 23313 - DNA, 402 bp, Homo sapiens
gacatccttagatgcccttcctgatgggcagctggtgagtcttcttccagctattttagtgaggtgggtagcagtgcatggggttgctgaggcacgcaccctcggaacatattggtgtctctccctaatggggcagcctactctgtacatgtcagaaaaggtgcctgtgaagctggcaatgtgagcttatatgatcctggccatgttggccacaggtaggattagccattggcaaaaagccaggttggccaagtttatttctggtgccttctcacttccacacccttttgtcattgcctcctgtgcagtcttcagggtcctggaatttctatttatcttctacacatctatggggattttctaacacatccaggacacatcccggcctctgtgtccatgcca

SEQ ID NO: 23314 - DNA, 947 bp, Homo sapiens
taaattttttattgtttgtgcatacatatattttcttggttcaaattcaaaaagcacaaaagatttaaaaaaaacatatatatctgcctttatacctcaactacctggttccctccctcacagtattattgatgtcttagtacttttctcatgaatgcagaacccttccctaacctgatttttatatttcttataagatcctaaataatcgtgttatagtttatgaatttctgaggttagtgggtccctaaatataatgcttcagtttaattgggaaccatttgtaaattgagtacttgatttatttttatcagctgagatttctttagctgccacactgctgggggaatacagataatggacaactctttaagaaataatgtataaataaattataatgcgacgctttgtttcatagtagaagcataaggtcgagaaggaatatttaatgctcttctctgggaggaccgacttgctggtaggaatggaagctgaattttgaaaaatgaatggtagcttactaggcagatggggttagaggtggcattccagacaaaggaggaagaggaatggaagaagttgtggtatgttgaatgaacaataaggaattgaatattgctgaaattactgggaagtagagtggtaggagctggggctagacaggcagtgtgatcagattatgaaagcttttagcgtagtgctgttgagatggacttaattcactaggactacgtgaaacaactttaaacttttaaattaataaggaattagagtttaaaaggccactctgttggtactataggaaataaatgagaacaggacgggattaggaaactgggagagtagtgagtaatccattagaataacctgtgaaagaaatgggttagcaaggctggaatggaggagggaaggcattcaagataccgtgagaaatgatgaattattag

SEQ ID NO: 23315 - DNA, 394 bp, Homo sapiens
ccaggccaggaaaagattagtgcattaaagattatcaaaataaggtgatgagtattgctacttaagaaaaatccaaacctctaaggctccttttgcagtacaatgtaatatagaaatattatgctgagaaaatgtgaaatttcatctattttatcattcacctggaagtgcttgagaaacaaatgacattaaactttaacttttattatagccatcagagattacaaaaggtaggagggtgggagagcggggtgaaggttgaaagattacctattggttacaatgttcagtctttggttgatgggtactctaaaagcccagacagactttatctctacataatgcatacatgtaagaaatctgcacttgtaatccttatgcctataaaaataaa

SEQ ID NO: 23316 - DNA, 315 bp, Homo sapiens
cgattccaaaacatattctttgtaagttttaatatatttatgtattatttatacttacattgtaacccataatgtacagatattatttttccttcaactcttaagaatattcttaaataataaaaaattaatgatttataatttttgttggttgggaatcattttatctcatcatttcatctcatcattttatctcatcatttcatctcatctcatctcatcccatcatttcatatcatctcatttcatcaaatctcatctcatctcatttccatttcattttcattatttcatttcatcatttcatttcactat

SEQ ID NO: 23317 - DNA, 533 bp, Homo sapiens
gcctttcaccttctgccatgattgtgaggcctccccagccacgtggaactgaagtcacggggtgactccaagcagggccccctttgcattcagcctgcccttctctcagcccagtcatgctggcaccagatgagctgctgcagactcatgaggaaagagtcaagacaggctctttgaaacctccctctccaggcatgccacgtgaacagaagttccaggagacagaagagaggggtgacaagaaattgccctgatcaaactgccacagtgacacaccatgaaaaacacacagagattggctctgtggcaatggcttcatacccaggtcacaggtgcaaatttggtgcagcaaagcagcattaaatattttgcattaaattgatgttaatttgcttttgctggttttatggcttatttttatatctggaatgatgtttttgtttcccattatatataaactataagcaaaggaagtttattcctacctttggtttgtaaaaatttaagtagtgttcaaatacaatctttaagtc

SEQ ID NO: 23318 - DNA, 301 bp, Homo sapiens
aaaaaaaaaaagggataatgtgatagtgacttgggatgcccaggcaagggatgctaggcaaattctgtttaacctgagggctatgctccacctttctctaccttgtcctctgccccagaagaccatcatgaatattctacatcaaggaccagtaaatgatggcctgctgcctgtttttgtaaataaagttttattggaacacagccacactcatttatttatgtatggtctacgctacgatggcagaattgagtagttatgacagagactgcatgacttgaaaagctgaaaatacttacta

SEQ ID NO: 23319 - DNA, 544 bp, Homo sapiens
actaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataccttattttttagtattctacagtttaatcaaattactgaaatgggatttttgatctggtatttatctgcaagagtatacttcattcactaataatagactggtgctgtaactcaaa

SEQ ID NO: 23320 - DNA, 370 bp, Homo sapiens
tctttttatttgtgaaaaaggttgaacacttacattcttctgtgaattatctgctaatagttgttgctcttttttgtcttgtatattaagaatgtgtatttgcaaatatttttgtcatttatcttttttatgtgattttctctgtatagaagcttttattatgttagtgcaaaggtaattgtggattttgccattacttttaacaaaaactgcaattacttttgcgccaacctaataaaagacatcagattggccgggtgcagtggctcacgcctgtaatcccaacaatttgggaggccaaggcaggcggattgcttgagcccaggaatttgagaccagcttgggcaacatggcaaagccccatctttac

SEQ ID NO: 23321 - DNA, 422 bp, Homo sapiens
gcgccattgcacgccagcctgggcaacagggtgagactctgtctcaaaaaacaaaacaaaacaaaacaaaatactttagataactgatttttaatgttatttggcctttttaatgcataaggcaaaataataagttacacctcaaagctgctttgtattttggcccaggacgcagccgtaggaaatgacaggacggccagtgatgctccaggagcacccccatgggaaaaggagcatcgccagggcctggtttggctgcaggcacttcaggcactcctcctgcatggaacaagcacagtatggacaaaacctattgcctgaagtgccatggagagagtctacaagttcagccaggtggtccaaaatcctcagggcagggtggcctgtgtcaactggcctggccaattaaaactaaattgttt

SEQ ID NO: 23322 - DNA, 409 bp, Homo sapiens
aaaaatcacctaaaaagcagacagttcatggacaccagtttggctacatcaagccatgagtctgtggctcctggaatcaatgaaagaacatcctgtggggttcatttccatctgaaaccaatagtgatagttgttagtgctgtctgccaaatatttctggttctccctatttccaggcacaggacaggattgccttttctggcccccttatggttgtgtggaaccacatgactagttacagccagtgacttgtgagccaaagggaaataaactccttcttatttacttgataattcaagacttttaagagctctctccttcctccagcacagtgaccagaagtaagcttttgtttgtttgtttgtttgtttgagacagggtcttgctctgttacccaagctggagtgca

SEQ ID NO: 23323 - DNA, 366 bp, Homo sapiens
cttgctttctttcttacctctgaaggagaaaagaaagttgctacttacatgtttgaaaaacctctcaaatctactcagtcaaaagattttatgcttcaatttggtcatatgttaagagtttagcttctaaactgatacctcagtagcccatagtttaaaggagtaaagagtacatggatgcttttggtactactcagaagctctgagtttctggccactgaaaccctgaaaagtagctaaatacgttcacttgctattttaatccatcactgtagatatgactcagtccctttgttattttcccccaatttgaaacaaatttaatgtgctgaaaagataactttctcctttttctttctttttctc

SEQ ID NO: 23324 - DNA, 319 bp, Homo sapiens
agtttccgctgttagcatcttccattagtgtactacatttgtgacagttgacaagccaatattgatacattattttggactaaagtccatagtttagggtttattctttgtgttgtacagtactcagggtttagacaaatgcataatttccccaaattggaagcaaccaagatgtccttctacagatgagtcaaactgtggtacattcataaagtggaattttattcagcaataagaagaaaagagctgttaagccaggaaaagacatggaagaaccttaaatgcctatagctaaaggaaggaagccagtctgaagagg

SEQ ID NO: 23325 - DNA, 275 bp, Homo sapiens
gcaagggaaagaaaggagctaaggaagaccaattctcttcccaaccggaggagggcagctcctggtgccattaacaaagagaagaaagggagttggttttagagacgctaagtgtgacagtccagcagtgttcaagtgcgactgcccagtgggcagttagaaatgtgggtctagaggccgggtgtggtggctcacacctgtaatcccagcattttgagaggccgaggcggatggatcaccaggtcaggagatcgagaccatcctggctaacatgg

SEQ ID NO: 23326 - DNA, 825 bp, Homo sapiens
ccctaggcgtatgtgtatacacgcacagatatttattcctttcgcttttagtggttgttatttctgtagcagccaagtcctgcggctccctggggctgagatctccctttgtggaactccgagagccgccctgacagtcccagccgccacccaaggagccccatccgcccacccaccctgggacccacgcggccactccagggatcattgttgtccttttgtgaggggctgaggcgactgtcccatggaggcatccaaggctttctgtgccaagaatcccaagtgactggggctggggaccacttctccaggcctctctccccgaccatgagagcccctggccctggcccctgcacaccagtgggcccagaataaccgccacccttgccatcctgcaacagctggactcaagtttccaggaagtggagatgtgtttctagaagtttcctgtggaacctggaggctcctgacgcctttgactccaggctgggcgattccgatgctgacccgtcctcctgggctccccacccccgctccccaagtgtcacacaggcactttgtacacatcctggttttctaagaagggaacttgccatcaagattcctgtaccaggcccacggccgtctcgggcagagccacctgggccccgggtgcagccggagaccccgccgagcccctcctcccagtattcccatccccgcatgcttctagggagcgcctcttttccgttcttgaggaatttctgttctggggcttgtccttcctttgcagctgttttgaatgtagttttccttttctatttatttgcacattaaagttaataa

SEQ ID NO: 23327 - DNA, 665 bp, Homo sapiens
ccctaggcgtatgtgtatacacgcacagatatttattcctttcgcttttagtggttgttatttctgtagcagccaagtcctgcggctccctggggctgagatctccctttgtggaactccgagagccgccctgacagtcccagccgccacccaaggagccccatccgcccacccaccctgggacccacgcggccactccagggatcattgttgtccttttgtgaggggctgaggcgactgtcccatggaggcatccaaggctttctgtgccaagaatcccaagtgactggggctggggaccacttctccaggcctctctccccgaccatgagagcccctggccctggcccctgcacaccagtgggcccagaataaccgccacccttgccatcctgcaacagctggactcaagtttccaggaagtggagatgtgtttctagaagtttcctgtggaacctggaggctcctgacgcctttgactccagggcctataatcccagcactttgagaggccaaggcatgaggactgcttgagcccaagagttcaagaacagcctgaacaacatggcaggaccttgtctctactaaaaatcaaaaacactagcttgtcatggtcattaggagtcagtgctgcatgatcacaccacgacactcagcctggactt

SEQ ID NO: 23328 - DNA, 1847 bp, Homo sapiens
gagaaaagacaggcttgagaatattggaggtagcttttaggacctggtgatagttttattttggttttgttttaaagaaagctttgttgagactctttttagtctcctacatggcttggatttgtatctgtaaagcctcttcctttttgattttctgtggcctgcatatgtgtaaaatctgactcctaaactggaagttgggttgtgaattaaacacacaagagagcaggtcacaggagcaggcaccaggtggtgaggcagaatatatttctggacaggtagccagcatgttgccgttagtttgaggagaggctgggggcaggcagtgcgaagtgattatctaccaccatgcagctgttaagcagggacgtagagtatgcagtgttaggagagaaggcagcagagataagctttgggccagcagatcagagagcttccattacagacaggcagggcagagtctgcacagctctttgaaaaggatgctgtattgtcaaactcagtggtcacacagacccaagtataactggatggctttgccccttgggagaacagcatttgacttagaaatgtctcactcatatctgtatctaactcagagatgtgtctaccaagaggacaaagggtatataataactgatgaaaaatttaggcatttggagaaaaagacagagagcctaagcttgtgccttataggaagggctctcttcctgtttattctcagatggtttgcattctataactggatttggacagggtttctattggatcaggacacatgtcttcccagaactaatgtactactatttagggatgtggggaggaagccagcagacaatgtagtggaacctgtgttcagatgccactcactagtcctattatccttggcaagtcacttaaatctactgagtcttactgggcgtagtggtgtgtgcctgtaattccagctactcaggaggctgaggtgggaggattgcttgagcctggaaagttgaggctgcagtgagctgtgatcataccagtgcacctgagcctaggtgacagagcaagaccctgtctcctaaaaaaaaaaaatttcctgagtcttggttcctttatctttaaaatgggaatgataataatagccaacatgtacaacactgtgtgccgtacactcacttactcttcacagctaccctattattatcatcctcattttcctggaaaggaaactgaggaatagaatgatagagtaacctgcccaagattccacaactccttggcagtgagcaaggttctaaacataggcagacagggtttctatgctgtcaacttttcccctctcctgcctctctaaacgtggcacagagaggcattcagtaaatggtagttctgggagaggaatggggaggcagcatcaagacatctcatcttttaagtgcactgagtaaggaaagaatcaagttgacttagaattggctctatttatagaactaactagaggtgtggaaataggtagtttctcttccatttctaacttaagtccatagatacacaattccagaatgacttttaaaaggttttagtgctttttggcttcttaaacttaaatctgaaaccaaataatcaaatcagtgctttgaaaagtaaatatacacagtgtatatgtgctagtgtgtgtgcacgtactattcaatatcttgtagcattactctacttaagagctattgttttcatacctattttcatcaggctggtacttcacagataagctgcaataagggtgtttttaggaaattctatgattacttttcagcatatgaaatcatgtttggctttgttgaaatgtctgagtacattgacctagg

SEQ ID NO: 23329 - DNA, 347 bp, Homo sapiens
tgaagataaagctttctcttccgtctcttcactggtacagaattccttaaataaattaatgtcaggctggacgcagtggctcatgcctgtaatcccagcactttgggaggccgaggcaggtgaatcgcctcagctcaagagttcgagaccaccctgggcaacatggtgaaaccccatctctactaaaatacaataaagtagccaggtgtggtagcactcacctgtagtcccagctactcaggaggctgaggcatgagagtcgcttgagcccaggaggaagaggttgcaatgagctgagatcacgccactgcactccagcttgggctacagagtgagactctgtctca

SEQ ID NO: 23330 - DNA, 451 bp, Homo sapiens
ttttgaaatggtttatgacctcttccccacttccccgcttgctttgctcattagtgttcctaggtggctgctgggtgacgggcttttcatcatctctgatgtgggccagtgcgaaagagcagctgcaacatctgtttctaattgggtcgtgcctttataaatacttcttgcctatttgtcacattgcttccctcccaccctgtcttccttggagtactgcagaatctgtaagcgtccctggaatgcacacgtggaccttgtcattcccaaacagactttctgctggtcagcactttgtaatgttcggctgttacaggcattagtcacttgtgctcagagagagactgtggtctttggaaactgaagaaaatgtcttttttgttgttgttaattcttggcatccagttagatttaacttctcaagagtttacacagacttttagaaaaacat

SEQ ID NO: 23331 - DNA, 1630 bp, Homo sapiens
taaagaaggatgagttgtcagattttgataactgcggatgaggggcgtggacacacggttgggaactcgcagccgctcattggtggctggtgcgggggaagttgtttcatttgccccaggtgttgcccagtgacctcctgcgcgtgcgccgcgtctgtccagctgcgcgggaagctcaggggagggaaggccaggttccatccattcagtcactccagacctggcacccagccaagcgcgcggttcctttacagactttcctgcgggtccacagaaatgcaaggatccgcctctgtgctggaattagagtctgggagggggaatgcacagtgcgccctgggtggtattttagttgtcgccttcagggctagctccgagcctcgtgccccggcctcctcagcgcttaaggaatctctggagcgcatgtcttggcgaggggaagtggggccccgttgaagctgtcgaggcgtctctgagaggggtgggctggggcctggagaggcctccgtgaggacgccgtttgctctgggctctgcctggcaggggactttggaacctggcctgaagtgttcaagaagcgggcgcgggggcaacacgcgcgcggggacgcagtaagatcacaggctgcaaagaaaacagcactaagcgtcctggaggacgctggagcttcaggatagtgtccttccaggtcgtgggaccgccccctcctccccgcactccaccttcccgcaactggatcactcggcggaagcctcaggtgggccccggggtccaagtccgccgccgggagggcgggggcgggccccgaaccgccgactgcagggcgcgtcacggcagccgctcctgattggcggccacggcggtcacgggcaaggtgccccgggattgacgccgcctgtggccagagccggagtaacgggactcccagctgcgcgtcgcagtcccgacgcgagaagggctggagtcggcgtccagcctagagcccccggtgggagccaggccgggacgcgtgcaccatgccctacctgctcatcagcacccagatccgcatggaggtgggccccactatggtgggcgatgaacagtcggatccagagctgatgcagcatctgggggcttcaaagagaagagccttgggaaacaacttttatgaatactacgtcgatgaccctccccgcatagtcctggacaagctggaacgcaggggcttccgtgtgctgagcatgacgggggtgggccagacgctggtgtggtgtctgcacaaggagtgaccttctcatgctgatttgcagacggggcacccctgtggaggggctgctgtgggccctgacctccaagctcctgcctcaccgtctgccttgctcctctcttcccaaatcatcaccgccatgggcccagccccaaagggcagtgaatggccttctctgaaaccctgcgtcaagcagtgggagagggcagtgcccggtgccctggtgctcccagctgccctcctgcttcgggcctgggccgagggccttgtgtaggccatgttcctcgggcagctgccccgggccggagctgggcactccagcggccctggcgcgtggctcctgcatagctagcccaagccaataaagggctgtgatgagtg

SEQ ID NO: 23332 - DNA, 1690 bp, Homo sapiens
taaagaaggatgagttgtcagattttgataactgcggatgaggggcgtggacacacggttgggaactcgcagccgctcattggtggctggtgcgggggaagttgtttcatttgccccaggtgttgcccagtgacctcctgcgcgtgcgccgcgtctgtccagctgcgcgggaagctcaggggagggaaggccaggttccatccattcagtcactccagacctggcacccagccaagcgcgcggttcctttacagactttcctgcgggtccacagaaatgcaaggatccgcctctgtgctggaattagagtctgggagggggaatgcacagtgcgccctgggtggtattttagttgtcgccttcagggctagctccgagcctcgtgccccggcctcctcagcgcttaaggaatctctggagcgcatgtcttggcgaggggaagtggggccccgttgaagctgtcgaggcgtctctgagaggggtgggctggggcctggagaggcctccgtgaggacgccgtttgctctgggctctgcctggcaggggactttggaacctggcctgaagtgttcaagaagcgggcgcgggggcaacacgcgcgcggggacgcagtaagatcacaggctgcaaagaaaacagcactaagcgtcctggaggacgctggagcttcaggatagtgtccttccaggtcgtgggaccgccccctcctccccgcactccaccttcccgcaactggatcactcggcggaagcctcaggtgggccccggggtccaagtccgccgccgggagggcgggggcgggccccgaaccgccgactgcagggcgcgtcacggcagccgctcctgattggcggccacggcggtcacgggcaaggtgccccgggattgacgccgcctgtggccagagccggagtaacgggactcccagctgcgcgtcgcagtcccgacgcgagaagggctggagtcggcgtccagcctagagcccccggtgggagccaggccgggacgcgtgcaccatgccctacctgctcatcagcacccagatccgcatggaggtgggccccactatggtgggcgatgaacagtcggatccagagctgatgcagcatctgggggcttcaaagagaagagccttgggaaacaacttttatgaatactacgtcgatgaccctccccgcatagtcctggacaagctggaacgcaggggcttccgtgtgctgagcatgacgggggtgggccagacgctggtgtggtgtctgcacaaggagtgaccttctcatgctgatttgcagacggggcacccctgtggaggggctgctgtgggccctgacctccaagctcctgcctcaccgtctgccttgctcctctcttcccaaatcatcaccgccatgggcccagccccaaagggcagtgaatggccttctctgaaaccctgcgtcaagcagtgggagagggcagtgcccggtgccctggtgctcccagctgccctcctgcttcgggcctgggccgagggccttgtgtaggccatgttcctcgggcagctgccccgggccggagctgggcactccagcggccctggcgcgtggctcctgcatagctagcccaagccaataaagggctgtgatgagtgaaaaaaatataaaacaaaaaaactcggggtttttgggggggaaaaggttaagggagtcaa

SEQ ID NO: 23333 - DNA, 1311 bp, Homo sapiens
attcttatttcttaaaagatatggctttattgatatgtaatgtgcataccataaattctttgatttaaagtgtacaattcagtgttgttgtttctttagtgtactcagagttgtgcaaccatcaccataatcagttttagaacatttctaataccccaaaaggaaaccctgtacccactggcagacactcttgatttcccccaagtccctcagccctagataaccactaattacctttctgtggtaatgtgatctgagtctggcttctttcatttacatgtttattttgttttgtttttttgaaatggagtctcactctgtcacccaggctggagtgcagtggtgcaatcatggctcactgcagcctcaaactcctcccacctcaagcgatcctcccacctcagcctcagtagctggaactataggctcgtgatactttgcctggctaaagctgagctttaaggcactagggagggcgcctacattgctcctcctgatcattgatgggctccaccccttcacagcttgtgctcagcccctaagaatccttgctactctctgtagcctttacctgaaccttactcagggctagcaggcaggggaggaaggacaggcaagaccttccacctcctcctggcagccagccaagcagccactgtggcttaccttgcaggaggtgggccccactatggtgggcgatgaacagtcggatccagagctgatgcagcatctgggggcttcaaagagaagagccttgggaaacaacttttatgaatactacgtcgatgaccctccccgcatagtcctggacaagctggaacgcaggggcttccgtgtgctgagcatgacgggggtgggccagacgctggtgtggtgtctgcacaaggagtgaccttctcatgctgatttgcagacggggcacccctgtggaggggctgctgtgggccctgacctccaagctcctgcctcaccgtctgccttgctcctctcttcccaaatcatcaccgccatgggcccagccccaaagggcagtgaatggccttctctgaaaccctgcgtcaagcagtgggagagggcagtgcccggtgccctggtgctcccagctgccctcctgcttcgggcctgggccgagggccttgtgtaggccatgttcctcgggcagctgccccgggccggagctgggcactccagcggccctggcgcgtggctcctgcatagctagcccaagccaataaagggctgtgatgagtgaaaaaaatataaaacaaaaaaactcggggtttttgggggggaaaaggttaagggagtcaa

SEQ ID NO: 23334 - DNA, 1553 bp, Homo sapiens
taaagaaggatgagttgtcagattttgataactgcggatgaggggcgtggacacacggttgggaactcgcagccgctcattggtggctggtgcgggggaagttgtttcatttgccccaggtgttgcccagtgacctcctgcgcgtgcgccgcgtctgtccagctgcgcgggaagctcaggggagggaaggccaggttccatccattcagtcactccagacctggcacccagccaagcgcgcggttcctttacagactttcctgcgggtccacagaaatgcaaggatccgcctctgtgctggaattagagtctgggagggggaatgcacagtgcgccctgggtggtattttagttgtcgccttcagggctagctccgagcctcgtgccccggcctcctcagcgcttaaggaatctctggagcgcatgtcttggcgaggggaagtggggccccgttgaagctgtcgaggcgtctctgagaggggtgggctggggcctggagaggcctccgtgaggacgccgtttgctctgggctctgcctggcaggggactttggaacctggcctgaagtgttcaagaagcgggcgcgggggcaacacgcgcgcggggacgcagtaagatcacaggctgcaaagaaaacagcactaagcgtcctggaggacgctggagcttcaggatagtgtccttccaggtcgtgggaccgccccctcctccccgcactccaccttcccgcaactggatcactcggcggaagcctcaggtgggccccggggtccaagtccgccgccgggagggcgggggcgggccccgaaccgccgactgcagggcgcgtcacggcagccgctcctgattggcggccacggcggtcacgggcaaggtgccccgggattgacgccgcctgtggccagagccggagtaacgggactcccagctgcgcgtcgcagtcccgacgcgagaagggctggagtcggcgtccagcctagagcccccggtgggagccaggccgggacgcgtgcaccatgccctacctgctcatcagcacccagatccgcatggaggtgggccccactatggtgggcgatgaacagtcggatccagagctgatgcagcatctgggggcttcaaagagaagagccttgggaaacaacttttatgaatactacgtcgatgaccctccccgcatagtcctggacaagctggaacgcaggggcttccgtgtgctgagcatgacgggggtgggccagacgctggtgtggtgtctgcacaaggagtgaccttctcatgctgatttgcagacggggcacccctgtggaggggctgctgtgggccctgacctccaagctcctgcctcaccgtctgccttgctcctctcttcccaaatcatcaccgccatgggcccagccccaaagggcagtgaatggccttctctgaaaccctgcgtcaagcagtgggagagggcagtgcccgctgccccgggccggagctgggcactccagcggccctggcgcgtggctcctgcatagctagcccaagccaataaagggctgtgatgagtg

SEQ ID NO: 23335 - DNA, 826 bp, Homo sapiens
cctttattgccgcgaaggggcccgggtacgtgcgtcccggcaacagggcgacctccgggcgcttccggctcctgtcctacctgtcggcgggagagacccagggagccctggcctcacgcgcagcacctagtgccctgcacagagccgctccgcaggggaaaaaagggcgaataacctgagagaaagaggaggtgggccccactatggtgggcgatgaacagtcggatccagagctgatgcagcatctgggggcttcaaagagaagagccttgggaaacaacttttatgaatactacgtcgatgaccctccccgcatagtcctggacaagctggaacgcaggggcttccgtgtgctgagcatgacgggggtgggccagacgctggtgtggtgtctgcacaaggagtgaccttctcatgctgatttgcagacggggcacccctgtggaggggctgctgtgggccctgacctccaagctcctgcctcaccgtctgccttgctcctctcttcccaaatcatcaccgccatgggcccagccccaaagggcagtgaatggccttctctgaaaccctgcgtcaagcagtgggagagggcagtgcccggtgccctggtgctcccagctgccctcctgcttcgggcctgggccgagggccttgtgtaggccatgttcctcgggcagctgccccgggccggagctgggcactccagcggccctggcgcgtggctcctgcatagctagcccaagccaataaagggctgtgatgagtgaaaaaaatataaaacaaaaaaactcggggtttttgggggggaaaaggttaagggagtcaa

SEQ ID NO: 23336 - DNA, 1170 bp, Homo sapiens
attcttatttcttaaaagatatggctttattgatatgtaatgtgcataccataaattctttgatttaaagtgtacaattcagtgttgttgtttctttagtgtactcagagttgtgcaaccatcaccataatcagttttagaacatttctaataccccaaaaggaaaccctgtacccactggcagacactcttgatttcccccaagtccctcagccctagataaccactaattacctttctgtggtaatgtgatctgagtctggcttctttcatttacatgtttattttgttttgtttttttgaaatggagtctcactctgtcacccaggctggagtgcagtggtgcaatcatggctcactgcagcctcaaactcctctgttttctcatctatcaatggccacaacagtggcaccttcactagcttgttgggaagaataaatgagatagctcgtgaagtacctagaaggggaggaggcagggggcgtgcacttaccccagcgcccagcaagcagccagcaagtgtgagtcactacaagagtggccaggctgcctgctgcagacactagctttgtaccaggagcttgctgtgtgcccctcctcaccccccccatcctgtctctttgcagttatgaatactacgtcgatgaccctccccgcatagtcctggacaagctggaacgcaggggcttccgtgtgctgagcatgacgggggtgggccagacgctggtgtggtgtctgcacaaggagtgaccttctcatgctgatttgcagacggggcacccctgtggaggggctgctgtgggccctgacctccaagctcctgcctcaccgtctgccttgctcctctcttcccaaatcatcaccgccatgggcccagccccaaagggcagtgaatggccttctctgaaaccctgcgtcaagcagtgggagagggcagtgcccggtgccctggtgctcccagctgccctcctgcttcgggcctgggccgagggccttgtgtaggccatgttcctcgggcagctgccccgggccggagctgggcactccagcggccctggcgcgtggctcctgcatagctagcccaagccaataaagggctgtgatgagtgaaaaaaatataaaacaaaaaaactcggggtttttgggggggaaaaggttaagggagtcaa

SEQ ID NO: 23337 - DNA, 358 bp, Homo sapiens
gtgggcgatgaacagtcggatccagagctgatgcagcatctgggggcttcaaagagaagagccttgggaaacaacttgtaagtagcagcctccctcagtatcctctccctgccagcccctagacctgcctctgctccctttatacaacctccaagcccagggacagggcccagcatcagagccccctgcctgcatcctggggctctgttctccggaggagttggtcccatctgtagcctctccaacatcccccctctcccccacgaggcttgctctgaaagctttccacatccttactggaaccgcagaaacagagtccgttccctgggtctaggactccactagcagactgttcctt

SEQ ID NO: 23338 - DNA, 640 bp, Homo sapiens
caaaaaggcctgaattgggggtccaagctaaaagcccccgtggggagccaggccgggaagccgtcgccaatggcataccttggtcatcaagcacccaaatccgccatggaggttgggcccgggggcttcaaaaaaaagaagccttgggaacaactttttatgaatactacgtcgatgaccctccccgcatagtcctggacaagctggaacgcaggggcttccgtgtgctgagcatgacgggggtgggccagacgctggtgtggtgtctgcacaaggagtgaccttctcatgctgatttgcagacggggcacccctgtggaggggctgctgtgggccctgacctccaagctcctgcctcaccgtctgccttgctcctctcttcccaaatcatcaccgccatgggcccagccccaaagggcagtgaatggccttctctgaaaccctgcgtcaagcagtgggagagggcagtgcccggtgccctggtgctcccagctgccctcctgcttcgggcctgggccgagggccttgtgtaggccatgttcctcgggcagctgccccgggccggagctgggcactccagcggccctggcgcgtggctcctgcatagctagcccaagccaataaagggctgtgatgagtg

SEQ ID NO: 23339 - DNA, 1458 bp, Homo sapiens
taaagaaggatgagttgtcagattttgataactgcggatgaggggcgtggacacacggttgggaactcgcagccgctcattggtggctggtgcgggggaagttgtttcatttgccccaggtgttgcccagtgacctcctgcgcgtgcgccgcgtctgtccagctgcgcgggaagctcaggggagggaaggccaggttccatccattcagtcactccagacctggcacccagccaagcgcgcggttcctttacagactttcctgcgggtccacagaaatgcaaggatccgcctctgtgctggaattagagtctgggagggggaatgcacagtgcgccctgggtggtattttagttgtcgccttcagggctagctccgagcctcgtgccccggcctcctcagcgcttaaggaatctctggagcgcatgtcttggcgaggggaagtggggccccgttgaagctgtcgaggcgtctctgagaggggtgggctggggcctggagaggcctccgtgaggacgccgtttgctctgggctctgcctggcaggggactttggaacctggcctgaagtgttcaagaagcgggcgcgggggcaacacgcgcgcggggacgcagtaagatcacaggctgcaaagaaaacagcactaagcgtcctggaggacgctggagcttcaggatagtgtccttccaggtcgtgggaccgccccctcctccccgcactccaccttcccgcaactggatcactcggcggaagcctcaggtgggccccggggtccaagtccgccgccgggagggcgggggcgggccccgaaccgccgactgcagggcgcgtcacggcagccgctcctgattggcggccacggcggtcacgggcaaggtgccccgggattgacgccgcctgtggccagagccggagtaacgggactcccagctgcgcgtcgcagtcccgacgcgagaagggctggagtcggcgtccagcctagagcccccggtgggagccaggccgggacgcgtgcaccatgccctacctgctcatcagcacccagatccgcatgttatgaatactacgtcgatgaccctccccgcatagtcctggacaagctggaacgcaggggcttccgtgtgctgagcatgacgggggtgggccagacgctggtgtggtgtctgcacaaggagtgaccttctcatgctgatttgcagacggggcacccctgtggaggggctgctgtgggccctgacctccaagctcctgcctcaccgtctgccttgctcctctcttcccaaatcatcaccgccatgggcccagccccaaagggcagtgaatggccttctctgaaaccctgcgtcaagcagtgggagagggcagtgcccgctgccccgggccggagctgggcactccagcggccctggcgcgtggctcctgcatagctagcccaagccaataaagggctgtgatgagtg

SEQ ID NO: 23340 - DNA, 390 bp, Homo sapiens
actttcttccaacctttctgtcagataaccaaaataaccccttataatttaaaattaattaaacctcatggctacctaatttaaagtactaagtaagatcatgttgcctccaataaagaaatcattcacattataaaaatatgattctttcctttagataaatttatctttaaggtattctaaaatgtgattaccatcctaggcaatacgacaggaccctgtctctacaaaaaaaaatttttaagttagccaggcatagtagtatgcacttgtgtcccagctattcaggaggctgaggtgggaggatggcttgagtccaggagttagaggctgcagggagctgtgatcaccactgcactccagcctgagtgacagtcgaggctctgtttc

SEQ ID NO: 23341 - DNA, 297 bp, Homo sapiens
actgagaggacacaggacctgcctgacccctctaaagccccccaaccctcctgtcccaaaccaagtcactcaggctcctatggcccatgccttttttcctgcccttagctttgggctgagagaacatagccctatgtgttgtttctacccatgggcctctgggataaaaagctgtgatttcaggctgggcatggtggctcacgcctgtaatcccagcactttgggagggcgaggcgggtggatcacgaggtcaggagatcgagaccatcctggctaacactatgaaaccctgtctct

SEQ ID NO: 23342 - DNA, 510 bp, Homo sapiens
  misc_feature (510)..(510): n is a, c, g, or t
tgttattggatgttccatcatacttgtgggccaggacttagttaaatggctacaccttgctacaaggaagtctgggaaatacagtctttcagctggatacatccccctggcctgaataaaagctgggttctcttacaaagcacaaaaaggggattgaatattggttaggcacctgtcaatctttcatatcagcccacgtgagatagccagggtttggtgaaataaaatgctgtttctcctcaaaacacttctctcttcctgattggggagggaccctgttctctgcagagaaattctttctcatgacagggccaacatgtctgccaaaagacagcaataggacttcccaatcattctatatatttaagggagactttttaaaaactacaatacggttgaactcatgtgatttttttttttgccatgaagtttcttgttaagcattgaacatttaaaagtaaattttgactaatgtgaaataaaagaatgttacttgaagcaaaaaaaaan

SEQ ID NO: 23343 - DNA, 1200 bp, Homo sapiens
aattctaatatattcatttaatatgtaaatctatagatatctcttgatgtagatatttagaatcctttaaagttatttgtacaacagatgtttttattataacagtaatttacatttaactttaaagttagtgaagcatactaccataaatgcacaattatgaaaaattagaagctaaattacagattcattgatggagtcaattatgcaaagtggtcagtggttgttgaagcatgcattgcttcaacaggatttgcgtgcatttcccatgatcctgcattcttgtgttcttgatagcatacagacttactcagaatcaacagttgctgcttaatttgtctattttgtaagcttaggctactattttattaaaactggacatagatacttggctgaatacaaatagttttgcagattgcaatataataaaggaaacagtaaaaactagtgggctatgcttaggtttttcttgaaacctaacattgctttaggctgggtgccgtggctcgtgcctgtaatcccaaagtgctgggagccaccgcgcccagcctggtttgaacattattaagctgttgaatataaacttgaaaataattttctatgatacagctttcaggtagaaaaatgaattttcgttgtgtttaacaatgttgtgtttaacagcttatacaaataacacagtataaatggtaattgccactgtcattttaaaaatcagaaaatagtaaataaaaggatgtggaagagtctcatgtgatacagtggagatttcataccgaataaaagcattataaatatggttaaattgaacataagcataaatttaacggaactcattagaaaaaaataagccttttttctcaggttgtttcattactgtatggtgagacaactgattcaccacgatttagtctagagctacttttctattctgaatagttttggtaaaactattggtgaattattaggctgttatagtaatctgcctccgtcaagtgtatttcttgggttaaggaacacaaacatttttttttaactattcacggaagctggatgttcttcctggtcatttgaatcaaggccgtctaacaggaattgaataattcagggactagcatttaacccatatcaggtctaggcaagaaaagacatacattaggaagccttaggatatcattaaactgcctagggtagtcaaaa

SEQ ID NO: 23344 - DNA, 1111 bp, Homo sapiens
ctgtctcttaaaaaaaagggctggcctgtaatcccagcacttttgaaggccaaggcaggcagatcatttgagcccaggagttcaggacgagcctgggcaacatggcaaaaccctgtctctaccaaaaaattaaaaaataaaaaatagctgggtgtagtggcacatgcctgtagtcccaactactcaggagtctgaggtaggaggatcagttgagcccgggaagtcgagtgcagtggtgtgatctcagttcactgcaacctctgcctcccgggttcaagcagttctctgtcgcagcgtcccaggtagctgggattacaggcgcccaccaccacgcccagctaatttttgtacttttggtagagacagggtttcaccatcttggccagactggtcttgaactcctaacctcaggatccacccgcctcggcctcccaaagtgctgggagccaccgcgcccagcctggtttgaacattattaagctgttgaatataaacttgaaaataattttctatgatacagctttcaggtagaaaaatgaattttcgttgtgtttaacaatgttgtgtttaacagcttatacaaataacacagtataaatggtaattgccactgtcattttaaaaatcagaaaatagtaaataaaaggatgtggaagagtctcatgtgatacagtggagatttcataccgaataaaagcattataaatatggttaaattgaacataagcataaatttaacggaactcattagaaaaaaataagccttttttctcaggttgtttcattactgtatggtgagacaactgattcaccacgatttagtctagagctacttttctattctgaatagttttggtaaaactattggtgaattattaggctgttatagtaatctgcctccgtcaagtgtatttcttgggttaaggaacacaaacatttttttttaactattcacggaagctggatgttcttcctggtcatttgaatcaaggccgtctaacaggaattgaataattcagggactagcatttaacccatatcaggtctaggcaagaaaagacatacattaggaagccttaggatatcattaaactgcctagggtagtcaaaa

SEQ ID NO: 23345 - DNA, 1364 bp, Homo sapiens
gaatgctttagtgttctgaagttagaagagtgagcttgagtgttttgttaatcggtcatacgaacacagcggttccattaaaaaaaaatgtggtcgagcacgggggctcacgcctgtaatcctagcactttgggaggccaaggcgggtggatcacgaggtcaggagatcaagatcatgctggctatcgtggtgataccccgtctctactaaaaatacaaaaaattagccaggcatggtggtggccacctgtagtcctagctactcgggaggctgaggcaggagaatggcatgaactcgggaggcagacttgcagtgagtcgaggtcgtgccattgtactccagcctgagccattgtactccagcctgagcaagagagtgagactctctttcaaaaaaaaaaaaaaaaggtcctattctatggattaatagacatgcctaaacatgtttactaaattgaactctttatcaaatgaagatggtgcaagtgatcctagatagcttattttaaatttgttcacatgttgatcatatatgttgatatgttgttcacatatattgataaaacgatgttacttagcctttatttgcaattttgattcagaagatatatctagaaccaaagttatacattttcgcattcttcctaggtgtatactactttttgtcttctttgtttctaaaatagttttggcaattaaacactaacattaatactgactttgtggcagccatttctgtagctgccatgagaattagttttaagatccacaaagatcacaatgaaaggaaaaaggaaaagaatttttctcagtaagatattctgtaaacatatcatgttaactatgtcatgctagaattttacattgctcttaggaacatcaaacctgcctggaaaatggaaataaaattcattccctattatcatcccaaattccccctttaatttatgattcatcaaggtgaagatgagggggaattacctctctgggaacatgtttattttgttgctgtaactgagatctccctttgtgcctatgcgagcaagtcagtgcttagatggataacagtagaaaaaaattattatacactctcctcatttcattatgcaaatttatcaggatgtatctcccataaattcactataccttgcactgtcttttaaaacaaaagattcagatgttctttttcatggatatcattcattgcattaaaaaaatggcaccgagacacactcaattttttctttcataaacatcttttatataaggaggttgtaaaaaataacttattttaaataaaaaaactatcactttgctataataaagaactatcactttggttttagttccattactgttaaaaa

SEQ ID NO: 23346 - DNA, 311 bp, Homo sapiens
atcttagggaaatgataattaaaggaattcgggagtcagtgccccacactcagaatctttcccgagcatttgacgtacaacaggaaaaagatgaaggccccatgaaatttctaaaaagaccaagggaacaaacaaaaaaatatgcagatttagatccagaagactctctcgggcaagaaatgttaaagctacatgttgtcacaaacagctggtcagacataacaaagcagttgcaaaaactagaaaactggaaaaacctgtccatagagaaactcctaggagaagcccaaaaattctatgtgaggagagat

SEQ ID NO: 23347 - DNA, 2610 bp, Homo sapiens
cactgagttgtttattaggcacaagatttaacttggacacttcctccaaacaccccaggttcttgcccagcctcctcgaatacagcctctctgggagtttccctctccccgactcagccgcgctggtccctgccttttcagcgctacctgccctccgtctgggacctggctcctttcctctcgccggtgtttcctcgccacccgcggaggggagggcggaccccagcctccttgccgcctgccccgcctccccgcctccccgccggcccggctcgggccgcgcaggcgcaccaggcgcggtccggaggccgagggcgaccacagcagcctccgcctcctgctgctccggactattctgcgctgggctagtcggcggtgacccggactgcgcccggcagtggcttcgcgggcgacgcgtcgccatgggctctcgctggagcagcgaagaggagaggcagccgctgctggggcccgggctcgggcctgggctgggggcctcctggagaagccgggaggcggcggcggcggcgctgcccgcggcggtcccgggtcccgggcgggtatacgggcgccgctggctggtgctgctgctcttctcgctgctggcgttcgttcagggcctggtctggaacacctggggtcccatccagaactcggcgcgccaggcctacggcttctccagctgggacatcgcgctgctcgtgctgtgggggcccatcggcttcctgccctgcttcgcgttcatgtggctcctggacaagagaggtctccggataactgtgctcctgacatccttccttatggttttgggaactggtctaagatgcatacctatatcagacttaatccttaaaagaagattaattcatggaggacagatgttaaatggattggcaggtccaactgtaatgaatgcagcaccatttctctctacgacgtggttttctgcagatgaaagggccacagccacagctattgcatcaatgctcagttatcttgggggagcatgtgcatttttagttggaccacttgttgttccagctcccaatgggacatcacctcttcttgctgcagagagcagcagggcgcatattaaagatcgcatagaggctgtgttatatgcagaatttggagttgtctgcttaatattttctgcaacactagcttatttcccaccccgacctcctcttcctcccagtgttgctgcagctagccagcggctgagttatcggagaagcgtttgtagattattaagcaattttcgatttttgatgattgctttagcatatgccataccacttggtgtatttgctggctggtctggagttctggacttaattttaacaccagcgcatgtcagccaagtagatgctggctggattggattttggtccatagttggaggctgtgttgttggaatagctatggcaaggtttgcagattttatcaggggtatgctgaaactaattcttctcctcctgttttcgggagctacactgtcatccacgtggttcaccctgacctgtttgaacagcatcacacacctacctttaaccacagtgacattgtatgcctcctgtattctcctgggagtgttcttgaatagcagcgtgcctatattttttgagctttttgtggaaactgtctacccagttccagaaggaattacttgtggagttgtcacttttttaagtaatatgtttatgggagtacttttattttttctcacattttatcatacagagttgtcttggttcaactggtgccttcccgggtcgtgtttgctcagtctcctcctcattctgtgcttcagggaatcctatgacagactctatcttgatgtggttgtctccgtttaatagcacagacttgaaggagtttaaaaggaggctggaaatcaatactgcacactgcacatttgctcagaattgcacatctaacaggaaaagagggagaagaaagaaacttcattcagaggttttgttaggttacagattatcacattaatttaattactactaggtaataataatgggagacttgagtgataataggggattttaaaactctacagatggcatacctgtgcctgcttctggggttggaagtgtgacttcttacacataaagcactacctaagtaattctctctctgttttgtgccagtgctaaactactgattacttgtaattatgaaaagaaataaagggtgtctatcatatgaagataacgccttccctaagtcacatatcagaataggaagatatgccactaacttctaaagaagttcaaaccctgtatccaattttaatgataaaatagccaagaggtatatcgatgatggaaattagccacatgtacactacattttttctaataaagccatttcttatatgactccttattttaatcaggtcagaagcccttggccatctttactatggtgatcaggtgctttccagtgacttctgagcataggcactgtgtctccatctcaacttatccttgtttctgtgaaatacaatttcatctactaggcccttaaataattatgtgagggtgtctaaatgtttaatatgattacattaaatattgtatgaaaaaatgtaat

SEQ ID NO: 23348 - DNA, 1290 bp, Homo sapiens
gttatttcaaaattcagatgattttcgtatttgtctttttaatccatcagatatttataaacagggacaagagtgatgatgatagagggtacttaaaaaataattatcaaactaacatttaaaggtgattgattttttttctttgaagtaatttattttgtaaccaaagtcaaggtggattaaattgatgaaaagttatgaacaatattgattaaaaatattccacatggaagccccgtcatatattacacacatcacttagtctccagattgtcactatttattgaaagccagtttctaggccttccagggtacatttattataagtactttttaatgcagagcagattccttccggcatacaggtggtggtctgctggtgatacatgaatgtttaaaactgcatgtttttttgtcttacagagttgtcttggttcaactggtgccttcccgggtcgtgtttgctcagtctcctcctcattctgtgcttcagggaatcctatgacagactctatcttgatgtggttgtctccgtttaatagcacagacttgaaggagtttaaaaggaggctggaaatcaatactgcacactgcacatttgctcagaattgcacatctaacaggaaaagagggagaagaaagaaacttcattcagaggttttgttaggttacagattatcacattaatttaattactactaggtaataataatgggagacttgagtgataataggggattttaaaactctacagatggcatacctgtgcctgcttctggggttggaagtgtgacttcttacacataaagcactacctaagtaattctctctctgttttgtgccagtgctaaactactgattacttgtaattatgaaaagaaataaagggtgtctatcatatgaagataacgccttccctaagtcacatatcagaataggaagatatgccactaacttctaaagaagttcaaaccctgtatccaattttaatgataaaatagccaagaggtatatcgatgatggaaattagccacatgtacactacattttttctaataaagccatttcttatatgactccttattttaatcaggtcagaagcccttggccatctttactatggtgatcaggtgctttccagtgacttctgagcataggcactgtgtctccatctcaacttatccttgtttctgtgaaatacaatttcatctactaggcccttaaataattatgtgagggtgtctaaatgtttaatatgattacattaaatattgtatgaaaaaatgtaat

SEQ ID NO: 23349 - DNA, 1442 bp, Homo sapiens
  misc_feature (1326)..(1326): n is a, c, g, or t
  misc_feature (1330)..(1330): n is a, c, g, or t
  misc_feature (1333)..(1333): n is a, c, g, or t
  misc_feature (1348)..(1348): n is a, c, g, or t
  misc_feature (1378)..(1378): n is a, c, g, or t
  misc_feature (1400)..(1400): n is a, c, g, or t
cactgagttgtttattaggcacaagatttaacttggacacttcctccaaacaccccaggttcttgcccagcctcctcgaatacagcctctctgggagtttccctctccccgactcagccgcgctggtccctgccttttcagcgctacctgccctccgtctgggacctggctcctttcctctcgccggtgtttcctcgccacccgcggaggggagggcggaccccagcctccttgccgcctgccccgcctccccgcctccccgccggcccggctcgggccgcgcaggcgcaccaggcgcggtccggaggccgagggcgaccacagcagcctccgcctcctgctgctccggactattctgcgctgggctagtcggcggtgacccggactgcgcccggcagtggcttcgcgggcgacgcgtcgccatgggctctcgctggagcagcgaagaggagaggcagccgctgctggggcccgggctcgggcctgggctgggggcctcctggagaagccgggaggcggcggcggcggcgctgcccgcggcggtcccgggtcccgggcgggtatacgggcgccgctggctggtgctgctgctcttctcgctgctggcgttcgttcagggcctggtctggaacacctggggtcccatccagaactcggcgcgccaggcctacggcttctccagctgggacatcgcgctgctcgtgctgtgggggcccatcggcttcctgccctgcttcgcgttcatgtggctcctggacaagagaggtctccggataactgtgctcctgacatccttccttatggttttgggaactggtctaagatgcatacctatatcagacttaatccttaaaagaagattaattcatggaggacagatgttaaatggattggcaggtccaactgtaatgaatgcagcaccatttctctctacgacgtggttttctgcagatgaaagggccacagccacagctattgcatcaatgctcagttatcttgggggagcatgtgcatttttagttggaccacttgttgttccagctcccaatgggacatcacctcttcttgctgcagagagcagcagggcgcatattaaagatcgcatagaggctgtgttatatgcagaatttggagttgtctgcttaatattttctgcaacactagcttatttcccaccccgacctcctcttcctcccagtgttgctgcagctagccagcggctgagttatcggagaagcgtttgtagattattaagatttcattttatatgttacatatgcatacacttgtgtattctgctgtctgagtctgactaatttaaacacncatntancaaaaaatcaagtgnatgatttgtctaatgagaaatgtgaaacangaagtatatagttaatccatgnaacgtctactaacacatacaattcattaatacacattatgat

SEQ ID NO: 23350 - DNA, 423 bp, Homo sapiens
  misc_feature (16)..(16): n is a, c, g, or t
  misc_feature (28)..(28): n is a, c, g, or t
gggtgacctagaggancccaagctcccnacaagagaggtctccggataactgtgctcctgacatccttccttatggttttgggaactggtctaagatgcatacctatatcagacttaatccttaaaagaagattaattcatggaggacagatgttaaatggattggcaggtccaactgtaatgaatgcagcaccatttctctctacgacgtggttttctgcagatgaaagggccacagccacagctattgcatcaatgctcagttatcttgggggagcttaagcgtccacaacaagaacgggaagaaacggttggagctgaaggtttggtcgactcgcattcggcgtccagtttggagttcagatgtggactcctttccaagatcatcctgggattctttggcttttacttcctatgacttgt

SEQ ID NO: 23351 - DNA, 2516 bp, Homo sapiens
cactgagttgtttattaggcacaagatttaacttggacacttcctccaaacaccccaggttcttgcccagcctcctcgaatacagcctctctgggagtttccctctccccgactcagccgcgctggtccctgccttttcagcgctacctgccctccgtctgggacctggctcctttcctctcgccggtgtttcctcgccacccgcggaggggagggcggaccccagcctccttgccgcctgccccgcctccccgcctccccgccggcccggctcgggccgcgcaggcgcaccaggcgcggtccggaggccgagggcgaccacagcagcctccgcctcctgctgctccggactattctgcgctgggctagtcggcggtgacccggactgcgcccggcagtggcttcgcgggcgacgcgtcgccatgggctctcgctggagcagcgaagaggagaggcagccgctgctggggcccgggctcgggcctgggctgggggcctcctggagaagccgggaggcggcggcggcggcgctgcccgcggcggtcccgggtcccgggcgggtatacgggcgccgctggctggtgctgctgctcttctcgctgctggcgttcgttcagggcctggtctggaacacctggggtcccatccagaactcggcgcgccaggcctacggcttctccagctgggacatcgcgctgctcgtgctgtgggggcccatcggcttcctgccctgcttcgcgttcatgtggctcctggacaagagagattaattcatggaggacagatgttaaatggattggcaggtccaactgtaatgaatgcagcaccatttctctctacgacgtggttttctgcagatgaaagggccacagccacagctattgcatcaatgctcagttatcttgggggagcatgtgcatttttagttggaccacttgttgttccagctcccaatgggacatcacctcttcttgctgcagagagcagcagggcgcatattaaagatcgcatagaggctgtgttatatgcagaatttggagttgtctgcttaatattttctgcaacactagcttatttcccaccccgacctcctcttcctcccagtgttgctgcagctagccagcggctgagttatcggagaagcgtttgtagattattaagcaattttcgatttttgatgattgctttagcatatgccataccacttggtgtatttgctggctggtctggagttctggacttaattttaacaccagcgcatgtcagccaagtagatgctggctggattggattttggtccatagttggaggctgtgttgttggaatagctatggcaaggtttgcagattttatcaggggtatgctgaaactaattcttctcctcctgttttcgggagctacactgtcatccacgtggttcaccctgacctgtttgaacagcatcacacacctacctttaaccacagtgacattgtatgcctcctgtattctcctgggagtgttcttgaatagcagcgtgcctatattttttgagctttttgtggaaactgtctacccagttccagaaggaattacttgtggagttgtcacttttttaagtaatatgtttatgggagtacttttattttttctcacattttatcatacagagttgtcttggttcaactggtgccttcccgggtcgtgtttgctcagtctcctcctcattctgtgcttcagggaatcctatgacagactctatcttgatgtggttgtctccgtttaatagcacagacttgaaggagtttaaaaggaggctggaaatcaatactgcacactgcacatttgctcagaattgcacatctaacaggaaaagagggagaagaaagaaacttcattcagaggttttgttaggttacagattatcacattaatttaattactactaggtaataataatgggagacttgagtgataataggggattttaaaactctacagatggcatacctgtgcctgcttctggggttggaagtgtgacttcttacacataaagcactacctaagtaattctctctctgttttgtgccagtgctaaactactgattacttgtaattatgaaaagaaataaagggtgtctatcatatgaagataacgccttccctaagtcacatatcagaataggaagatatgccactaacttctaaagaagttcaaaccctgtatccaattttaatgataaaatagccaagaggtatatcgatgatggaaattagccacatgtacactacattttttctaataaagccatttcttatatgactccttattttaatcaggtcagaagcccttggccatctttactatggtgatcaggtgctttccagtgacttctgagcataggcactgtgtctccatctcaacttatccttgtttctgtgaaatacaatttcatctactaggcccttaaataattatgtgagggtgtctaaatgtttaatatgattacattaaatattgtatgaaaaaatgtaat

SEQ ID NO: 23352 - DNA, 1206 bp, Homo sapiens
ctggcagatgtgtgatgctttgtcaaactttatcaactacctttgaaaagaagaaatttttgagtcaatacttaggaaagagaacaccccgaagatctatctgatatgactcactgccgctagtgtgaaactaaaatgtttgtgtttttattttagtgacattgtatgcctcctgtattctcctgggagtgttcttgaatagcagcgtgcctatattttttgagctttttgtggaaactgtctacccagttccagaaggaattacttgtggagttgtcacttttttaagtaatatgtttatgggagtacttttattttttctcacattttatcatacagagttgtcttggttcaactggtgccttcccgggtcgtgtttgctcagtctcctcctcattctgtgcttcagggaatcctatgacagactctatcttgatgtggttgtctccgtttaatagcacagacttgaaggagtttaaaaggaggctggaaatcaatactgcacactgcacatttgctcagaattgcacatctaacaggaaaagagggagaagaaagaaacttcattcagaggttttgttaggttacagattatcacattaatttaattactactaggtaataataatgggagacttgagtgataataggggattttaaaactctacagatggcatacctgtgcctgcttctggggttggaagtgtgacttcttacacataaagcactacctaagtaattctctctctgttttgtgccagtgctaaactactgattacttgtaattatgaaaagaaataaagggtgtctatcatatgaagataacgccttccctaagtcacatatcagaataggaagatatgccactaacttctaaagaagttcaaaccctgtatccaattttaatgataaaatagccaagaggtatatcgatgatggaaattagccacatgtacactacattttttctaataaagccatttcttatatgactccttattttaatcaggtcagaagcccttggccatctttactatggtgatcaggtgctttccagtgacttctgagcataggcactgtgtctccatctcaacttatccttgtttctgtgaaatacaatttcatctactaggcccttaaataattatgtgagggtgtctaaatgtttaatatgattacattaaatattgtatgaaaaaatgtaat

SEQ ID NO: 23353 - DNA, 1720 bp, Homo sapiens
cactgagttgtttattaggcacaagatttaacttggacacttcctccaaacaccccaggttcttgcccagcctcctcgaatacagcctctctgggagtttccctctccccgactcagccgcgctggtccctgccttttcagcgctacctgccctccgtctgggacctggctcctttcctctcgccggtgtttcctcgccacccgcggaggggagggcggaccccagcctccttgccgcctgccccgcctccccgcctccccgccggcccggctcgggccgcgcaggcgcaccaggcgcggtccggaggccgagggcgaccacagcagcctccgcctcctgctgctccggactattctgcgctgggctagtcggcggtgacccggactgcgcccggcagtggcttcgcgggcgacgcgtcgccatgggctctcgctggagcagcgaagaggagaggcagccgctgctggggcccgggctcgggcctgggctgggggcctcctggagaagccgggaggcggcggcggcggcgctgcccgcggcggtcccgggtcccgggcgggtatacgggcgccgctggctggtgctgctgctcttctcgctgctggcgttcgttcagggcctggtctggaacacctggggtcccatccagaactcggcgcgccaggcctacggcttctccagctgggacatcgcgctgctcgtgctgtgggggcccatcggcttcctgccctgcttcgcgttcatgtggctcctggacaagagaggtctccggataactgtgctcctgacatccttccttatggttttgggaactggtctaagatgcatacctatatcagacttaatccttaaaagaagattaattcatggaggacagatgttaaatggattggcaggtccaactgtaatgaatgcagcaccatttctctctacgacgtggttttctgcagatgaaagggccacagccacagctattgcatcaatgctcagttatcttgggggagcatgtgcatttttagttggaccacttgttgttccagctcccaatgggacatcacctcttcttgctgcagagagcagcagggcgcatattaaagatcgcatagaggctgtgttatatgcagaatttggagttgtctgcttaatattttctgcaacactagcttatttcccaccccgacctcctcttcctcccagtgttgctgcagctagccagcggctgagttatcggagaagcgtttgtagattattaagcaattttcgatttttgatgattgctttagcatatgccataccacttggtgtatttgctggctggtctggagttctggacttaattttaacaccagcgcatgtcagccaagtagatgctggctggattggattttggtccatagttggaggctgtgttgttggaatagctatggcaaggtttgcagattttatcaggggtatgctgaaactaattcttctcctcctgttttcgggagctacactgtcatccacgtggttcaccctgacctgtttgaacagcatcacacacctacctttaaccacaggtgagcataggctatttttgaacttttaataaatattttcattcacagaagtgtacataactctgacagtaggacttcttcttgctttctgtaagtaattgttaaatatacaaaaaagtttctcttgtccagtcatcaaaccatcatcttatctaaagag

SEQ ID NO: 23354 - DNA, 302 bp, Homo sapiens
cctatcaacagcagctgataaaatattaaaagatttgccttgtgtaatgtctctggagagctgtcttactgatgtacgaggccatgattgacaactttgagactttgctggaagcgacaaaagtatatctataatattatgctgaattgcataggtctttcttcttaaatgaggctagaaataacataccaccaagtgtttggcttttaggaaattgagcattttctttagttctagctgcagtttaatttcctcagaattagacattatgcggtatctggaacgttaaaaaaaaaaaaaag

SEQ ID NO: 23355 - DNA, 1306 bp, Homo sapiens
gctttttaacaattttacattttaattcttagtttggtagattggattgaaagaaaggagaaagaacattagcagaaggcactttcccattttcttccaggaatgacttattcctggggtggtgagaattggtgggtggtaaccatccatagtataaaattgttagaaagaatataaactgccaaacaagcatgttatcttcaggcttttccaagcaagaatgaagtcttttgatgtttatgttcattttaagaagacaaacaaactaaaattttaagaccagacacaacccaagttgaattgtgatctcaggaggtgaactctcattcaccatgtggcatattactacctgtatttatatcatggaatttcagggtatatgtgaacatgtctagtatgactcaggtaaacctttaaagaatgtatgttacttaccatttttgtaaagaagcaaacaggagctgaattgttaaccaaaactgttccattaccttgggtcactgtgcaaactaattcagggtacagatataaagtttagaagccttgggattaaatgccagcctctttgctcaggcaaaatgaccctgggctttcttgggaagtccagcatgtatgtaaggggtgaggccctgctgacctcagggcttttcgctttaaggagattaaccctagtcacagtgattttcatttaggagctaactaggagtttactctttatgacgtgaaacttcaaagagtatagaaaacttttgtaccacaatcaaagaagaagaaatggtgtatggaaagaaaacaaaacaaaacaagaaatctcttgtaaaatattccaggtcaaagttgtctcctctccaaaccttgcagaagcacctttcttctcttcagcgcactgttttgggactgtttatgcagcagatgtaagtagacaacatggactccatgtgacatgcctctaatagtaaagataaagtattactgaggttaaaaataaaaattgagtagtattaatttaaagtgcaccatcaggacaacaaaccatttaagctgaaaaaacgctattttatttcttgagtttgccagttgcttccaccttgagttaaggacgtgtctcatcttcacctactgcgcattctcccttctctaactgtgtaatatgtcaggtcaaggacattgaatgttatgaattgagaacctaattgatgcgcatagttttcatctatgcaattttacttgcttctgtcactttacgatctgttcatatttggcatcaattaaagatactttttaaggatcttatcaaggaatatct

SEQ ID NO: 23356 - DNA, 581 bp, Homo sapiens
cggccgccgcggctcccgccagggcactgcaaagacgacctgccgcattcccactcgggctctccgctgactcagcaccgcccctgcgccaagccagccggccaggtcaaagttgtctcctctccaaaccttgcagaagcacctttcttctcttcagcgcactgttttgggactgtttatgcagcagatgtaagtagacaacatggactccatgtgacatgcctctaatagtaaagataaagtattactgaggttaaaaataaaaattgagtagtattaatttaaagtgcaccatcaggacaacaaaccatttaagctgaaaaaacgctattttatttcttgagtttgccagttgcttccaccttgagttaaggacgtgtctcatcttcacctactgcgcattctcccttctctaactgtgtaatatgtcaggtcaaggacattgaatgttatgaattgagaacctaattgatgcgcatagttttcatctatgcaattttacttgcttctgtcactttacgatctgttcatatttggcatcaattaaagatactttttaaggatcttatcaaggaatatct

SEQ ID NO: 23357 - DNA, 481 bp, Homo sapiens
cggccgccgcggctcccgccagggcactgcaaagacgacctgccgcattcccactcgggctctccgctgactcagcaccgcccctgcgccaagccagccggccagtaggtgttcagtgagtcctgaatgaagaaagaatattttgctatgttggatgctgtggggaagacccaaggaaatttttgcaagcagggagagggagacatttctggaagaccggaagacctttctggaagagataatgaaacaagcccagaaaaggaagagagccttcaaaaatgacgttaaattcatggcagacctgatactagaaaccagaagtcccagcagggtagaaatattctcacttagacaccaggctatgactgttcagagtgcagcagagactgcttttcgtccttctgttctcactcaggtccaggaattatgtggggttttccatttaggccttctgcttttcaaggctcataaaagcagatta

SEQ ID NO: 23358 - DNA, 150 bp, Homo sapiens
aaaatggcacactgattatctttaacatgattgaggagcaagcactcctaagatgagaaaaccaggagaatgaataaagtgagttttagaccataaaatcggctttctagaaggggcacacttgttcttagtgctcaggaagatggatgg

SEQ ID NO: 23359 - DNA, 283 bp, Homo sapiens
gacacctgctcttagactgaatcaagtaattgagtcatcatttcagttcaggagcagacatgtgatggcagtagactgcttaacccaagatcaacaaaacaagaataactagttacctcagactaaatggactaaataaatacactgatttaattatggtcaatggtctgttcttcatggatatttaaaaagtggctcacgcctgtaatcccagcactttgggaggccaaggtgggtcaggagttcgagaccagctttgtcaacacggtgaaatcctgtttct

SEQ ID NO: 23360 - DNA, 565 bp, Homo sapiens
gcgggaggaagaggctgggggctgaggtgtgctggggtgggtaggagaccggctgagcccagcacggagccgcttcctggtagccctggcggcatcacccttgggtcgggttccagagcccgggggtcctttcagctttccgttccttttccttatacttcgtccctctctccagctagagaggggcaggctctggggtctgggtacttttgttttggagccatttaacttgagttataataacatgcttttctgattataaaattaatgcatggctaccataaacaatttggaaaagacagaaaacaagttaacacgttaaaatctcaatcctgtctggtgaggactgcagtgaagcccagctggccaccccttccggggcctctgttctccccagggccttgcagcctctctgggcttggcattgctatggctaaagtgtgaaagggtcatgcaaggctgtcagccctgcgtcccccacgtgtgactgcatggggtcccacccaaatcggagtaatatacccactcagcctcacccctgctctgctggccccagggaggaaat

SEQ ID NO: 23361 - DNA, 177 bp, Homo sapiens
tcgctaaacctaaatatagattaggaagacagaaagttttctagatatgaaatgaagaaagatacaacatgatccaaatagagctacccttcagattttaatgaaaggtttagagagaaaaaaatagtgttcttcaagcttaatgtgaaaacaaatattaccttcaagtggtgtctt

SEQ ID NO: 23362 - DNA, 990 bp, Homo sapiens
cgagactgtgtctaaaaaaaaaaaaacaaaaatggcatttttagtttttaataacggggacaaagcacaggaagcagaaagaggagcaagaaggacctcccacaaggtgcagctcttggctgcagccttaagctcacctcctacatagagtttctttcctggctcttggagtgaagaagggaagctgaaatgtgagaagcccagagctggtacgctcctagacggcgtgttttgggcatgaatcagtgtgcacactgtaaggaaactggtcattggaagagggattgcccagtcttcctccaaagggagctgttaggtccagggccgtgactatgacaaatgtcatgctcagggttagggtgcagcccatgatgaggtctgagaggagtggatggatagatgaatagctgaaagaacattcggggcggtgtagacaggtgaaatgtagttttattcagcagctctctcatcagcagttctctcacactagctcttttatactgttcgcctttatcttggctgtctgctctgactctggaccctctcagcagctagctcccactcacagctgcacaactggtctgcaaggccagctctaagatcagtagcttaacctttctctctgggcacaagctgagccatgtcctggctcccctctatccacctgtcagacagtcattctcccttacaggggtcagtagcttcactctctttctgagcaccagtgcctgcacaagagcgatgctgagccatgttgagtccccgtgcacagtgtcagcagggcagttattccttttacagacagtagtggtgtagagccaagtatgagcttacacaaacaggttatataacaagtggaggtgagtgcctgtgcagcagtctcactgagtcatgcaggcctggatatctgcctcggctattccttgaccaaagcacatccatgtaccttacagcagccatcccgtctaggagcgtaatcggtaccgagcc

SEQ ID NO: 23363 - DNA, 878 bp, Homo sapiens
cgtgactatgacaaatgtcatgctcagggttagggtgcagcccatgatgaggtctgagaggagtggatggatagatgaatagctgaaagaacattcggggcggtgtagacaggtgaaatgtagttttattcagcagctctctcatcagcagttctctcacactagctcttttatactgttcgcctttatcttggctgtctgctctgactctggaccctctcagcagctagctcccactcacagctgcacaactggtctgcaaggccagctctaagatcagtagcttaacctttctctctgggcacaagctgagccatgtcctggctcccctctatccacctgtcagacagtcattctcccttacaggggtcagtagcttcactctctttctgagcaccagtgcctgcacaagagcgatgctgagccatgttgagtccccgtgcacagtgtcagcagggcagttattccttttacagacagtagtggtgtagagccaagtatgagcttacacaaacaggttatataacaagtggaggtgagtgcctgtgcagcagtctcactgagtcatgcaggcctggatatctgcctcggctattccttgaccaaagcacatccatgtaccttacagcagccatctgcacccaagccagatgccaaaataaccagggaagcccaagagtgacggggcgcaagaccttccgctacacctcccgtcggacaactagccatatcttctgagaagcctcagataacccttgacatgacaggtaataatattaacttccttctagaatgcttactctgttttgacccattataatgggcctctgtcatcccaaaactctatggtcaaggggatagacaggcccatagatgcc

SEQ ID NO: 23364 - DNA, 2401 bp, Homo sapiens
  misc_feature (2211)..(2211): n is a, c, g, or t
  misc_feature (2220)..(2220): n is a, c, g, or t
  misc_feature (2222)..(2222): n is a, c, g, or t
  misc_feature (2227)..(2227): n is a, c, g, or t
  misc_feature (2234)..(2234): n is a, c, g, or t
  misc_feature (2236)..(2236): n is a, c, g, or t
  misc_feature (2247)..(2247): n is a, c, g, or t
  misc_feature (2253)..(2253): n is a, c, g, or t
  misc_feature (2259)..(2260): n is a, c, g, or t
  misc_feature (2263)..(2263): n is a, c, g, or t
  misc_feature (2271)..(2271): n is a, c, g, or t
  misc_feature (2283)..(2283): n is a, c, g, or t
  misc_feature (2288)..(2288): n is a, c, g, or t
  misc_feature (2295)..(2295): n is a, c, g, or t
  misc_feature (2301)..(2301): n is a, c, g, or t
  misc_feature (2309)..(2309): n is a, c, g, or t
  misc_feature (2315)..(2316): n is a, c, g, or t
  misc_feature (2322)..(2323): n is a, c, g, or t
  misc_feature (2331)..(2331): n is a, c, g, or t
  misc_feature (2345)..(2345): n is a, c, g, or t
  misc_feature (2347)..(2347): n is a, c, g, or t
  misc_feature (2353)..(2353): n is a, c, g, or t
  misc_feature (2369)..(2369): n is a, c, g, or t
ttttttccaaccactttttatctataccccaatgtcttacattccataaaacatcatgttttgaattccagtataactttatcgttaaacatgtttctttgcagaagcatgtataagttagggtccacaagattatttgcataagctaatttacaaaaaaaattatataatcactgacatgaaagcatgtctgggcagccatgggagctcatatgaggcgtccagttcagtcgccttttaaaaatgatatttgcattagctgggcatggtagcatgtgtctgtagtcccagctactcaggggactgaagtgagaggatgcaccagagccccagaagtcaaggctgcagtgagccatgatcacatcactgcaccagcctgggcaacaggagtgaggccttgtctcagtcagtcaatcaatcaatcaataatggtatttggtcttctgaaagaaagtgacattttagctgggccttaaaggggatggtaagattctagtaaagtagagatgaaagcggaggagctttccagctacaaagagtaatctggagatcaggaagagtaagaccctgtctgtccctgaatctaaggaaaaagaaaaaaaaattttgagaaaaatctgaggaacagcaagtagtcctctttaaccagaacaatagaagatcgtaaaagagcagtagagaaaaacatgataggccttttatgtaggtggaggtcaatgacagagtaaggtagtaacatgtgcattgtctttagagatcttctggcctaggttcaaatgctggatcaaataaatatgtactagctgtttcaccataagctcattaccagagttcaaccacccatttctttatattcccacaggccaattttactaaagaattgcaatgaagagttaagcaatttatctgataaatatttttagatttatatttcattcataactagcagcagtattttgaaacagaatacaaaatttatatgaatttttaaagtaatacagtcatcaaagaaattttctatttctagaagactgcttaggcatactcttttgtgatgtgttcattctcctttggcctggaaaagtttgagaactgttgctcattgggatgttgtaaggactaaataagataaactatgtaaacacttaaccatgcttgacccaagatcatcttaaataattgttcttcccttccctgtcaataaatatttattttctccctttccaaggagacacaaagtatggtcttgtgaccaacagcatctgtatcttatgtggactgctgcactggagtattttgagcagtcagaagactgtaaaaggagtgtgtttatgtttgtgtggtgtatgcttgcaaggagtttgatggaaggatgctgaagaggaattttgccatgagccctggtgctggcaaatactaccagaaaacatctccccttcaacagcttggatctcatcactccttaatgtaactaataccatgaattgctcatataaattcagtaacatgcacctactacaggtaaagcagtattcttaaccctgcaagggcaggagcagtgggtgtagtatgagtcaggagccctgcactcaaaggtattatggtctgttagggtataggaaatgggcctgagataagtatactaataaccccaataaattttaagcaccataagaggggtacagagctttgtgagatttaaagatgggacatttcatttaaagatgagtaaggtttcagcatgctgagatggtaagacttaaggaatagcatgagcagaggcactgaggttgtgaatgtggcaacacagccaaggaacagtcagtagtctagtgtgactaaaacaggactttaaagaagtgatggaaaatcaggctggaactgtaggttaaagagcctttaaagccaaggtaaagagttagtactcacgtaggtgatagggaacattggagatttttgagtggggaataatatggctggagctgtatttaaaaagataatacagcctggggtgatttgaagtcagcatagacaagtagtagggaaactaaggagaaagaagtgatctagagaggaagttataatgacttggaggcagggtggctgtgctgagaggagaaagtgggcatctcctgtgagatggtctaggaataccggaaccttttgaaaggtagattctgtagacacagtcatctacacagctgctcatgntgaaacccntntctantaaaaananaaaaattagcngggcanggtggnncangcctgtantcccagctactngggangctgagncagganaatcgctngaaccnnggaggnngaggttgnagtgagccgagatngnaccatngcactccagcctgggngacagagtgagactccgtctcaaaaaaaaaaa

SEQ ID NO: 23365 - DNA, 1148 bp, Homo sapiens
aattcttgtgcctcagcctcccgaatagctgggactacaggcacacgccactacgcccagctagttttttgtattttagtagaaacagggtttcaccgtgttgcccagggtggtctcgaattcctgaactcaggagatcctcccgtctcagcctcccaaagtgctgggattacaggcgtgagccactgcgcccagcctattcataattctttatagggcttattaccaaagaacagaaggctttttaaaagtcatctattgtttagtgattattaaaaataagtcttctgatgaggattacatgtatctaactactgtaaaatagatttcatgtcagtgctacataatcagtatctaggttcagtacctgaaagttcatttgaccatgcctttttatgattttaatcctaccatagtcatttttgtcctatttgccgttcacggaaaactttatcagaatataagtaaatgatcttgaaaacattaatatttatcttttttgtacatactatacattttcttaccatacatattatatgttctctgacctctggaacattaactcacaaattgtttccgttttcctttacctagattgcatgtagatgtcaaaactgtgcaagcaccaaggaatgctaaatgttgaggaatggtcatagacttattaacccacatatactgagattgtttatgagagccatttggtctgagtaacatgtatagggtatgactaaagtaggtggtaaggccaaaaagagtaagtgaggtaaggtgggggtgggttagtggatttaaaaaagtaatttgtagctctaccttcaggaaatgtcagtgattcaacattcaaatctacctaatcaactgtatctttactacctatataagttttgtatgtgagagaatgattctcattttgtatatgtgcatattcagtcttctgattcataggtcctaaatgcttttgtatttatttaggcttattttgaagcccagaatatggtcttttgtggtaaatgttccatttgagctcttgaaaagaatgtatattctggtggttttggacagattgtgctgtaactatcaataaagtcaagttaattaataaattgtgctgtaactatcaataaagtcaagttaattaataatgt

SEQ ID NO: 23366 - DNA, 551 bp, Homo sapiens
  misc_feature (543)..(543): n is a, c, g, or t
gcctcgccaatacagtgaaaccccgtctctactaaaaatacaaaaattagccaggtgtggtggcacgggcccataatcccagctactcaggaggctgaggctggaggattgcttggcgccgggagtttgagactgtagtatgctttgattgcacctgtgaatagccactgtactccagcctgggcaatatagtgagaccctgtcctttaaaacaaaaaagtatagcgcacataataagtgtgtagtaaagtcgtgctgaaaagggtcctcgcagaaccacagttcacttgttgacagacgtcaggactggcagtcttttttttttgagttggcgtctcgctctgtcccccaggctagagtgcagtggcgtgatctcagctcactgcccgctccacctcccgtattcacgccattctcctgcctcagcctctttagtagctgggacttcaggcacctgccaccacgcctggctaattttttgtatttttagtagagacagggtttcaccatgttagccagggtggtttcgatctcctgacatcngtgatcca

SEQ ID NO: 23367 - DNA, 413 bp, Homo sapiens
aaaagtggtatctcaaaaatcactcggacaaaaatgctctgtttactatacagtgtggggactagtggatagctgtttggaaaaagataaaggtagatccatttctttcatcacacccaagaataaactccaaatggatcagagatctaaatataaaaagtaaaactatgcaagtaccaaaaagaaaaaaaacaccccatgagtgaattcttctgaaaccagtgtataaggaaaagctttctaagtgtgactacggtcccatacacaataaaagactgataaatttgactacataataaaaattttacatggcctgaaaaataccactaagtcaaagacagctgacaaactgggagaaaatagtcacaacatatatcagataaaaggttaactcctttatttgagaactttct

SEQ ID NO: 23368 - DNA, 445 bp, Homo sapiens
tgagacgagtctcattctgtcacccacgctggagtgcagtggtgcgatctcagctcactgcaacctctgcctcccaggttcaagcaattcttgtgcctcagcctcccgagtagcttggattacaggtatgcaccaccacgcccagctaatttttgtatttttagtagagatgggagttcaccatgttggcctcgctggccttgaactcctgacttcaggcgatccgcctgcctcagcctcccaaagtgctgggattacaggcgtgagccaccgcatctggcctcatattcttttttgtactgcatggtgtcccattttgcagaataccaaactatgcaaccacatattaacaggtatttaggttttttcagtcttttgctgttacaaactgctgcagtgaacaagcttgtttgtaggtcatttcttaggagtgctaggatacagg

SEQ ID NO: 23369 - DNA, 288 bp, Homo sapiens
tgctaagacccaattccattccctgtgtctcctctttcctaatcctaaaatgcagggtgcatttgccaagttacatttggggtcccttcatgttcccaagtcttttgaagcataagactacttttggggtacactgcgtattgttctgggccattgcctccccccgtttttcctgccactgtgtgctgggtgagtacatacactatacaccccataccaacccacacatgtccccctgttaagcttgatttgcgtacttggcaatttatacttcctgcctttcaaccc

SEQ ID NO: 23370 - DNA, 784 bp, Homo sapiens
aggttccaatttgtccacatccttgccaacacttattttcctttttatagtagccatcctggtgggtgtgaagtggtatctcattgtggttttgatgtacttctctaatgactgatgttgagcatcttctcatgtatttgttggccaatcatataacttctttggagaaatgcctattcaagtcctttgcccctctttgattcagttgtttgtctttttgttgttgagttagaagagttctttataaattctaggtactagacctttgtcagatatgatttgcaaatatattttcttccattcagtaggggtaaatagaatattgagagactttttatatagtaatataaaaaagcatgaagggatgtgttttgcaaaaagtaagattacacagtattatacaactatgttatacactttggctcttggttttctctctaaggaataactcatgaagaacattccatgtgttaaggtatacctctaattctttctaatgcctacataatatcctattgcatgggtgtgctattcaccccctacttatggttattcattctgtttctagtttttggccactgccaacaatgctgcagttaacatccttgtacaatatatgtttatgtattttaaatttcagtttaaaaggatttattctgaggagtagtatttctggtttaaagagtatatgtgtttttaattttaatagatattgctcaattgttttacattaataacttacatttttactagcaatatatgaaaacattctttctgcactgca

SEQ ID NO: 23371 - DNA, 5363 bp, Homo sapiens
gtcaaagaaacccaccttccaaaggtggtacttgtggatctggtgcccggtgatagtgattatgaagtaatttcagatgatattccccttcagttagtgactgacccacctcagttgactgtcaaagatatcagctgtataaatacagaatgtattgatatagaagataagagctgtgacttttttggttctgaagtcagatgtaattgtaaagcctctactccctcaatgacaaaccaatgcaaagagactttcaaaataataaaccggaagaaggactatattattctgggagagccaagttgtcaatcttgtggttctgaaatgaattttaatgttgatgcctctgatcagtccatgacttacgagtcacaaggacctgatgagaaaatggtgaaatatattgattcagaagataagagctgtggatataatggttctaaaggaaaatttaatttggaagacacttctcatcgaacgactcaccgactgcagaaagctcacaaagaagccagtcttcggaaggatccaagaaatgctggcctaaaaggtaagagctgtcagtctagtgcttctgcagtggattttggtgcctcttccaagtcagcgctccatcgaagggctgataaaaaaaaacgttcgaagctaaaacatagagatctagaagtgagctgtgaaccggatggttttgagatgaattttcagtgtgctccccctcttccatctgatactgatcagcctcaagaaactgttaagaaaagacacccttgtaagaaggtatcttctgacttgaaagaaaagaaccatgattcccagtcaagctctgttctcaaggttgattctgtaaggaacctgaaaaaagcaaaggatgtcatagaggataatcctgatgaaccagttcttgaagccttgcctcatgtacctccttcatttgtggggaaaacatggtctcagataatgagagaagatgacataaaaattaatgctctggtgaaggagtttagggaaggtcgtttccactgttactttgatgatgactgtgagaccaaaaaagtttcttcgaaggggaaaaaaaaggttacctgggctgacttgcaaggtaaggaggacactgcaccaactcaagctgtgtcagagagtgatgatattgtctgtggtatttcagatattgatgacttgtcagtggccttagataaaccatgccatcgtcatcctccagcagagaggcctcctaagcaaaaggggcgtgtggcttctcaatgccagacagcgaaaatcagccatagtactcagaccagttgtaagaattacccagtgatgaaaagaaaaataattagacaagaggaagacccaccaaaaagtaagtgttcacgtttacaggatgacagaaaaaccaaaaagaaagtcaaaattgggacagttgaatttcctgcatcatgtactaaagttttgaagcctatgcaacccaaagccttagtctgtgttctttcttctttaaatattaaactgaaagagggtgaaggccttcctttccctaaaatgaggcaccatagttgggataatgatattcggtttatatgcaaatataaacggaatatctttgattattatgagcccttgattaagcaaattgtaattagtcctcccctgagtgtaatagtaccagagtttgagaggcgtaactgggttaaaattcattttaataggagcaaccaaaactccagtgcaggagataatgatgctgatggacaaggctctgcttcagcgcctttaatggcagtgccggcaagatatggatttaattcacatcagggaaccagtgactcttctctgtttctggaagaatcaaaggttctgcatgctcgtgagcttccaaagaaaagaaatttccagctaacatttttaaatcatgatgttgtcaaaatctctccaaaatcagttagaaataagcttttggaaagtcaaagtaaaaagaaaattcatggaaagagggtgacaactagtagtaataagctaggttttcccaaaaaggtttataaaccaattattctccagcaaaaacccagaaaagcttcagagaaacagtcaatttggattcggaccaaaccaagtgatatcattagaaagtatatttcgaaatactctgtctttttacgtcatagatatcagtccaggagcgcttttcttggaaggtatctgaagaagaaaaaatctgttgtcagtaggctaaagaaggcgaagagaacagctaaagtgcttttgaactcttcagttccaccagctggtgccgaagagctgtcaagcgctatggcaaatcctcctccaaagcgacctgtgcgggcttcttgccgcgttgcaagaaggaggaagaagactgatgaaagctaccatggccgacagaaaggtccttctacacctgtgagagcatatgatctgagaagctcatcttgtttacaacaacgtgagagaatgatgactcggctagcaaacaaactgagaggtaatgaggtaaaatagaagttggttttgtgttcaggctagttgaggattcagtacttcagttgaaatatatttggtactttgtgcacacagctttcccagctttggtgagaaaactaatcttgaactattttgctataaatattatttttcagaatttttatattcatttaaaattagtgtttagagtcctttcattttaagattcagaaacagcctttgtccaacattttctgtagaagaacttcatcttaatttatgtcacaaaataatttagcaccgtatatagaattttgttcctcaaatcatatccctcttattttttatgattatctctctcatgccagcaaatttaacattgtgagaatgaatatagcaaacttattaaaaagaaggaattataatgaattatgtcaacttttgaatggggttgacttaaatgaatacaaacaaaatataagttttctttctttttaaagcattccagaaaatgagattccataatctttaatacagtttttaaaaactggtgattttttttatgcatagcacaaactcctcctgcttcatttaaattggatctgcaagtctctaacttttatcatttggacacatgcacacatacagtctctaggttttttgggttagccttattagatcttaaaggggaaaataattttgcccatgtgtttaggcattcccccccttttttttaaccacctttactctcttctacatgaagagttggtggcttaatatgaaaatccaggttattttgtggccttatcccctaaaaatattttaggcattaccatatcagtttttatttttatgtttatttattattattattttttgagacagagtctcactgtcttgcccaggctggagtgcagtggcctgaacttagctcaccgcaacctccacctcccgggttcaagcaattctcctgcctaagcctctcgagtagctgggactacaggcgtgcgccaccatgcccggctaatttttgtatttttagtagagttgggggtttcactatgttggccaggctggtctcaaactcctgaccttgtggtccacccgcctcagcctcccaaagtgctgggattacagtcatgagccaccatgcccagcctaccatatcagtttttaataacttgaactgaaattattggcttggtaatatttgggcaggccattaattctcattagaaaattacttaatatttcaaaaaattgaataaaactggtaatctttgtggaggcccattttgcaagtggaaacctgtatttatacattagtttgtctttaactatttgttaacagattttaacagttcaaatgaaagatgttaacgagatgcagtttgagtctgggatactcagaatagatccagaacctttattcagggacactggttgagttggtacagatgcattcagttgtcattcattcgtgttaagccaagatcctggatcttctatcattaatgttaagaggaaacatgaattacaactatattgtatgactgccatattttattgaaactaaggtcaatgttgaaccatatcttgatttcagaatttaaaatgtgttaccttagaaataatgaaatatagtgtaacagttggtttctaaatgtggttttatttcaggggccattatttaacctgtgtgtatgctatgatggagttcttttgtgatttctttacttctaaatttaaatagtaattatgtttaaaaacaaatgtttttgtctttagttgcaaagcagcatatatctcatttccttcaaccttgcctcctcatacacaaatatattttcatttcttaaaagatcactgggccagtagttcaaaataatcctccaattttaatttaggaacaaagctttgtcctactgactaggaagtaaacaaacagctgatatataagatatttgtgggtattggtgtcttttttccctatggaatagacacatagttcccttaaatattattaatagacattctacagtctttcagtgtaagtttaaaagcaagagatcaaatgaaaatgtgtactatgtacctatgatgtgtcatatcgtgattacatcatgcagagagaacagttcctgtaattcaagtaattaaaatttcaagttgtaaaaatgttaccattttcacattggaagcccttctaagtaccattttcattgggggcagggagaaggtttatatttaaattttatattaccagacataaaagtacagtgcagtactgatgattttgtttaaagtttttgaaatgttttgtttactaagttcttgtaatcattattttagacaagcttgaaaacttgaaattgttgaaacttataatttaaattaaattggaaattactttcagaatttggtagtatacaagatgtgcccctttgtctaaataaatgttggcttaatttgcagaatagataaaacaattgatgtttttgtgtgttcaagaatgcattaaattcttttaatagtaaaaagtcaaattacgaccataatgagtattttaatcttgttcttgttcagtattttgcgtagatttttattgtaattgtcctgagttctacagtatgtgaacaatatcgtgtgaagtgtgtttttgcatttgtgcatttaaattatttatgtaactagggctgtgagtaacactttttttttttttttttggttaaagaaaagctatatttaaatattcaaataattatatatttccatgtaaaactaatgtgaagactaatgtattttttatattgcagtgtaaaagctaaacttgtttttgatgttatcaagataaaatttattaaaccttgaaatttgtctgttct

SEQ ID NO: 23372 - DNA, 141 bp, Homo sapiens
aattcaagcttctaacgatgtacggggacatgtaaaactaatgtgaagactaatgtattttttatattgcagtgtaaaagctaaacttgtttttgatgttatcaagataaaatttattaaaccttgaaatttgtctgttct

SEQ ID NO: 23373 - DNA, 5311 bp, Homo sapiens
gtcaaagaaacccaccttccaaaggtggtacttgtggatctggtgcccggtgatagtgattatgaagtaatttcagatgatattccccttcagttagtgactgacccacctcagttgactgtcaaagatatcagctgtataaatacagaatgtattgatatagaagataagagctgtgacttttttggttctgaagtcagatgtaattgtaaagcctctactccctcaatgacaaaccaatgcaaagagactttcaaaataataaaccggaagaaggactatattattctgggagagccaagttgtcaatcttgtggttctgaaatgaattttaatgttgatgcctctgatcagtccatgacttacgagtcacaaggacctgatgagaaaatggtgaaatatattgattcagaagataagagctgtggatataatggttctaaaggaaaatttaatttggaagacacttctcatcgaacgactcaccgactgcagaaagctcacaaagaagccagtcttcggaaggatccaagaaatgctggcctaaaaggtaagagctgtcagtctagtgcttctgcagtggattttggtgcctcttccaagtcagcgctccatcgaagggctgataaaaaaaaacgttcgaagctaaaacatagagatctagaagtgagctgtgaaccggatggttttgagatgaattttcagtgtgctccccctcttccatctgatactgatcagcctcaagaaactgttaagaaaagacacccttgtaagaaggtatcttctgacttgaaagaaaagaaccatgattcccagtcaagctctgttctcaaggttgattctgtaaggaacctgaaaaaagcaaaggatgtcatagaggataatcctgatgaaccagttcttgaagccttgcctcatgtacctccttcatttgtggggaaaacatggtctcagataatgagagaagatgacataaaaattaatgctctggtgaaggagtttagggaaggtcgtttccactgttactttgatgatgactgtgagaccaaaaaagtttcttcgaaggggaaaaaaaaggttacctgggctgacttgcaaggtaaggaggacactgcaccaactcaagctgtgtcagagagtgatgatattgtctgtggtatttcagatattgatgacttgtcagtggccttagataaaccatgccatcgtcatcctccagcagagaggcctcctaagcaaaaggggcgtgtggcttctcaatgccagacagcgaaaatcagccatagtactcagaccagttgtaagaattacccagtgatgaaaagaaaaataattagacaagaggaagacccaccaaaaagtaagtgttcacgtttacaggatgacagaaaaaccaaaaagaaagtcaaaattgggacagttgaatttcctgcatcatgtactaaagttttgaagcctatgcaacccaaagccttagtctgtgttctttcttctttaaatattaaactgaaagagggtgaaggccttcctttccctaaaatgaggcaccatagttgggataatgatattcggtttatatgcaaatataaacggaatatctttgattattatgagcccttgattaagcaaattgtaattagtcctcccctgagtgtaatagtaccagagtttgagaggcgtaactgggttaaaattcattttaataggagcaaccaaaactccagtgcaggagataatgatgctgatggacaaggctctgcttcagcgcctttaatggcagtgccggcaagatatggatttaattcacatcagggaaccagtgactcttctctgtttctggaagaatcaaaggttctgcatgctcgtgagcttccaaagaaaagaaatttccagctaacatttttaaatcatgatgttgtcaaaatctctccaaaatcagttagaaataagcttttggaaagtcaaagtaaaaagaaaattcatggaaagagggtgacaactagtagtaataagctaggttttcccaaaaaggtttataaaccaattattctccagcaaaaacccagaaaagcttcagagaaacagtcaatttggattcggaccaaaccaagtgatatcattagaaagtatatttcgaaatactctgtctttttacgtcatagatatcagtccaggagcgcttttcttggaaggtatctgaagaagaaaaaatctgttgtcagtaggctaaagaaggcgaagagaacagctaaagtgcttttgaactcttcagttccaccagctggtgccgaagagctgtcaagcgctatggcaaatcctcctccaaagcgacctgtgcgggcttcttgccgcgttgcaagaaggaggaagaagactgatgaaagctaccatggccgacagaaaggtccttctacacctgtgagagcatatgatctgagaagctcatcttgtttacaacaacgtgagagaatgatgactcggctagcaaacaaactgagaggtaatgaggtaaaatagaagttggttttgtgttcaggctagttgaggattcagtacttcagttgaaatatatttggtactttgtgcacacagctttcccagctttggtgagaaaactaatcttgaactattttgctataaatattatttttcagaatttttatattcatttaaaattagtgtttagagtcctttcattttaagattcagaaacagcctttgtccaacattttctgtagaagaacttcatcttaatttatgtcacaaaataatttagcaccgtatatagaattttgttcctcaaatcatatccctcttattttttatgattatctctctcatgccagcaaatttaacattgtgagaatgaatatagcaaacttattaaaaagaaggaattataatgaattatgtcaacttttgaatggggttgacttaaatgaatacaaacaaaatataagttttctttctttttaaagcattccagaaaatgagattccataatctttaatacagtttttaaaaactggtgattttttttatgcatagcacaaactcctcctgcttcatttaaattggatctgcaagtctctaacttttatcatttggacacatgcacacatacagtctctaggttttttgggttagccttattagatcttaaaggggaaaataattttgcccatgtgtttaggcattcccccccttttttttaaccacctttactctcttctacatgaagagttggtggcttaatatgaaaatccaggttattttgtggccttatcccctaaaaatattttaggcattaccatatcagtttttatttttatgtttatttattattattattttttgagacagagtctcactgtcttgcccaggctggagtgcagtggcctgaacttagctcaccgcaacctccacctcccgggttcaagcaattctcctgcctaagcctctcgagtagctgggactacaggcgtgcgccaccatgcccggctaatttttgtatttttagtagagttgggggtttcactatgttggccaggctggtctcaaactcctgaccttgtggtccacccgcctcagcctcccaaagtgctgggattacagtcatgagccaccatgcccagcctaccatatcagtttttaataacttgaactgaaattattggcttggtaatatttgggcaggccattaattctcattagaaaattacttaatatttcaaaaaattgaataaaactggtaatctttgtggaggcccattttgcaagtggaaacctgtatttatacattagtttgtctttaactatttgttaacagattttaacagttcaaatgaaagatgttaacgagatgcagtttgagtctgggatactcagaatagatccagaacctttattcagggacactggttgagttggtacagatgcattcagttgtcattcattcgtgttaagccaagatcctggatcttctatcattaatgttaagaggaaacatgaattacaactatattgtatgactgccatattttattgaaactaaggtcaatgttgaaccatatcttgatttcagaatttaaaatgtgttaccttagaaataatgaaatatagtgtaacagttggtttctaaatgtggttttatttcaggggccattatttaacctgtgtgtatgctatgatggagttcttttgtgatttctttacttctaaatttaaatagtaattatgtttaaaaacaaatgtttttgtctttagttgcaaagcagcatatatctcatttccttcaaccttgcctcctcatacacaaatatattttcatttcttaaaagatcactgggccagtagttcgaagtaaacaaacagctgatatataagatatttgtgggtattggtgtcttttttccctatggaatagacacatagttcccttaaatattattaatagacattctacagtctttcagtgtaagtttaaaagcaagagatcaaatgaaaatgtgtactatgtacctatgatgtgtcatatcgtgattacatcatgcagagagaacagttcctgtaattcaagtaattaaaatttcaagttgtaaaaatgttaccattttcacattggaagcccttctaagtaccattttcattgggggcagggagaaggtttatatttaaattttatattaccagacataaaagtacagtgcagtactgatgattttgtttaaagtttttgaaatgttttgtttactaagttcttgtaatcattattttagacaagcttgaaaacttgaaattgttgaaacttataatttaaattaaattggaaattactttcagaatttggtagtatacaagatgtgcccctttgtctaaataaatgttggcttaatttgcagaatagataaaacaattgatgtttttgtgtgttcaagaatgcattaaattcttttaatagtaaaaagtcaaattacgaccataatgagtattttaatcttgttcttgttcagtattttgcgtagatttttattgtaattgtcctgagttctacagtatgtgaacaatatcgtgtgaagtgtgtttttgcatttgtgcatttaaattatttatgtaactagggctgtgagtaacactttttttttttttttttggttaaagaaaagctatatttaaatattcaaataattatatatttccatgtaaaactaatgtgaagactaatgtattttttatattgcagtgtaaaagctaaacttgtttttgatgttatcaagataaaatttattaaaccttgaaatttgtctgttct

SEQ ID NO: 23374 - DNA, 619 bp, Homo sapiens
tggggatctgcttccaagttcacttatgttattggcaggccttgcttccttgccacatgtgtctctcaacatggctgccttccagcatgacatttggcttatcccaggttgtgagtgatccaggagagagcaagagaggagggtgcatgccaagatggaagccatagtctttttataacctaatctcagaagtgacatcttattacttctgtctcattaagtttgtaagaaacaagtcacccagtctaggggaggcagttacacaagtgtgtgactaccatgaggtagtgatcattgccaccttagaggctacctactataagcaaactaatataatatttgtggtattttacattcttcaatttacattgccatgtacttagcagttggttcctatttattatgccttaagagctgcttgttatctccctttctcactattcaacaagatacttgaatcaattttatctttgcttctttcccctctgcccccatctaaatgttcagtgctttggaatgctgaggtgggaagatcacttgagcccaggagtttgaggctgcggtgagctacaattgcaccactgctctctagctagggtgacggcaaggccccatcatt

SEQ ID NO: 23375 - DNA, 285 bp, Homo sapiens
agggggctgaggtgggaggattgcttgagctcaggagttcaaggctgcagtgagttatgattgtgccgttgcattctagcctgagcaacctgtctcaaaaaaatttttttaatttaaaaaataaattagtcgagcatgatgtcacatgcctgtagtcctagctacccaggagtctgaggtgggaggatctcttgagtccaggagtttgaggctgcagtgaactatgatcatgccacggcactgaacttgggtgacagagtgagaccctgtcccaaaaaaaaaaaa

SEQ ID NO: 23376 - DNA, 339 bp, Homo sapiens
gtcttctcttaggaactcctagtcttgggaaaaaggaatggggaagggctgtaatgtgaagttaaaaaaaagtgctgaggccgaacacatctgggccctcactgcagccctattgcacacacactgcatcacctcgaacaagttattcaccctctctgaattcatctatttgcccataaaaatagagatgatccttttatatgttggctaccacttattatgtgcagcatgcttgttattgtactaagttactcattttttagtttttcatataactcatatttttgttgatttttattttaaaattccaaacgaattaattaaactattttccaaaat

SEQ ID NO: 23377 - DNA, 432 bp, Homo sapiens
tctcactctgtcacccaggctgagtgcagtggcacgatcacagctcactgtagccttgaactcctgagcttaagcagtgccccaccttagtctccaagtagctgggataaaggcacacgctgctattcctggctcatttttaaatttttaaagtagagactcccgcttcagcctcccaaagtgctaggatttgtaattttcaatcttttgagatatgagaaaatgaaaaatagttttctactagggcacataactcttcatgtaagagtttaggtgtctgttacacattgtggatattacttagtcctttctggttctgttaaaactaatttccttcagaaaacacagtagtggccaggcacagtggctcatacctgtaattccagcactttgggaggctaaggcgagtggattgcttgagcccaggggttc

SEQ ID NO: 23378 - DNA, 328 bp, Homo sapiens
ctgggagacagagcgagactccgtctcaaaaaaaaaaaaaaaaattatagagttggggtcttgctacattgccaagactggtcttgaactcctggggtcaagcatcctcctgtcttggcctcccaaagtgttgggattagaagcatgagccgctgtgcccagcctgacggggccttttagtgggaggagttgccattacactacgtccagtaagctccagactttcggaaaagattggtggacgggaatgctgtcatggatgggatcttgccaagaaccatcacgtgttaatttagttgcttaaacaaaaggtgttctgtttcttaac

SEQ ID NO: 23379 - DNA, 233 bp, Homo sapiens
tcaattcctcctggctcagacccctccaggactctggcactgatctctcttggtctcggatttgaggaaataaaaatagaagaggaaaaacacagaactctccaaagctttggagtggctgcagccatctggatggaggcagcatgcgcctgggctggaagagccacggtcccttgactgagtctcggtgcttctccccgtccctctcagacacggttctcatggtggacgag

SEQ ID NO: 23380 - DNA, 415 bp, Homo sapiens
taaaaataattttgtcttttttactcgcattcacccaagagtgtacgttgttgttttccagaggctatatgatactgcacatatgatattgcagcagagtacatacagaagcatataaaagaattcatttgtagggccgggcgtggtggcttatgcctgtaatctcagcactttgggaggccgaggcaggtggatcccttgaggtcaggagtatgagactagactggccaacatggtgaaaccccatctctactaaaaatacaaaaattagccaggcgtggtggtgcacccctgtaatcctagctactttggaggctgaggcccgagaatctctggaacccgggagatggaggttgcagtgagccaagattgtgccactgcactccagcctgggtgacagagtaagactctgtct

SEQ ID NO: 23381 - DNA, 152 bp, Homo sapiens
gccacacagccacccccagcgccgcccccaccagtccccgcgccgcccgaagcagcagccacagagaggctggcggctgcggccgagaggctggcggcggccactacggcggcctcctgcaaggagtcgtcgtcgtcgtcgaagcgcggccg

SEQ ID NO: 23382 - DNA, 395 bp, Homo sapiens
tagaagccatattctaggtcctgcttcaggaggatttctttatctcagattatgtgtgaatgatggagttgttttaacaagacccttctagagctgcttgaggtgatcagggggcctgagttgacaacgtcgccccccttgattgctttggaatctctaggagcagccttgggtggtattctagggcaagtacaggcaacaacccttcttctagaaacctggttgtgcccctgggcaattccaggacccctctccaccccaccaaagttaccacaccagaagtcaggaatagctccctttgcccgtgtcttgtctgcctgtgttaaagcctttgctgtgttgtatgtggctggtttccattcatcaggggcttcttgatcaattgtgatgtgtat

SEQ ID NO: 23383 - DNA, 242 bp, Homo sapiens
gtgcgtgacttgaagaacaagtgcctgatttttagtatagtcacagaattgtgtaactgtcaccataatcaatcttcagaacatattcatcaccccagcaagaaaccccatacccattagtaattgctcctttttttcaccccacccttcagcctcctctctccagcccctgggaaccctaatctacttctttgtttctgtgaacttgcctattctcaatatttcatatgaatggaataata

SEQ ID NO: 23384 - DNA, 1006 bp, Homo sapiens
gccaagtcttatgtccagaatggtatttcttaggttatttttcagagtttttatagtttaatgttttatatttaagtctttaatccttcttaagttgatttttgtatgcagagtaagctgggggcccagtttcaatcttctgcatatggctagccagtaatcccagcaccatttattaaatggggacttctttccccattgcttgtttttgtcagctttgtccaagatcagatgattgtaggtgtacagcattatttctggactctctgttatgttccatttatctgtgtgtctgtttttctactaataccatgctgttttggttactgtagctctgtagtatggtttgaggtttggtaacttgatgcctccccttttgttctttatgtttaggattgccttggctaggctcttttttggttccatatgaattttaaagtagtttctaattctgtgaagaatgtcattggtagtttgatagggatagcattgaactatttgctcaactcaacattttaggaatttatttctgctgtctagtgctcaaaacttgcagctagaattgagggaagagagagaccttcttatattgttttatattgtttgatactcagtacctgttttaagaaaaaacaacaaggaagtaaaaccaaagacaggcagcccagcgccaggcccaaaaccaggcctgggcctgcctggcctaaacccagtagttaaaaatcaactcattgcctgtaatcccagcactttgggaggccgagacgggtggatcacgaggtcaggagatcgagaccatcctggctaacacggtgaaaccccgtctctactaaaaatacaaaaattagccgggcatggtggcacgcgcctgtagtcccagctacacgggaggctgaggcaggagaatggcgtgaacccaggaggcggagcttgcagtgagtcgagatcgcgccactgcactccagcctgggcgacagagcgaaactccgtctcaaaaaaaaaaaaa

SEQ ID NO: 23385 - DNA, 644 bp, Homo sapiens
cagcctattattaatgcacatttaggttgattccttatctttgctattgtgaacagtgctgcaatggacatacacgtgcatgtgcctttatggtacaatgatttatatttccttgggatatgcattcctttgggaataatgggattgctgagttgaatggtaattctgagttctttgaggaatcaccaacctgctttccacagtggctaaactaatttacactcccaccaacagtgtatgtgttccattttctccacaaccttgccagcatctgttatttattgactttctagtaacagccattctgactggtgtgagatggtatgcacttctgtagtgattagtgatgatgagtgatttttatatgctttttaaatgcatatatgtcttcttttgaaatgtgttcatgttctttgcccactttctttttaatggggttgcttgtttttcgcttgtaaattttttgaagcttcttatagattctggatattagatctttgttggatgcatagttggcaaatattttctaccattctgtaggttgtctgttactttgttaattgtttcattttgttttgtttttgttttttgaaacaggtccagcctgggcgacagagcgaaactccgtctcaaaaaaaaaaaaa

SEQ ID NO: 23386 - DNA, 2451 bp, Homo sapiens
tgtcctttcaatttcggttctcacagactcttacttggatgtctgtaaatccggctggactttcagcttctaagaacagtccgtttctcgaggatccaggcgcaggaggacagagcaatgggtgagagaactcttcacgctgcagtgcccacaccaggttatccagaatctgaatccatcatgatggcccccatttgtctagtggaaaaccaggaagagcagctgacagtgaattcaaaggcattagagattcttgacaagatttctcagcccgtggtggtggtggccattgtagggctataccgcacaggaaaatcctatctcatgaatcgtcttgcaggaaagcgcaatggcttccctctgggctccacggtgcagtctgaaactaagggcatctggatgtggtgtgtgccccacctctctaagccaaaccacaccctggtccttctggacaccgagggcctgggcgatgtagaaaagagtaaccctaagaatgactcgtggatctttgccctggctgtgcttctaagcagcagctttgtctataacagcgtgagcaccatcaaccaccaggccctggagcagctgcactatgtgactgagctagcagagctaatcagggcaaaatcctgccccagacctgatgaagctgaggactccagcgagtttgcgagtttctttccagactttatttggactgttcgggattttaccctggagctaaagttagatggaaaccccatcacagaagatgagtacctggagaatgccttgaagctgattccaggcaagaatcccaaaattcaaaattcaaacatgcctagagagtgtatcaggcatttcttccgaaaacggaagtgctttgtctttgaccggcctacaaatgacaagcaatatttaaatcatatggacgaagtgccagaagaaaatctggaaaggcatttccttatgcaatcagacaacttctgttcttatatcttcacccatgcaaagaccaagaccctgagagagggaatcattgtcactggaaagcggctggggactctggtggtgacttatgtagatgccatcaacagtggagcagtaccttgtctggagaatgcagtgacagcactggcccagcttgagaacccagcggctgtgcagagggcagccgaccactatagccagcagatggcccagcaactgaggctccccacagacacgctccaggagctgctggacgtgcatgcagcctgtgagagggaagccattgcagtcttcatggagcactccttcaaggatgaaaaccatgaattccagaagaagcttgtggacaccatagagaaaaagaagggagactttgtgctgcagaatgaagaggcatctgccaaatattgccaggctgagcttaagcggctttcagagcacctgacagaaagcattttgagaggaattttctctgttcctggaggacacaatctctacttagaagaaaagaaacaggttgagtgggactataagctagtgcccagaaaaggagttaaggcaaacgaggtcctccagaacttcctgcagtcacaggtggttgtagaggaatccatcctgcagtcagacaaagccctcactgctggagagaaggccatagcagcggagcgggccatgaaggaagcagctgagaaggaacaggagctgctaagagaaaaacagaaggagcagcagcaaatgatggaggctcaagagagaagcttccaggaaaacatagctcaactcaagaagaagatggagagggaaagggaaaaccttctcagagagcatgaaaggctgctaaaacacaagctgaaggtacaagaagaaatgcttaaggaagaatttcaaaagaaatctgagcagttaaataaagagattaatcaactgaaagaaaaaattgaaagcactaaaaatgaacagttaaggctcttaaagatccttgacatggctagcaacataatgattgtcactctacctggggcttccaagctacttggagtagggacaaaatatcttggctcacgtatttaagagcctgaatattccaggtaagaaaatataaaatgaggtttattttattttaataacataacactgttgctcattttgtaagtataagtgttatagcagtttcattcaagaaaagtttaaaattaaaaagtgattatcaaagaatatcagggcctgacatccacaaaaaacaaacttaattttgattgaactaataatttataaacatgggaaacaagtcagaagtagtgacattattcctagaaaagatttaaggaaagcaaaaagacaactggtaagattaagaagccattaaccatttgcaatttatattatagtcacagaaataatttcagttatgactagctcttgccgattaatgagaagagagcagctccacaatttttaatttttttaacttttattttagat

SEQ ID NO: 23387 - DNA, 2253 bp, Homo sapiens
tgtcctttcaatttcggttctcacagactcttacttggatgtctgtaaatccggctggactttcagcttctaagaacagtccgtttctcgaggatccaggcgcaggaggacagagcaatgggtgagagaactcttcacgctgcagtgcccacaccaggttatccagaatctgaatccatcatgatggcccccatttgtctagtggaaaaccaggaagagcagctgacagtgaattcaaaggcattagagattcttgacaagatttctcagcccgtggtggtggtggccattgtagggctataccgcacaggaaaatcctatctcatgaatcgtcttgcaggaaagcgcaatggcttccctctgggctccacggtgcagtctgaaactaagggcatctggatgtggtgtgtgccccacctctctaagccaaaccacaccctggtccttctggacaccgagggcctgggcgatgtagaaaagagtaaccctaagaatgactcgtggatctttgccctggctgtgcttctaagcagcagctttgtctataacagcgtgagcaccatcaaccaccaggccctggagcagctgcactatgtgactgagctagcagagctaatcagggcaaaatcctgccccagacctgatgaagctgaggactccagcgagtttgcgagtttctttccagactttatttggactgttcgggattttaccctggagctaaagttagatggaaaccccatcacagaagatgagtacctggagaatgccttgaagctgattccaggcaagaatcccaaaattcaaaattcaaacatgcctagagagtgtatcaggcatttcttccgaaaacggaagtgctttgtctttgaccggcctacaaatgacaagcaatatttaaatcatatggacgaagtgccagaagaaaatctggaaaggcatttccttatgcaatcagacaacttctgttcttatatcttcacccatgcaaagaccaagaccctgagagagggaatcattgtcactggaaagcggctggggactctggtggtgacttatgtagatgccatcaacagtggagcagtaccttgtctggagaatgcagtgacagcactggcccagcttgagaacccagcggctgtgcagagggcagccgaccactatagccagcagatggcccagcaactgaggctccccacagacacgctccaggagctgctggacgtgcatgcagcctgtgagagggaagccattgcagtcttcatggagcactccttcaaggatgaaaaccatgaattccagaagaagcttgtggacaccatagagaaaaagaagggagactttgtgctgcagaatgaagaggcatctgccaaatattgccaggctgagcttaagcggctttcagagcacctgacagaaagcattttgagaggaattttctctgttcctggaggacacaatctctacttagaagaaaagaaacaggttgagtgggactataagctagtgcccagaaaaggagttaaggcaaacgaggtcctccagaacttcctgcagtcacaggtggttgtagaggaatccatcctgcagtcagacaaagccctcactgctggagagaaggccatagcagcggagcgggccatgaaggaagcagctgagaaggaacaggagctgctaagagaaaaacagaaggagcagcagcaaatgatggaggctcaagagagaagcttccaggaaaacatagctcaactcaagaagaagatggagagggaaagggaaaaccttctcagagagcatgaaaggctgctaaaacacaagctgaaggtacaagaagaaatgcttaaggaagaatttcaaaagaaatctgagcagttaaataaagagattaatcaactgaaagaaaaaattgaaagcactaaaaatgaacagttaaggctcttaaagatccttgacatggctagcaacataatgattgtcactctacctggggcttccaagctacttggagtagggacaaaatatcttggctcacgtatttaagagcctgaatattccagggtctcactttgacacccaggctggagtgcagtagcacaaacatgggtcattgtagcctcaacctcccagctacacgggaggctgaggcaggagaatggcgtgaacccaggaggcggagcttgcagtgagtcgagatcgcgccactgcactccagcctgggcgacagagcgaaactccgtctcaaaaaaaaaaaaa

SEQ ID NO: 23388 - DNA, 1846 bp, Homo sapiens
acctctgctcggtacccaggaaagatgtcccagacctgatgaagctgaggactccagcgagtttgcgagtttctttccagactttatttggactgttcgggattttaccctggagctaaagttagatggaaaccccatcacagaagatgagtacctggagaatgccttgaagctgattccaggcaagaatcccaaaattcaaaattcaaacatgcctagagagtgtatcaggcatttcttccgaaaacggaagtgctttgtctttgaccggcctacaaatgacaagcaatatttaaatcatatggacgaagtgccagaagaaaatctggaaaggcatttccttatgcaatcagacaacttctgttcttatatcttcacccatgcaaagaccaagaccctgagagagggaatcattgtcactggaaagcggctggggactctggtggtgacttatgtagatgccatcaacagtggagcagtaccttgtctggagaatgcagtgacagcactggcccagcttgagaacccagcggctgtgcagagggcagccgaccactatagccagcagatggcccagcaactgaggctccccacagacacgctccaggagctgctggacgtgcatgcagcctgtgagagggaagccattgcagtcttcatggagcactccttcaaggatgaaaaccatgaattccagaagaagcttgtggacaccatagagaaaaagaagggagactttgtgctgcagaatgaagaggcatctgccaaatattgccaggctgagcttaagcggctttcagagcacctgacagaaagcattttgagaggaattttctctgttcctggaggacacaatctctacttagaagaaaagaaacaggttgagtgggactataagctagtgcccagaaaaggagttaaggcaaacgaggtcctccagaacttcctgcagtcacaggtggttgtagaggaatccatcctgcagtcagacaaagccctcactgctggagagaaggccatagcagcggagcgggccatgaaggaagcagctgagaaggaacaggagctgctaagagaaaaacagaaggagcagcagcaaatgatggaggctcaagagagaagcttccaggaaaacatagctcaactcaagaagaagatggagagggaaagggaaaaccttctcagagagcatgaaaggctgctaaaacacaagctgaaggtacaagaagaaatgcttaaggaagaatttcaaaagaaatctgagcagttaaataaagagattaatcaactgaaagaaaaaattgaaagcactaaaaatgaacagttaaggctcttaaagatccttgacatggctagcaacataatgattgtcactctacctggggcttccaagctacttggagtagggacaaaatatcttggctcacgtatttaagagcctgaatattccaggtaagaaaatataaaatgaggtttattttattttaataacataacactgttgctcattttgtaagtataagtgttatagcagtttcattcaagaaaagtttaaaattaaaaagtgattatcaaagaatatcagggcctgacatccacaaaaaacaaacttaattttgattgaactaataatttataaacatgggaaacaagtcagaagtagtgacattattcctagaaaagatttaaggaaagcaaaaagacaactggtaagattaagaagccattaaccatttgcaatttatattatagtcacagaaataatttcagttatgactagctcttgccgattaatgagaagagagcagctccacaatttttaatttttttaacttttattttagat

SEQ ID NO: 23389 - DNA, 387 bp, Homo sapiens
aggagtctggtgtggaggaaccagcactttcaagctcctttagtttcctgtcttgataaacaggaaaatccccaacagtcaactccccacaaagtgcatgtcctttcaatttcggttctcacagactcttacttggatgtctgtaaatccggctggactttcagcttctaagaacagtccgtttctcgaggatccaggcgcaggaggacagagcaatgggtgagagaactcttcacgctgcagtgcccacaccaggtaagtttgctcttaagctttacctttcaagtatatttgggttataacaaacaacaacaaattcccaagcgcagactgcacacggggagggttggagacttcacactggcgggtgacaaaggcagtggagga

SEQ ID NO: 23390 - DNA, 475 bp, Homo sapiens
atattccttgtcccaacctgaagcttgacaaccaatgttttatacagggtcagcagtcccccgttatttgctagatgagcatggccttgctacaccagtggaaattagaattaattagaattaaacctgcattccctctcgaagggcattctttgtgctggaacaaaatttctttctacctccagtgagatgttgcttagggaatgtcacaaaaggtaaaccatgtatactcccatgattcaggtccaatcatctggaaatgttacacaaattcatcaaagcgttttctaagataatagagaaatagacacatatgcttaaacgttgaattagttaaatacaaaactctgactcctgaagaaaattggagattttcaaaagtggactatttcccttttataggtacaagaagaaatgcttaaggaagaatttcaaaagaaatctgagcagttaaataaagagattaatcaactga

SEQ ID NO: 23391 - DNA, 260 bp, Homo sapiens
agatttgtgactttattgaacaataatttcgccatcataagatgagacctttgctgcctgacaggtctttgctctttcttggttcctcaggcaaacgaggtcctccagaacttcctgcagtcacaggtggttgtagaggaatccatcctgcagtcagacaaagccctcactgctggagagaaggccatagcaggtacaggggcagggctcagctatcagagggattgggagtttcctgcaatgccttcttgctgatcaca

SEQ ID NO: 23392 - DNA, 2103 bp, Homo sapiens
tgtcctttcaatttcggttctcacagactcttacttggatgtctgtaaatccggctggactttcagcttctaagaacagtccgtttctcgaggatccaggcgcaggaggacagagcaatgggtgagagaactcttcacgctgcagtgcccacaccaggttatccagaatctgaatccatcatgatggcccccatttgtctagtggaaaaccaggaagagcagctgacagtgaattcaaaggcattagagattcttgacaagatttctcagcccgtggtggtggtggccattgtagggctataccgcacaggaaaatcctatctcatgaatcgtcttgcaggaaagcgcaatggcttccctctgggctccacggtgcagtctgaaactaagggcatctggatgtggtgtgtgccccacctctctaagccaaaccacaccctggtccttctggacaccgagggcctgggcgatgtagaaaagagtaaccctaagaatgactcgtggatctttgccctggctgtgcttctaagcagcagctttgtctataacagcgtgagcaccatcaaccaccaggccctggagcagctgcactatgtgactgagctagcagagctaatcagggcaaaatcctgccccagacctgatgaagctgaggactccagcgagtttgcgagtttctttccagactttatttggactgttcgggattttaccctggagctaaagttagatggaaaccccatcacagaagatgagtacctggagaatgccttgaagctgattccaggcaagaatcccaaaattcaaaattcaaacatgcctagagagtgtatcaggcatttcttccgaaaacggaagtgctttgtctttgaccggcctacaaatgacaagcaatatttaaatcatatggacgaagtgccagaagaaaatctggaaaggcatttccttatgcaatcagacaacttctgttcttatatcttcacccatgcaaagaccaagaccctgagagagggaatcattgtcactggaaagcggctggggactctggtggtgacttatgtagatgccatcaacagtggagcagtaccttgtctggagaatgcagtgacagcactggcccagcttgagaacccagcggctgtgcagagggcagccgaccactatagccagcagatggcccagcaactgaggctccccacagacacgctccaggagctgctggacgtgcatgcagcctgtgagagggaagccattgcagtcttcatggagcactccttcaaggatgaaaaccatgaattccagaagaagcttgtggacaccatagagaaaaagaagggagactttgtgctgcagaatgaagaggcatctgccaaatattgccaggctgagcttaagcggctttcagagcacctgacagaaagcattttgagaggaattttctctgttcctggaggacacaatctctacttagaagaaaagaaacaggttgagtgggactataagctagtgcccagaaaaggagttaaggcaaacgaggtcctccagaacttcctgcagtcacaggtggttgtagaggaatccatcctgcagtcagacaaagccctcactgctggagagaaggccatagcagcggagcgggccatgaaggaagcagctgagaaggaacaggagctgctaagagaaaaacagaaggagcagcagcaaatgatggaggctcaagagagaagcttccaggaaaacatagctcaactcaagaagaagatggagagggaaagggaaaaccttctcagagagcatgaaaggctgctaaaacacaagctgaaggtacaagaagaaatgcttaaggaagaatttcaaaagaaatctgagcagttaaataaagagattaatcaactgaaagaaaaaattgaaagcactaaaaatgaacagttaaggctcttaaagatccttgacatggctagcaacataatgattgtcactctacctggggcttccaagctacttggagtagggacaaaatatcttggctcacgtatttaagagcctgaatattccagtccagcctgggcgacagagcgaaactccgtctcaaaaaaaaaaaaa

SEQ ID NO: 23393 - DNA, 1649 bp, Homo sapiens
tgtcctttcaatttcggttctcacagactcttacttggatgtctgtaaatccggctggactttcagcttctaagaacagtccgtttctcgaggatccaggcgcaggaggacagagcaatgggtgagagaactcttcacgctgcagtgcccacaccaggttatccagaatctgaatccatcatgatggcccccatttgtctagtggaaaaccaggaagagcagctgacagtgaattcaaaggcattagagattcttgacaagatttctcagcccgtggtggtggtggccattgtagggctataccgcacaggaaaatcctatctcatgaatcgtcttgcaggaaagcgcaatggcttccctctgggctccacggtgcagtctgaaactaagggcatctggatgtggtgtgtgccccacctctctaagccaaaccacaccctggtccttctggacaccgagggcctgggcgatgtagaaaagagtaaccctaagaatgactcgtggatctttgccctggctgtgcttctaagcagcagctttgtctataacagcgtgagcaccatcaaccaccaggccctggagcagctgcactatgtgactgagctagcagagctaatcagggcaaaatcctgccccagacctgatgaagctgaggactccagcgagtttgcgagtttctttccagactttatttggactgttcgggattttaccctggagctaaagttagatggaaaccccatcacagaagatgagtacctggagaatgccttgaagctgattccaggcaagaatcccaaaattcaaaattcaaacatgcctagagagtgtatcaggcatttcttccgaaaacggaagtgctttgtctttgaccggcctacaaatgacaagcaatatttaaatcatatggacgaagtgccagaagaaaatctggaaaggcatttccttatgcaatcagacaacttctgttcttatatcttcacccatgcaaagaccaagaccctgagagagggaatcattgtcactggaaagcggctggggactctggtggtgacttatgtagatgccatcaacagtggagcagtaccttgtctggagaatgcagtgacagcactggcccagcttgagaacccagcggctgtgcagagggcagccgaccactatagccagcagatggcccagcaactgaggctccccacagacacgctccaggagctgctggacgtgcatgcagcctgtgagagggaagccattgcagtcttcatggagcactccttcaaggatgaaaaccatgaattccagaagaagcttgtggacaccatagagaaaaagaagggagactttgtgctgcagaatgaagaggcatctgccaaatattgccaggctgagcttaagcggctttcagagcacctgacagaaagcattttgagaggaattttctctgttcctggaggacacaatctctacttagaagaaaagaaacaggttgagtgggactataagctagtgcccagaaaaggagttaaggcaaacgaggtcctccagaacttcctgcagtcacaggtggttgtagaggaatccatcctgcagtcagacaaagccctcactgctggagagaaggccatagcaggtacaggggcagggctcag

SEQ ID NO: 23394 - DNA, 476 bp, Homo sapiens
cttctgatggaggtgatctgagatgagcagcctctaaaagcagcctctgcgagcctctaagagcagccgggacctgctggagaacagaacatggcctaggagcgcaacagccaagtgttcagcaccacggacagcttcgctggcctattgctggggaggccagaggtggggaggctggttgtccagcaagacagagtgccatgggagagagaaaaaaacatgggaaagatctcagagaccatctagtccagcctcctcgatttggatgggaggagacccaggacaagagagaagtgacttgtccaaggtcacacaacaagtcagtagagagccagagatgggagctgacagcctacttcctcacacctcttcaaggccctcagatacctggtgtccatgacttattagtggcacagccagaccttgattaagggctccaaaattaaaattacctgtccttggaaatgacaagaaaa

SEQ ID NO: 23395 - DNA, 233 bp, Homo sapiens
gttgaggctgcagtgggccatgatcacactactgcacttccgcctggacaacagagcgagactcgtctctttaaaaaagcaaaagaaaggcctggcgcggtggctcacgcctgtaatcccagcactttgggaggccgagacagggtttcaccatgttagccaggatggtctcaatctcctgacctcatgatccgcccgcctcggtcgacgcggccgcgaatttagtagtagta

SEQ ID NO: 23396 - DNA, 946 bp, Homo sapiens
ttagactcttgcgagagcctgcaccccatatcaggtggggtcaatagataaatacccctgcctccttgccccttagttctggtgtggtgggcaagtcagaggaactgttcttctcacactttcacgtgctctcggtggagatctggttcaaaggcagaggtctgggctggggtctgtgattgtgcatctccaaccagctcctgggggattggctcttgccgatggtccacgggccacactgaggagcgaggcgtcatagctgcccagaggttcccggtggaactgagccctggttgccggccatagaaaccttctcgctaacctgaaccagctccttctcaagttcccggtctcaacctcccttcctgggactgcattccgaataaaccacttccacttggatcctgtttggggatccaacctcaggtgacgctcccgcactccacctatcagccgatggcctcgagcaagtcacttggcctctctgagcctcagtttccttaaatcttcaaatggagatggtaaccaggatgtgcagaagatggcatgaatgaacacgcgcaaggaaccggaaatgctagcaccagcgccgatgtttgcccagctgtgctgtagaaaagcaaggctgatccgcgttgccacagggttgctgcagtgttgggctctcagtgaaccggacgcttcatcaaaggctggggttgctctgtaggtgggggtgggtgcctctttggagcaaatccagagtgaggatttatgttgaacccaaaacgtcactcccctattcttattttttgtctgttcttctttaagtacgtcctgggggaatggttcctaatgtctgcagtttacttttcatttatttttaatgccaaagccaagcatactgattaaaaccaacaataaaaaagcttcgtgaatggctcccccaaagtgtgtgttgggggaa

SEQ ID NO: 23397 - DNA, 447 bp, Homo sapiens
aaatgtcttctcttaccagacaaggaaacaaaaaccacaggactttgatgcattttacggagctaaaagatgattgtggcatattggatctttacagatcagcttcgagacaccagagagtgacctattcttagagaaggagagatgcataatatatagtgtgaacatttaaaaacaggcttccttctcacttggcctaaagcctgtcacccgcttgggggaaggaatttttttttcttctgtgtgttccatccccacctggatagaacaaaatccagctttagcatattgaacaatcttatatttcagaaattttaagaaagtaaactatttttcgaataccattttttaagattaaggtagtttatataaacgagaatttaagagaatactgataactggaagactcagtcatttaagagagaatcttcaacttctagcatactc

SEQ ID NO: 23398 - DNA, 379 bp, Homo sapiens
gcaaaaaaagacttcgaaaatgtgattaagtgaaatatcttgagataggaagattatcctggattatccaatgggcccattgtggtcacaagggtccctctcttaaggagacaggagaatcaaagaagatgtgaggataaaagcaaaggtcagggagtcagttttgaagatgctactctgccagctttgaagatgaaagaagaggccaccagcctaggaatacaggcagcctctagaatttggaaaaggtaagaacagattctccacttgaatttccagaaggaatcagcctgttgactgacaactttaccttaattcataagactgattttggacttttgacctacagaatgtaagataataaatttatgtcatttta

SEQ ID NO: 23399 - DNA, 693 bp, Homo sapiens
gaagaatttaaagcagggactcagatatttgtacaccagtgttcacagcaacattattcacaatagtaaaagggtgaaaacaacccacatatccaacaatgggtgaatgaataaacagaacatggcatataaaaacaatggaatattattcagcctcaaaaaataaacaagttctgacacatgctacaatgtagatgaaccttgaaaactttatgttaaatgaagtaaattacttacaaattgaacaaatactatatgattccacttatatgaggtacctataacagtcaaattcatagaaaatagaatggtgacagttgccaggagatggggaaagggggagacagaaatcattgtttaatggatgcaaagcttgagttcagaaagatgaaaaagttctggaaatggatggtggtgacggttgcacaacagtagaatgtacttaacaccactgaactatacaccaaaataatagttaaaatgaaaatttcatgttgtatgtatttcaccacaattttaaaaagtattcaaaaacaacaataggctgagcacgggggctcatgcctgtaatcccaacactttaagaagctgaggcaggaggagcacttgagcccaagagctcaaggctggagtgaactattatcactgccactgcactccagccagggcaacaaagcaagaacctgtctcaaa

SEQ ID NO: 23400 - DNA, 884 bp, Homo sapiens
  misc_feature (16)..(16): n is a, c, g, or t
taactacctgagttcnagcctggcatggtgatgccccatatgtagtctcagctgtttgggaggctgaggcaggtggatcaagggctgcagtgagctaggatcaagccactgcattccaacccgggtgacccaggactgaaccttgaagaaagccagcactttaaggatgttttcaaagtataactacctgaggtcagctgggcatggtgatgcccatatgtagtctcagctgtttgggaggctgaggcaggtggatcaagggctgcagtgagctaggatcaagccactgcattccaacctgggtgacacagtactgggcctttaaaaaaaaaagaaggaaagaaaaataaagtataacctgaggactaccagcatgtgaatcctgtggatgagctataaaattcagattcagattcctgagtcccacgaggaccttgatgtattcacatccctctgagagaccatcagtagtgtttttaagaaacatttcgaccaggcatggtggctcacgcttgtaatcccagcactttgggaggccaaggcaggcgatcacctgaggttgggagttcaagaccagcctgaccaacatggagaaaccctgtctctactaaagagagacgggtgtggtggtacatgcctataatcccagatactcgggaggctaaggcgggaaaactgcttgaactcgggaggcggaggttgtggtgagccaagattgcgccattgcactccagtctgggcaacaagagtgaaactctgtctcaaaaaaaaaaaaaaaaaagatttcaggaattttttgcagactacagttggagatataagagatgggtgaaggaagtgagtactacaaaagaagcttcaggagtgaccagagagtgaaatga

SEQ ID NO: 23401 - DNA, 388 bp, Homo sapiens
agataggttgagctttggctatggaagcaagtacaaatgtctactaaatcagttggttttatagatctggagttaagagagatttgggctgtataaaaatttggcatttagcaatatgtagttcataatcggaagctttgtgaatgacaagtcacataggaatgtatagattgaaagactgattggaagatagctgaggacccaggactgaaccttgaagaaagccagcactttaaggatgttttcaaagtataactacctgaggtcagctgggcatggtgatgcccatatgtagtctcagctgtttgggaggctgaggcaggtggatcaagggctgcagtgagctaggatcaagccactgcattccaacctgggtgacacagtactg

SEQ ID NO: 23402 - DNA, 154 bp, Homo sapiens
attctataattagttttccaaatgaggaaactggttcagaaagggaaatgattggccaaaaatatcattgctcaactaatgattgcatgaaattcagagcccaggaaaatttctgtactttttattcagaaaaaaagatgagacaggcctatag

SEQ ID NO: 23403 - DNA, 729 bp, Homo sapiens
tggagaaacggcacaaggagagcccttaaattactcatagcgaaatctataatggcttaggggccagtgaccccaagttccagacccacaacttctactgaaatgaaatagaactttagtcattttattttcttacctctgtcctgagctttccccatttgtaaatgacagccgtaactatatctgccctgcttctcttgcagggagtcattcacggctggtgtgctagcttttcgtctgagcataccctctgcatgtgttagcggagagaccccgggcgggcagtatgtgtgcttgatttctgctccccgtctgctggcctggctgatctaggcagtgactctctggcacattttctctgtctgtccagtggggacagtaatgaacaggattgccgcctgcagcgttcagagctccttgagcatacatcagttatttctgcagatcaggttttaaagcagccagaacctccatgggaaagagcaggacacgcagtacttaacaagagaacttagctaatttgatctgccatttggttgattaaccagcacttgacaccagaagcagcctgttcctgcaacaagtgatggggagcagtctcatcaatattttatgcaaacgctggctcagtggaaagaggagaaaacttttccctccccatctgttttttttttttttaaacagcagaaaagtaatttctggtgaactgatgagaattccctgttgcaa

SEQ ID NO: 23404 - DNA, 437 bp, Homo sapiens
gtcttgcttttggctaaatttgccacctcttatttcttaaaaccacgtctcactcccttggtgtctctctgtaactgaggcttagaagctccttgttcattctttggactctttctcagtccctttgtctacaagggaaacagagccatcagcagaggccagtctgggggttataaggggcgtcgggattcaggccacaggtccccccatgaatggacagaatagaggctgtgactatgcttgatgtgaggggaagaatggccaaatgcctgaggtgatcattgtttcttaatttagaattcgtatatttattttaaaaaggacttgactgggtgtggtggctcccagcactttgagacaccaaggtgggaggatcgcttgaggccgggagttcaagaccagcctgggcaacaaagtgagatgcccatgtctaattt

SEQ ID NO: 23405 - DNA, 254 bp, Homo sapiens
cccccacatttgctcagcatacttcctataatttgaccaatgtgcctgtgaaagattgtaaaaatggccacaatgctcttataccactcttcatatttatgacctgtgcaatgtggctttacagatgtgttcaataagagacagttctgtttccccatcccttggatctgagctgacattgtgattttctttggccagcagagtgtggcagaagtgaaaaaggaaggtgtgtcagttcttttcctttctgagaa

SEQ ID NO: 23406 - DNA, 163 bp, Homo sapiens
acctcggcctcccaaagtgctgggattgtaggcatgagccactgcagctggacccataatatattttaaaaatcaacatatatttaaaaatatatttaggattgagttgcattatatgcatattgaacctatgcaaacatgactctgtgggtttagcaaaaca

SEQ ID NO: 23407 - DNA, 552 bp, Homo sapiens
ctgtaagttagcatgctctgtgtatagcagatatcactagtaatagcatttagtaagtgatgttcacacatgctgctgtcatgaacactatctcatgttgtgtaacactttcatttttccaagaactttataatcagccgacttgaaactcacagtcgtcccctcagaaaggcagggcaaatgttgttatttccaatttgtcagaagctcagaaagcttattctgttgctgacagtccttgcaagggtcagaatcaggaccggagccccagatgcgctggtgtcactgatgtccccgtgccgggcatgagcccttctgtgcaaggagctccaatgtctcccggccagtgatgatgtgaaaacatttagaaccgacctacacaataaggcagattttcattctgtacccaaaacaggaacacagatttaatgcagagcaaaagggctttaatcaacagatatgttcatttttcacgtagacctattttacaagctaacttgtaagccagaaaatgacattcgagattttcaagtgagaacaaatgatttggtc

SEQ ID NO: 23408 - DNA, 361 bp, Homo sapiens
attttttgtgtttttagtagagacggggtttcaccatgttagccaggatggtctcgatctcctgacctcgtgatccgcccgccttggcctgccaaagtgctgggattacaggcgtgagccaccacgcctggcccaatttgggcattttaaaggaaacactgtttctaagagtaaaataaagcaatcaagcccagtggggacctggtgagagcatcgtctgtgtcttcggtgggagggtcttggccagggctgcaggaggccagcctctgctctcaagtgcttgagatcctgagtgagaggcaggtgagcactgggtcctccgtaatgcaggtggcagggagagtgacagggggtgtcagca

SEQ ID NO: 23409 - DNA, 759 bp, Homo sapiens
agtgacagtaaataaattatgcctgtggatgcatgtcacaaatataaagttgagtgaaaagtacaaattgaatttttctcccctgggcacgtctttgctgcgaaggccctggtggccgagaccaaggctggctgtttacgtgaggccagccttgcaggtggggcagagaggaggaaattttgttgtaagaactgggacaaagttggcttctggaactcccaaagaaaatatttttctggcaaggggaatgcaaggcaaggcttctctgatgtgtaactgatagcctcagaaggtgtaaggttaaataatgatctcatcagtataacaggagctggacagtattaatcagtggtccaattcaaaataaagccacactgctataagcaaagtaatgaaggcttattgtgacctggggctccttaatgacacagatttgattcccacttaatgggcaactgaataatgcagctgatagcacagaccagtggggaaggcagaccagaggggtacaggaggctgcctggggtgaggcatctaaaggctgttatcacatgtcacatcatcagaccttgaatttgctattaaacagcaaataagcaaatatgccacttacagaagacctttccaaacttcaaggcatctactaaaattatatttatctctctttgatataccaatcacgcaactctaaactatttatgcagaaactaatctacatattaaattgtgccaataaatgttgtcttctctgtttacata

SEQ ID NO: 23410 - DNA, 408 bp, Homo sapiens
tccatataaaaatgagccatttgtcctagaacctcctaagctagttgaagagaccaagatggaaacaagttaacagggcatgatgatgttacagcagaggcatgtgcaaagcttggtggggccacaaaacagataatgttcctccaggtttgaagaggctagtatgtttttctaatatgtttctactatgtttttctaatagtaaaaacacgttatttgtggtcagagaatgttcttccttaaggccttttaatgctgttaagaaaaattagctcatgtaaccctccaggatctggctctcccacttcaactcccatgctctgcttcctacactctagctatattggtcttcattcagtgcactaataattcactgcttttacactgcatgttgatttacattgcctg

SEQ ID NO: 23411 - DNA, 495 bp, Homo sapiens
acacgtgcaccaagctaactgagccagatagtttatgactcctttagtggaggggttggcaaactatggtctgcgggccaaatttggcccaacacctatttctggaaatgaggctttattggagcatacgcgcacccatttgtttacatattgtctttggctccatatgtgctacagtggctgatctgcataatggccagagaaatcttaaggctgaaaagctggaaatacttactatctgcaaagctgaaaatatttactatctgacctccctgttcctttgttcctttcctttccctttccctttctttttgacagggtctcactctgtcactcaggctgtagtgcagtggtgcaatcatggctcactgcaccctcgaccccctgggctcaagcgatcctcccacctcagcatgttgggaggctgacataggtgggttgcttgagcccaggagttcaagaccagcctgggcgacatgatgaaaccctgtctct

SEQ ID NO: 23412 - DNA, 604 bp, Homo sapiens
gtgtgaagatggctatctgcaaaccagggagtaggtcctcaccaagaacaccaccatgctggcaccttgatcttggacttctagcttccgaactgtgggaaataaatgttgccttaagccacctaatctatatttttgttgtagcagcccaaatggattaagacactttcatcagtagcttattcagagtagcactgattctcaacattgctatcattctgtatcagaaatataaaacatggcccacacctgtaatcccagcactttggtaggccaaggcggattgcttcagcccaggagttcgaaaccagcctaggtaacatagtgagaccacatctctacaaaaaataaaattagctgggcatggtggtgcctgtctgtggtcccagctacatgggaggctgaggtgggaggattgcttgaaccttggaggtcaaggctgcagtgagccatgattgctccactgcactccagcctggacaatagagggagactgtgtcaaaaaaaaaagaaaagaaagaaatataaaacatgaggacaaatagctcccttggccaccaaagtatttctgtaccccgtgaaagttttgatgtagaagtagatg

SEQ ID NO: 23413 - DNA, 458 bp, Homo sapiens
attctccccagccccctcagaacatattgcattctcacgactctttcaggcaaatccaaagggaaactgggactttgggatatcagaggacgagagatgagaaggtgtcatcatttaggaatacttctgacagtccctctgggtcacctattttacagtctcctccacggcttgttaaaaatgaggattactgtacccgtcctcaaatccagaatgagaaatgtacgtggtggaggatggggggagaatggggcctagtttctgcatttttcacaagtccccaggagttctggcacgcattagcatatgagaaacacggagagggtacaggagggagatggatgggggtggacagaatatgttgagtctaagtccacttgagaggtgagtggctcacatcacagaggaatggccagtcaggcagggcactgggctcatgtggcccagtgatgagtacc

SEQ ID NO: 23414 - DNA, 230 bp, Homo sapiens
tctccataccaattaaaaataaaaacatcaaaatacactggaaataaaaaaggaaaaaagctgttgaacccacagtacgtgggaacagcaattaattgtcatgcagggataagctaacattaatattcttcaaagaaagcaacttaaggcagaatcattgaaaagacaaaaggattttcaacccctatttatggttaatacagcgtatttagtggaaaagcatgtaagac

SEQ ID NO: 23415 - DNA, 1752 bp, Homo sapiens
gccaggcccagcctcggtgagcacacacgccctccctgtctctcgccttcgcttccctgcatctgcgctgattgtgctggagaagaaatacatccacccaccctcctttgatgatgtccactgagcaaatgcagccactggaagtctcagaagacagactggacaagctagaccctcgttgcagccacttagatgatctttcagaccagttcattaaggactgtgatctcaaaaagaagcctagaaagggaaaaaatgtacaggccaccctgaatgttgagtcagaccaaaaaaaaccaaggaggaaagatacaccggcgctgcacatcccacctttcataccaggtgtgttttcagaacatttaattaaaagatacgatgttcaagagagacatccaaagggcaaaatgatccctgttcttcataacactgacctggaacagaaaaagccaaggagaaaagacacacctgccctgcacatgtccccctttgcagcaggtgtgacattgctcagggatgagagacccaaagcaatcgtggaagatgacgaaaaggatggtgacaagatagctatttaaagatagtttccctgagaccacttgtaaataggttagattggttccctgtggtgacctagagaaaaaatagacttgtttctgctctcatttttgtcatcgtctgacttgaagattcagacaccttctccccaggagatgtatgccatcaaattgccagtcacctctttgtctctctcttctttctgagtatggtttctattctgtgttttgaatttttattttctaatgcagtggaaaagaaacagatcatcctaaatgaggaggtaacagggaaagcactggggttcggtttctgcatcttctggatcaattcacggaacagagatcgtggattacatgggctccttcttggtttttgctgctgggcaggacttgacttagcattatccaagcaccagtccaagtggggttccctgttgccagttagagaggtgagaatgtttggactctaactcaccgattgctttgcagacaaaggtcttttatttctcctgtcctatcttaagagtccaaatgtctctggtgatgttcctaagacccttgtcccagatactctaaatgtgaatgtatgagctgggggagtcaacccagcccaccatgccttggctgatgataccagaggcagagagtgctggtctgtctgggaagcttagcaatgtatcttcaaatttatttttgtttttaaaaatatttcttaaacatgctgtcccaacatttgtgagttgtgtcacaagtgagtcattatcaatggtagataaaatatcaatgtttgtgatgaatttactgtaaaaaaattaaggtcaatgaaagccattctgttatttttagcattctcacttatttagactctattacactttcttggatgagaggggagagtgtggtgttagctagtgagcagaggtctgtatattgtccttgccccagcctgcaatctgtggatgcccaggggaaggcatacaggcctcatccaccaggcaatagacaggagagaggtgagaactatttttagaaggaggaaaagtagatacgcaaattgtcacaactaagagtgataatttggtagctctgtatgtatgctggttccaactgtttaatcccttctgtctttctgttctcacaaagatggaaaagatgcaagagcttgccggaaataaagctacatctatccaca

SEQ ID NO: 23416 - DNA, 1016 bp, Homo sapiens
agacgctggggagagagcagggatcgcgagcccggcggatgcggcagcggcggaaggcggctggggagacgctactccaactgttgaattgaattttcacctttcctttcatccgctgctttgcttgcggagatggatttatttgctttgaaatccgcatatctttctcagactgtggggtgatcccggcagacaccagactgaaagagaccacccgtgacagaaaaggaggaattaaaaaaaaaaaaaacctccacaacagactgcacaattaactgtacacatcgatgttggactttgtgaatagaaaaaattgagaggaaaatcttgaactatgatgcgaggctaagctgggaacaattactggaaacctgattttgtttttccttttccaagactctgaaaaatttcggggtacctctcgcctaaccaagaggaaaggtttaaaaaaaataaacaaaataaataaaccaatacacctagcaaagcagacgccttgttttccagaacctcggactccggcagaaagaggtagagtaaaagtgctgctagattcagcttcaccttcttccctccatccttttctcttgcattttctttttccccaaaaacatgaatctggtttttctttctatagactgagtcagagaaagcgttaggaagaagccgcaactaatgtctgtgaagggaggaccatgaggcgagagtgaatacgattcgttccgctgcttctgactcatccggcagatcggaacacctgcatttctggatgtgtcattcccgtatgtcgaggcgcctccagaacccgaaataatgtgtagacagacctgtgtctaacatcccctcggagggagctccccggggtaggagcccctggctggaccgccgcggccgcagctctgcaccccctgccctccctgagtcgcccagaaaaactgaaagagagactgcagaatgcatcacgccaaaccttgatgtgttgctttcatccagcccactcctcctactataagaga

SEQ ID NO: 23417 - DNA, 101 bp, Homo sapiens
ccacctctttgtatttgtttcacggttgtatttcctccttagtgaacttcctatacacatgttgtaacagtgggaaaagactcagtaattccataagtgtt

SEQ ID NO: 23418 - DNA, 463 bp, Homo sapiens
taagagacagggtcttcttccatcgcccgggcaggagtgcagtggtgccatcatggcttgtggtagccttgagctcttgggctcaagcagtcctttcacctcagcctcccgagtagctgggactacagacgtgcaccaccatacctggttaactttttaatttaaatttttgtagagatggggtctcgttctgttgtccgggctggtctagaattcctggcctcaagcaatcctcccgccttggcctctcaaagcagtaggaatacaagcatgggccaccgtgctgaatggatttagattcatagaggggcaaaaagatcatgaggaagtttgtttctctgatttgaagttgctgtacattgcaggctttctagtttagaggggatgctcctgtcacttgtgaggaagaggtgatgcctggaaacaggtggagggacccaatgtgttggcgcagggactggcc

SEQ ID NO: 23419 - DNA, 259 bp, Homo sapiens
tgagtggaagtgctttaatgatgtgataccagagggtggtgattaatgaggaagctagggaagcgctcctgtggctgatgataggcattagtgaaagaaactgaagtaaacacgacaatgcctctaatattatccttccttctgacacattgtttaaaaataggaagggtggaaacattagttaagagggaatcgcgaccctgtacggagaaaaggtagtaagagagaatccagttactttgaaagtttaagcctttag

SEQ ID NO: 23420 - DNA, 300 bp, Homo sapiens
aaagtcacaatgtgtctggttcctgatctcctgccatgttctcaagaaagtgtgtgtgtgtgtgtgtgtgtgagagagagagagacagagagaaggagagagggaggaaatggggaggagagaagaggagacaggcagggtaaagaggagaatagaaggagagagaaaagaaagacagacatggaaatgaaatagagcaggagagagaagtggtaagagaagggagaagaaaaaagtgaagaatgagaacagacagacaggagacaaggaacaaaaaattagcaaaatggccagagaaaa

SEQ ID NO: 23421 - DNA, 356 bp, Homo sapiens
tgagacagcgtctcactctattgcccaggctggagtgcagtagtgcgatctcagctcactgcaacctctgcctcccaggttcaagcgattctcctgcctcagccactttgagtagcagggattacagggacatgccaccatgccccgctaatttttgtatttttactagagacagggttttaccatgtttgccaaactggtctcgaactcctgattctctcgcctcagcctcccaaagtactgggatgcaggcgtgagccacagcacttgaccaacaagtggtaatttcttaaaggttagttgtactgtataatctgaaaacactgatgaacttctcatactggtacattaaaaac

SEQ ID NO: 23422 - DNA, 496 bp, Homo sapiens
acaaaactgaattgtaagaaatgaaaacacagtaattgaacaatttaaaacttagtaagtcacatgtagcacagaaatacaatgacaggaaataagttagacaggtgaagaaatgtggaggatagtgtgtgaagttttagttgtgtatatgtaactggagttccaggagaagaggaaggatagaacagaggaaatatttgaagagttactagctgaaaattttccagaactgatgaaaaactaattcatagattcatgaattctgacatatccaaagtagagtaaattttaaaagaggacacatcctagtgaaactgccaaaaaaaaaaagaaaaggacttaaaatcagccacaggtaaaagattaccttcaaaagactgacacacacactaacagctagcttctcagcagcaacaagtggaaaacaagacagtggaataacattttcaatgcaataaaagaaaataacttccttgggaggccgaggtgggcagat

SEQ ID NO: 23423 - DNA, 210 bp, Homo sapiens
tataatagccccaaactggaaaagaaaccaaatgtccaaatatagaataaacaaaccgtagtatattcatacaatgaaatactacacaacaatgaaaataaatgaattgcagctacatgcagtaacatggatcaatctaacaatatgctgagtgaagaattacatgcagaattcattcataatgaaaaactattattaaattcactcatg

SEQ ID NO: 23424 - DNA, 452 bp, Homo sapiens
aaaaaattccaggtgcagcggcacatgcctgtagtcatagttactcaggagactgatgtgggaggatcatttgggcccagaaggttgaggctgcaatgagccaagatcgagccactgcactccagcccaggcaatggagagagcctgtctcatggaaaaacaaaaaatcattgcagagttaaatattctgaatgacatagcatataaacacttcctagagactttcaaagaagggggaagtcatttattgacagcaaactgtgtgaaagaggtaaggttgatacagaatctgacaaagagatcatataacagatgatagaaattggtaagaacctgattaaggaagaacaagagatagtaagattatttcgtaattgaggttttgaaattctgttatggatcattgtggaaatatatatgtattaaagagctatattgttgttattaagaaa

SEQ ID NO: 23425 - DNA, 468 bp, Homo sapiens
gtcgaaaagacagtaagcatgccccaaggtaagcagctagcccacctggttcactgctgtaactctgtatgtagatagcgtggggccagacatatagtctgtgccatgtactcaacgttcatgtccctgaaattcacacactgaaatcctcacccgcaaggtgacggtatgaagtggtggggctctgggccaggcacagtggctcatgcctgtaatcccagcactttgagaggccaaggtgggtggatcacttgaggtctagagttcaagaccagcctggcaacatagtgaaaccccatctctactaaaaatataaaaattagccaggtgtggtggcgggcacctgtaaccccagctactcaggaggctgaggcccaagaatcacttgaacccgggaggtggaggttgctgtgagccaagattgtgccactgcactccagcctggacaatggagagagattgtgtctc

SEQ ID NO: 23426 - DNA, 710 bp, Homo sapiens
tccctggttcaaatgattctcctgcctcagcctccggagtagctgggattacaggcacgcatcaccacgcccagctaatttttgtatttttagttgagacagagtttcaccatgttggccaggatggtctcgatctcctgaccttgtgatctgcctgcttcagcctcccaaagtactggaattacaggcgtgagccactgcgccggcctacaaatttttatcttaataaatgttcctgattacaaaatttcaaacaagccaaaaaggtgtatgtgtaaattaaatttatcctttcatctgcctgactctcactccctgacccaaagattttcactgaaaataggtgcatgttctccagatgtgtttatgtacacgtaatttactactgtatagctacatataaagaaaaatatttcacataaaatatacaaaatacacatattcttcaaaactgtagtcataacatattcttctgcaattttcctatttcacttaatatatctctgactttcattgatatttcattagcaatgtttactgacataaatattgctctttcagtgaattttcttttgacatcattgacccactgttggtcagtaagtctgcctaacatatcacaaatataagccccattagtttgcaaatattctctctacttttcacataacttttacctttttttctgcaatacacagtgttttaaattt

SEQ ID NO: 23427 - DNA, 921 bp, Homo sapiens
gagcggaggctgtgagcctagtgcgccccggcccggcccggcccgccgctcgccccctcccctcccttcccctcgccgcgcctcctcccctcgcctcttctcgcctcctctcctctcctccgcccggcgctgctcccgcctgcgcccgggccgccgaacccagcccggccggggcccccggcttcgcgcgctctcggctgggcccggcggggaccgggtccccgcggctgacatcgcccctcctcggggacccggtggattccggacctttcggaacgtgaactgagccgtgggagcggtctcgcccagggccgaccgcggggctgggctgagcagaccctcgcggccgctccggacgccgcgggtgccggggcacggacgttctgggtccgggctgagcgcgtcctgggcgcccggcggtgccagctcactccgggcggggtagggcagggcagaccccagcggagcacggacccggccgatctggactggacagagcgaatcccggacggtgcagagcccggggaatgccgggcgtgggctgaggggatcccggcgccctcccagccctccgactttggctcacgcgctgggacctgcccggcgtctcctcggcctccccgcgccccggtcacctgtggcctcggagccccaaatctgccggaccctcgctcattcccgaccccgagcctggagaggcttgagaaagatttttcctgcccccttccctggagcgcggaggccccgccccctcccaccgcccagatgtctccggtcacggctcggaggacctccctgaggcccggggccgaagggtccagagagagaagcccgccctagggagccttgggggccccccaactccgtcttggggcttggcccccgacgctgcttggagggaaggccggtgcccccaccctc

SEQ ID NO: 23428 - DNA, 1323 bp, Homo sapiens
tcagctctgcacacccacaggcacttcaagacctggaggccactcctgggacccaaggtcttccccctcctctcctgtgtcctcaccttgaccccctctgctagactctgtctccctctgggtgtcccactctccacccagaggcagaggaggctgggtggcagggggcaggggctggttgagggccgcccagggccagggtgggctggggggccgttaaaatgtggagctctgcccagccgaggggggctccgtggaggcagacgcagtgtgtgcccagctggggggagtatgggcaggcctgcgcaacgtggtaaacgatgaacattcggggcgccccggacctcgggcagcccagttgacgaccccagcagtggtggtgagcgggagcggattcgacagcgcatgaagatggtcatcgggcagcttgagggcatccttcgcgagctcaaggaggtggccaaggagctgagggaggtggtgagccagatcgataagctaacctcggacttcgactttgaactggagccggacgactggaccacggccactgtgagcagcacctctagcactgacaaggcgggcatgggtggcccctttgacctgggccacctggacttcatgacagccgatatcctctcagacagctgggagttctgctccttcctggacgtctctaccccctcggactccgtggatggtcccgagtcgactcggccaggggctggccctgactaccgcctcatgaatggtggcacgcccatccccaatgggccacgagtggagaccccagactcctccagtgaggaggcctttggtgctggccccacggtgaagagccagctgccccagcggaccccagggacacgggagagggtgcggttcagtgacaaagtgctctaccatgctctgtgctgtgacgatgaggagggggacggtgagcaggaggtggaggaggaagaagtgggcttgccccctgagcctgcccatacagaggcccatgcaggcccccacaagccctccccagccccctacaagtcacggcgctctccactgaccagccgccactcaggctctaccttggcccctgaacagactcgaagggtcacgaggaacagcagcacccagacagtgtcagacaagagcacgcagacggttctgccctacacagccactagacagaaagccagggggaaaaactaggggccggggagggggccgggggcggtgggcacatagagctataaataaatatatatatatatatatatatatatatatttaaacaaatgaagtcataataaaatttaaaaatgctaagga

SEQ ID NO: 23429 - DNA, 847 bp, Homo sapiens
gagcggaggctgtgagcctagtgcgccccggcccggcccggcccgccgctcgccccctcccctcccttcccctcgccgcgcctcctcccctcgcctcttctcgcctcctctcctctcctccgcccggcgctgctcccgcctgcgcccgggccgccgaacccagcccggccggggcccccggcttcgcgcgctctcggctgggcccggcggggaccgggtccccgcggctgacatcgcccctcctcggggacccggtggattccggacctttcggaacgtgaactgagccgtgggagcggtctcgcccagggccgaccgcggggctgggctgagcagaccctcgcggccgctccggacgccgcgggtgccggggcacggacgttctgggtccgggctgagcgcgtcctgggcgcccggcggtgccagctcactccgggcggggtagggcagggcagaccccagcggagcacggacccggccgatctggactggacagagcgaatcccggacggtgcagagcccggggaatgccgggcgtgggctgaggggatcccggcgccctcccagccctccgactttggctcacgcgctgggacctgcccggcgtctcctcggcctccccgcgccccggtcacctgtggcctcggagccccaaatctgccggaccctcgctcattcccgaccccgagcctggagaggcttgagaaagatttttcctgcccccttccctggagcgcggaggccgggggcggtgggcacatagagctataaataaatatatatatatatatatatatatatatatttaaacaaatgaagtcataataaaatttaaaaatgctaagga

SEQ ID NO: 23430 - DNA, 991 bp, Homo sapiens
tgggtatctagaggatcctccgggagccttacctccgggagccttaaccctccgggagcggattcgacagcgcatgaagatggtcatcgggcagcttgagggcatccttcgcgagctcaaggaggtggccaaggagctgagggaggtggtgagccagatcgataagctaacctcggacttcgactttgaactggagccggacgactggaccacggccactgtgagcagcacctctagcactgacaaggcgggcatgggtggcccctttgacctgggccacctggacttcatgacagccgatatcctctcagacagctgggagttctgctccttcctggacgtctctaccccctcggactccgtggatggtcccgagtcgactcggccaggggctggccctgactaccgcctcatgaatggtggcacgcccatccccaatgggccacgagtggagaccccagactcctccagtgaggaggcctttggtgctggccccacggtgaagagccagctgccccagcggaccccagggacacgggagagggtgcggttcagtgacaaagtgctctaccatgctctgtgctgtgacgatgaggagggggacggtgagcaggaggtggaggaggaagaagtgggcttgccccctgagcctgcccatacagaggcccatgcaggcccccacaagccctccccagccccctacaagtcacggcgctctccactgaccagccgccactcaggctctaccttggcccctgaacagactcgaagggtcacgaggaacagcagcacccagacagtgtcagacaagagcacgcagacggttctgccctacacagccactagacagaaagccagggggaaaaactaggggccggggagggggccgggggcggtgggcacatagagctataaataaatatatatatatatatatatatatatatatttaaacaaatgaagtcataataaaatttaaaaatgctaagga

SEQ ID NO: 23431 - DNA, 2513 bp, Homo sapiens
cgttctgaggtcacaggggcgcgcagtcatcgatataattattccttcaagttttatagaatatcacttgggagattccaaagccatagctattacgcggcaaacctaggataagaaaggtagtatgagtgctggtagaccagctgcaactttcctatacagtgaaaaaggctggtgaaacaagtacagtccagattttttaaaatcatactttctcagggatctccacaaactggtgggtgtcctggctgtctgtgtgatagcctctttctataggtgaggcctcaaatgaattgcagctatcctggtgttcctatgagggcactttgtatgaaaaagggcatgtactccaaaacatttttgtaggttctttggccagttgccaaagagtgtgaaagaatccaatagaggatttttcttactgatagcagtcattcattgcagtaaaataaaatatgatcccattagggaatcttgaattctgacctcccatactccgttttgaaataaccactttatatttcattttttaaaaatctgatgatctctttgaggcaggtttcagatttggcagtacaacatgaaagattaggaaaagcattaataacgtgtgggtggaaagcttgttaaaaatctgagagtgaagtttgagttaaaagttgtttgaacatggcattgactgggaggccaaagatttaaagaagcggaagattcttctcttaagacatgaggagtaagttgtgtgataatggtatgtgttttgtgtgcatgaatggacattgtaaatgttgaattctaggctccgacaatcattgtcaacagaagatcaagctgcaaatatttatgttttaaaacttaaattataaagctagttaagtctttctaatgactagttttaatgttcatgggtacattttacctaagttaccgtttacattgtatagaaaaagatacatcttaagcacagattggttattaggaattagtttggggaagaggtttttttgtggattctttcatactgcaaagaaaaaccatttgccttttggggaattgagctaacttctaatctagtcttaagactagaatgctaaaaacaaaaacatgaaggaaattaaaaccccttattattaaattgatttgtaaaaacattgttactggaaatttattggacttgaggccttcctccagaaaataaggacttgattgtcaggcctatattaggttctgaaccttaatgccatgtatttgtacttactaaaaattgtttcaatgaaaagtacattagcagtatgaacttctggtccagttggaagtttttccatttgaaaaatgtgatgtttgcatggaactgtttgaaacttttttattttctagtccccctcccccacactggatagaatttagcctagaattttccctttggataaaagaacaaaaattgaacatgttatttgtaaattgatgtttagtaattagtgataaacttgaaatactagcatatattataagccttaatcttaggtagtcttatgaaaatgaatctcttaactatcttttgaacctgtattcacattggttttcaagatattttaagttatattttttcctcttttcagagctgcttcttattctggggctacttttttttttagttgtgtaattcacaaagggctgcattttttttttttttaataaggcttataactatggctggatcttttgctctagtcttctaagaagggccattttattttttagagtcacttctaaagtcatgtggtaattaactttggagactgttttgcgtatgagtgctgatacaaattaaaacccaagtagacctcattgcatgtcaccctatgaatgttgacaatggaaggaataccttgcctgtagtatactgtcacttctggattgataagctgaggaagaaagttaagtttcttttttacataagtcagaaaaacttacagctggtgttcctagtttcctggttgacctcagcagatgaagtgaacagatagtgttaattcagattgaagaaattatctgaatcttggtttgtgtagatttacaatctacatgcaatattaactaaatcagatagcttttacagtttcacatgtgtacataggttccctcccggtcccttccatatccattagttattgaactttctaaactggcattgaaacattacaacaatgttttgttgcaccaattttataaacttaagcagtgcaatacgtgttacttttctgaggcaaaccaaaggtaaatttctcaaggttcttgctgccttctttagcagcatttgatggaagatcttttatacatttgtaatagataaaaataaaccagattgcaaatccttttttaaaatcctaaaccatgtaccaagtttttggtccaaattatgtaggataagttaaacttaaattgcattctattaaccaatatgagtgtatttctgtaagcatagttatgttgaaataaagttttaaaaacca

SEQ ID NO: 23432 - DNA, 2755 bp, Homo sapiens
cgttctgaggtcacaggggcgcgcagtcatcgatataattattccttcaagttttatagaatatcacttgggagattccaaagccatagctattacgcggcaaacctaggataagaaaggtagtatgagtgctggtagaccagctgcaactttcctatacagtgaaaaaggctggtgaaacaagtacagtccagattttttaaaatcatactttctcagggatctccacaaactggtgggtgtcctggctgtctgtgtgatagcctctttctataggtgaggcctcaaatgaattgcagctatcctggtgttcctatgagggcactttgtatgaaaaagggcatgtactccaaaacatttttgtaggttctttggccagttgccaaagagtgtgaaagaatccaatagaggatttttcttactgatagcagtcattcattgcagtaaaataaaatatgatcccattagggaatcttgaattctgacctcccatactccgttttgaaataaccactttatatttcattttttaaaaatctgatgatctctttgaggcaggtttcagatttggcagtacaacatgaaagattaggaaaagcattaataacgtgtgggtggaaagcttgttaaaaatctgagagtgaagtttgagttaaaagttgtttgaacatggcattgactgggaggccaaagatttaaagaagcggaagattcttctcttaagacatgaggagtaagttgtgtgataatggtatgtgttttgtgtgcatgaatggacattgtaaatgttgaattctaggctccgacaatcattgtcaacagaagatcaagctgcaaatatttatgttttaaaacttaaattataaagctagttaagtctttctaatgactagttttaatgttcatgggtacattttacctaagttaccgtttacattgtatagaaaaagatacatcttaagcacagattggttattaggaattagtttggggaagaggtttttttgtggattctttcatactgcaaagaaaaaccatttgccttttggggaattgagctaacttctaatctagtcttaagactagaatgctaaaaacaaaaacatgaaggaaattaaaaccccttattattaaattgatttgtaaaaacattgttactggaaatttattggacttgaggccttcctccagaaaataaggacttgattgtcaggcctatattaggttctgaaccttaatgccatgtatttgtacttactaaaaattgtttcaatgaaaagtacattagcagtatgaacttctggtccagttggaagtttttccatttgaaaaatgtgatgtttgcatggaactgtttgaaacttttttattttctagtccccctcccccacactggatagaatttagcctagaattttccctttggataaaagaacaaaaattgaacatgttatttgtaaattgatgtttagtaattagtgataaacttgaaatactagcatatattataagccttaatcttaggtagtcttatgaaaatgaatctcttaactatcttttgaacctgtattcacattggttttcaagatattttaagttatattttttcctcttttcagagctgcttcttattctggggctacttttttttttagttgtgtaattcacaaagggctgcattttttttttttttaataaggcttataactatggctggatcttttgctctagtcttctaagaagggccattttattttttagagtcacttctaaagtcatgtggtaattaactttggagactgttttgcgtatgagtgctgatacaaattaaaacccaagtagacctcattgcatgtcaccctatgaatgttgacaatggaaggaataccttgcctgtagtatactgtcacttctggattgataagctgaggaagaaagttaagtttcttttttacataagtcagaaaaacttacagctggtgttcctagtttcctggttgacctcagcagatgaagtgaacagatagtgttaattcagattgaagaaattatctgaatcttggtttgtgtagatttacaatctacatgcaatattaactaaatcagatagcttttacagtttcacatgtgtacataggttccctcccggtcccttccatatccattagttattgaactttctaaactggcattgaaacattacaacaatgttttgttgcaccaattttataaacttaagcagtgcaatacgtgttacttttctgaggcaaaccaaaggtaaatttctcaaggttcttgctgccttctttagcagcatttgatggaagatcttttatacatttgtaatagataaaaataaaccagattgcaaatccttttttaaaatcctaaaccatgtaccaagtttttggtccaaattatgtaggataagttaaacttaaattgcattctattaaccaatatgagtgtatttctgtaagcatagttatgttgaaataaagttttaaaaaccaaaaaaaaaaatcaaaaaacaaaaaaaaaccatgtcggccgcttgggccaagtcgattttagactcgagcaggctaatgcatgcggccgcatttggagctaatttggccaattcgccttatagggagccgtattacaatttaactgccccgcggtttacaacggcgggactgggaaaacccctgcggtacccaacttaatccctttgagcaaaacccccttttcgccaatgggcgtaaaaaca

SEQ ID NO: 23433 - DNA, 808 bp, Homo sapiens
cgttctgaggtcacaggggcgcgcagtcatcgatataattattccttcaagttttatagaatatcacttgggagattccaaagccatagctattacgcggcaaacctaggataagaaaggtagtatgagtgctggtagaccagctgcaactttcctatacagtgaaaaaggctggtgaaacaagtacagtccagattttttaaaatcatactttctcagggatctccacaaactggtgggtgtcctggctgtctgtgtgatagcctctttctataggtgaggcctcaaatgaattgcagctatcctggtgttcctatgagggcactttgtatgaaaaagggcatgtactccaaaacatttttgtaggttctttggccagttgccaaagagtgtgaaagaatccaatagaggatttttcttactgatagcagtcattcattgcagtaaaataaaatatgatcccattagggaatcttgaattctgacctcccatactccgttttgaaataaccactttatatttcattttttaaaaatctgatgatctctttgaggcaggtttcagatttggcagtacaacatgaaagattaggaaaagcattaataacgtgtgggtggaaagcttgttaaaaatctgagagtgaagtttgagttaaaagttgtttgaacatggcattgactgggaggctgaggcaagagaatcgcttgaacacaggaggtggaggttgcagtgagccgagatcgtgccattgcacttcagcccaggcgagagtgtgagactctgtctttaaaaaaaaaaaaaaaaaaa

SEQ ID NO: 23434 - DNA, 510 bp, Homo sapiens
tggtacagctaattcctaattgtagagtgttaaatgtttgaggagaaccttttctcatagatggttggtgttcatatggctactttacaataaagagaactgtaagtgatatttggaaactacaaacctggaattaggagatataattattccttcaagttttatagaatatcacttgggagattccaaagccatagctattacgcggcaaacctaggataagaaaggtagtatgagtgctggtagaccagctgcaactttcctatacagtgaaaaaggctggtgaaacaagtacagtccagattttttaaaatcatactttctcagggatctccacaaactggtgggtgtcctggctgtctgtgtgatagcctctttctataggtgaggcctcaaatgaattgcagctatcctggtgttcctatgagggcactttgtatgaaaaagggcatgtactccaaaacatttttgtaggttctttggccagttgccaaagagtgtgaaagaatc

SEQ ID NO: 23435 - DNA, 362 bp, Homo sapiens
ctacaaaaattagctgggcatggtgacacgtgcggctgcttggtaggctgaggtgggaggatcgcttgagcccaggaggtgaaggttgcagtgagccctgattgtgccactgcattccagcctgggcgacagagtgagaccatgtctccaaaacatacatatatataaaatatatttaaagacctcttggagttcaggcagaagtgaagatagcactatgaagtagtttccacattaacaatagcaatgacttgaacgatgtgttccccctttcttctgatattaatatctgttcattttgcaaacattgaaagattatgaaagctatgacccagaatcacaattatataatttggatacat

SEQ ID NO: 23436 - DNA, 388 bp, Homo sapiens
tgcagataattataatttattactctcttgaaaagtagctagtattaatactttgtttgcttaaaggtatgcctaatgttaatattgtagagcctaactcaggatttatctatatctcttgatttcacaggagtattgtcatcctgtggatgtggatagaccaaatgttacccaggtttttagagggtaggaggtgattaatatatcatgttttattccatatagattatggttagtaaaatgatttgattattaatatttattttggctagaaataaataataactactttctcaatttgattttagagaatgcttgaagaggtctttaatatttaagagaaataattatttttgaaaatcccaacctctttataattgtttgattt

SEQ ID NO: 23437 - DNA, 572 bp, Homo sapiens
ctgagattgtagaagtagcaagcagtaggtagtatgaaagatacatggattgaagattgtgtgtgaacatgaactggaaggagaaaagagttgacttaaatcaggccatgttccctaagaaagagatcagttgatccagaggatgagaagtgacagattgggccagagttgaatatttatggcaggttggtagctaagtgtgcgagtacatccggggcagtattggatcatgtgaaggtctggctatgatactccacagtctatgtgaagagctgttaagaagactgggactgttggcagggcatggtggctcacacctgtaatcccagcactttgggaggccgaggcaggcagatcacgggaggtcaggagttcgagaccagcctgaccaacatggagaaaccctgtctctactaaaaatacaaaattagctgggcctgttgtggcatatgcctgtaatcccagctacttgggaggcagaggcaggggaatcgcttgaacctgggaggcggaggttgcagtgatcacgccattgaactccagcctgggcaacaagagcaaaactccatttc

SEQ ID NO: 23438 - DNA, 562 bp, Homo sapiens
cctttatttgatcattcatttttagacagtattgattgatacgttgttacttcagaagcataaattagcactaacacctaatcctatcataccttctatgctttttcagttttattacattcttaggtgttgtttgtattaaaacataaataaattaagcaaccacattctgtctgactcagttcagcctgctttgacaaaataccatagactgagtggcttaaatgacacacatttgtttcttacagtaccagaggccaaaaatctgacgtcaggatgtaggcatgtttgagttctcgataaataaccttgttttggtttacagatggttgtcttctcattatatctttaaataccagagaggagagaggcatcgagctagttttcacctgtctcatcttataagggcactaattcaattaaagagggcttcaccctcatcatctaattgacacaggattttctcagccactttgttaaccagggatctccacagccagcagtatgcccctaccacctaggcctcgcttagccctgggtctgccactggagacgccgtacc

SEQ ID NO: 23439 - DNA, 367 bp, Homo sapiens
ctttcagagaattgagtagatactggccaggaggggacatcctaggcacaggggtcttgcctgagggggtctttgggcccagccacccaggactggtcaacattttggttatacgtgcactggcatgtgctgaaatgaggtgtgaccctaatgtgataaggcttttgtttttcatttttcaacaaccataccacaaggaatgaacccaaatatatcttgtccttccaagtgagcaccgtgggtgacagagtaaatgctcaataaatatttgttgaatgaataaacaacaaaatcatccccactccaaatatcttgagaccttccctcagaattgctttcagagtctgagtcaaagcacatgagaaaa

SEQ ID NO: 23440 - DNA, 6574 bp, Homo sapiens
aatctctctgtgcccggttcgacctgtcgcagcttgccaaactgagaagtgtgctcttctacacagcttgtctcgatcccaattttccagccacgctattcaaagacaagatgaaatgcactgtgaataaccagcaatcaaagaaaatcatggtggcagcagatattgtgacgatattcaacctgatccaaatgaatggcggggctgccaaggagaagctgcccacgggccgccagaaggtacgcaagaaggaggcatcctttgaatcatgtaggtcggacacagagatctgcaatgcagctgagtgtgagcccctgaactgtgagctgagtgagaggtctttcagccggggctaccccatcaggcagtcgtccaagtgccggaagatggactgcaaggactgcccacagtttgtccctgcctctgagcctaacttcctgttgggagttagcaaagaggtgaaaaaccgcgccgcttccctggacaggttgcaggccctggctccgtactctgtgaccagccctcagccctgtgagatgcagaggacctacttccccatgaacatcgaaaacgagtccatttcagaccaggactccctgcccatcaatcagagcatcaaggagaccttcatttccaatgaggagccatttgtggtccagtcctgtgtccagaaaaggaatatcttcaaagaggattttcacaatttgatggcagtgtcccccagtttggttggccccatcagcaaagcagagaatgagcacagggaaccccagagtcgaaaggaaccccacaagccacccttcttcaaccacagctttgaaatgccctataacagccagtacctgaatccagtgtattccccggttcctgacaaaaggcgagcaaagcacgaaagcttagatgaccttcaagcctctacatattttgggcccactcccgtgatgggaacccaagaagccaggcgctgtctagggaagcccaacaagcagactccctggccagccaaaagctggagcctaaacacagaggaagttcctgactttgaacggtcctttttcaatagaaatccctccgaggagaagctacactatccaaatgccagtagccagacccccaatttcccagccccagaaaggcgcccaacttaccttgtgccaaaggatcaacagccaattctccccattgcttatgcggcaaaacaaaatgggctcaaatctaaagagatctcatcccctgttgacctggagaagcatgaaccagtcaaaaagtttaaagacaagagcattaactgcaccagtgggcagctcagctcagacaccagtagcgtgggcacccagactgagcacgtgctggagcccaagaaatgcagagacctgtgcacctctggtcagggcaagtacagtgacaggcacaccatgaagcactcagacgatgactcagaaattgtcagcgacgacatcagtgacattttccgatttcttgatgacatgagcatcagtggctccacgggagtgatacagtcgtcctgctacaacagcacaggatccttgtctcagctccataagtcagactgcgacagttcccctgagcacaacttaaccaaaattgccaatggggtccccaacagcaagggagacaagggcaaccggcctgaaaacacccaccactcggaagaagagctgaagaccagtgtgtgcaaactggtgctcaggattggcgaaatcgaacggaagctggaatccctgtcgggtgtccgtgatgaaatctcccaggtcttgggcaaactaaataaattggaccagaaaatgcaacagcctgagaaggtgagtgtgcagatagatctgaactccttgacaagcgagggtccgtctgatgacagtgcctctccccggatgttccacgcacacagtggctcccacggacccaaactagagaacaaccctgactggtgctgctctgatgctagcgggagcaacagtgaaagcctgcgggtcaaggccttaaaaaaaagcctcttcaccaggccatcctctaggtccctaacagaggagaacagtgccacagagtccaaaattgccagcatctccaactcgcccagagactggcgcaccatcacttataccaaccgtgtgggcctcaatgaggaggagataaaagacacaggcccaggagataataaagactggcatcggaaatctaaagaggcagacaggcagtacgacattcccccacagcaccgactgcccaagcagcccaaagatggcttcctggtggagcaggtgttcagccctcacccctaccctgcctccctcaaggcccacatgaagagcaaccccctgtacacagacatgcggctgaccgagttggccgaggtgaagcggggccaaccttcttggaccattgaggagtatgcacggaatgcgggcgacaagggcaagctgacagccctggacctgcagacgcaagaatctttaaacccaaataatttagagtactggatggaagacatttatactccaggatacgattcattactaaaacgtaaagaagccgaattcagacgagccaaggtctgcaagatagctgctctgatcgctgctgcggcatgcaccgtcatcctcgttattgtcgtgcccatctgcacaatgaaatcatgagctaagaatgcaaccttacgtacagcttatgactaccaatgtcgtcgtctgtatcttagaatcttgcagcagtgaggcaacaatttgttgaaatggagatgaaatcatggaggcatttctacaaatgttgaatgaaggtggttttcagaaagtatacattctagtgagaaatctacctacctattagctttgactcaattacactctgacgcatttttagaagtgcaatatcttttcctaccaaaagaacatcatggactatcaataaatacaaattgaatattccaagccaaaaaaggaagattaattgggttctttccattttgatgatgtttcatggtggggaataagttatacagaagatatttaatacacgcctctttagaagaaactaagggaaatagcaacataagaagaaaagaggtggcttctcttttccataatgttcttagaccattgctggtgaagtaacagggtgtgtgtccctaaagggtattacttctctgtcgacttttatcaagggctactgacgtttcattcttgcccttttgtcatcaacacgacagagtgtctgcatcactgcagatcttcatggaaacattctggaccttcttccttgcacttggagtgagaaggagctggactaccaagtcaggcgtggaatgaagtatgctcagactgcatgatgggccaaggtattcaggccaggagacctcgtcctcaatccaaagtgtaggggagctgcctgctaacgatgtaaggtcagtatttgaaaatcatggccactccaaaggatctcctgttcttgctttggtgtgtggctccattccttgattttctatctcctggtggtaccagatgctctgcctctcatacatgagttgaagagtttggaacttgtccttgtgccttgaagagtagagacaatggctaaacgttgacattctatctgtaaaccatggttttcacgcaccactaatatctgccattttcaatggctttaaaaagattttgaaagcttgctcaataatgttcaataatataataataataaaggcactgaggtcttctcagttaccccaacacctactccagagttttgaatacttgtcagcagtgcaaaaaatattatctgtttaaccacttatctatatgtctatctatctatctatatgtctatctatctatctaaatacttgatttttatttattgtcttctctgttaaataacttgagagcaaggtttctttcgtgtaaaagaagctgttgtaatttcatccaaatttgatctgtttccacctgctgaatggtgctctgacaataatggaacagaaagaatccttatcagcatctgattccaatgtcttgttacaggtcaaagaaaaaaggattgacagaaactagctaccttatatatattttttgataataaggtgggatataaatagattttggtagcaagtgtaatcactccgtatgatataataaatttctaaaagatttgagagcatctcaatttttaaagcaataggagtctagcatccattctgaaaaatcgcaaataatgcttagcttgctgtgtctgattctgttgttcaccattaaggggtagacagttaattttattatgttaacaagtgagggatgaatgttttcatctgtggtgaacctttatttttagaagtcttcatgttatctatttgtattatcatgtttatgtatggattttcaatttcagtaaccgaaaacttaagccttagtatgaaaaactgaggatttataattgaaaatgaaaaaaatatgttactctctatcatcagaattatagtctttggtgctctgttttcaatggggcatattacataaggttgtttctttcaccccaaagagactactaggttaccactctgggcattgcctttccacctaacccctcaaccagtaagactctacaccatattgtagccccactattctcctctttatcacagatgaagtgccagagcatcagagataggtagctcccaacctcttgctctggatttgcagaagagggggagatgtacttacccaggataagaaaaatctagtcaaatccaccccaaatcttccatttaacaggtaggaccatcgaggctggaccaaaccactttttccactgcccttggtgaatctattcctagtggaccccatttgggcatgtgcctagctaccttgggaaggcatgactataagtcacacctcaggcttggaaatgaaaggattctatagaatattctatactttccatagctggagaggtagtcagaaattcagtcttgctctgagtccacagtagctttaaaattcaactcaacattgttgtcacgtaacggaaacatctagacctggtaataatccaggaaattgcaaaatggaggccaaaagtaaggtgggtttctctggaaaggggtcatcctcagtctgataataccaagtctgacgctgaggttatgaatcattaccatggcttggagctattggatgcttggggtcttgggatagatagaaggtgaggttcacagttggagcttttcttgccattgaccccaagctcaccccagccttccttccctgaccctgagactcaccctatctatctcccctattccctcagtttgcagaatgagcaagatagagtctggctaggagggaaacatctatccatctctctaatctttgcccatcacctcctgttgcaatgagttcccgcaggtgacatacggactggcctctctactgtactgggtgccatctcccaccatactctggcatttttatgtaaaggataatttcttgtacctgagtctaaaattacaacgttatcaaaattcacttcgtttttcctgcattttaaaagtaataaaatattatttgagattattttgaaattaaatatccttaaccaatgattaaattcataatcatttcatcttctttcataatcatttcatcttctaatctgaatttgttttgaacacagccttgcagaaaagcaaaaaatatttccccgctcaaattttgccgacattttataccagtatccccttcattacagtaaactaaatcataacttacatcatccattactagctgatcataaattgttagtattttaaggtatgcaactatgtgattgacatctgtaaggctagtttaatagacgtgctaaatatcactgttctgaatatctgtgccatagttctgatacccttattggaatcaaggcagtgctgtttctgtttacaagttatcaagataagagcagtggcatcacatttgttgttgttgtttttttttttgaaatagaaaaaaacagaagaagctctgccaacaataaaagattttgttaagtggtataaaaatttgtgaatgttgaaattcaacatgcttcatattataaccaacctgcaagaatattgtggtcaattgtgtgaataccaaatcagtatatactgtatactgtactatgaaaatttgtatttaaaggcaaagatacaagtaattgttggtataattggggaaaagggtattcaatatttattaagtaacaatgagaaatgcaacaaacttccttatttatgccttatgaataaaagagtgtggaatgtaaggtgaaattttatgtgcaagatcctgaaggaatgggtattcttgaaggcagggactgtcttttctatgtttgttctgtacagctctcagcacactcttggtgcttgataaatgttatgttatataataccaataactaagcacatttttagatcttttttcaaatggcttgtgtaaaatttggttaatgtacaatggttggtttgaagctatcatgtaaaattggcctctccaaatataatcagaaataaaccgaaaaaaatata

SEQ ID NO: 23441 - DNA, 355 bp, Homo sapiens
accatatcagacagtgtcatagtttttgcttcaactgccaaactaatttaggaaactcaagagaaggaaaatgttttgtatttatccatatatttagtctttccatgattattttttcctttatgatgttgcaaaattccttctaattatcttttctgtcctgggaacagtttctagttattcttttagaataagtttactggtgagaaatctttttagtttcactttatctgatattgccttcatttccccttcattcttaaatgatatttagctggatatagaattttgtgttgacacttcatttctttcagcacttccacatatagtgtcacttcctctggcctccatagtt

SEQ ID NO: 23442 - DNA, 942 bp, Homo sapiens
ttccctctgtctgtctcgcctctgaatactaatgacgataccctctaaaaacgagagagacgagagaagagtgactaacctctattaggaagctggaaccaagcgttcatggaaggcaactcatcagaaagcaaagttcttttacagttcggtagattatgtacgagatctccatggtagtaaggggggtgagggtcggggagtgaaaaataagattctcttaaaactctttgaaatacaacgacatataagcaaaatatgtaaatgtgtataatgattataaaatgtgatgtaagcaatataaaggaacataaaggagatgactaaagatggcctgctctataagcaagccatgggaatggtgcaaaagtattaaattaagagagcaaacagaaatctaactgtggttctgtcattaattagctatctgaactggaacaagtcactggaacttcctggttctcagattttttcagttctaaagacataaggtagactagtagaaatgtaacatcatttccaggtctgaaattctaagtttacagctcatcaaaagtgtcatcagctggtggtgagtgtcctgtttgtcttacttctgataggacttcaatgacagcctgaaacctggaggtacataatgagtgcaaaaaagcctttttctgcggggtgcggtggctcacgcctgtaatcccagcactttgggaggctgaggtgggcggatcatgaggtcaggagatccagatcatcctggccaacatggtgaaaccctgtctctactaaaaatacaaaaaaattagctgggcatggtggcaggcgcctatagtcccagctactcgggaggctgaggcagaattgcttgaacccaggaggcagaggttgcagtgagccaagattgcgccactgcactccagcctgggtgacagaatgagactccatctcaaa

SEQ ID NO: 23443 - DNA, 446 bp, Homo sapiens
agtagctagctaaagactctgaaaagtaaatcctggttggtagattagggaactcaaaagtgtcatcagctggtggtgagtgtcctgtttgtcttacttctgataggacttcaatgacagcctgaaacctggaggtacataatgagtgcaaaaaagcctttttctgcggggtgcggtggctcacgcctgtaatcccagcactttgggaggctgaggtgggcggatcatgaggtcaggagatccagatcatcctggccaacatggtgaaaccctgtctctactaaaaatacaaaaaaattagctgggcatggtggcaggcgcctatagtcccagctactcgggaggctgaggcagaattgcttgaacccaggaggcagaggttgcagtgagccaagattgcgccactgcactccagcctgggtgacagaatgagactccatctcaaa

SEQ ID NO: 23444 - DNA, 457 bp, Homo sapiens
caggtgccaagatttctgtactgcctctaatttctgctaccacttaaactcaggcaggtggagcctacacactgatatttccttgtggatatcacacttcagaacgtgtccgctagataaagctctcaaacttaccaaggaaagtgatgacagcttgactcggccttacacagaaccctatgtaggtctcacacaatagaacaatgtacaaataagcatttttctttcccaaagaagcatgtaaagatttcccattcctgccactcaacttctctttgttgtgacagggtggaagaattactgtatatagaaaagatgtccgcagcgttcagtaaacacagacactaatgagactcagaggctcatctgtggtcaggtattataacagcttaaaactaaaaaaaaacaaaatattttgctccatggaaaggaagcatagtgaggagccaatggatta

SEQ ID NO: 23445 - DNA, 448 bp, Homo sapiens
ccctgctcaggggagggtggtgctcgtggctgggttttctttttaaccatttttacaaaaaccagcctgtggcccagcttcagcagggtagagtgtgggggggccagctcagcctcttgcgttgccttcgttcctgacgcccaccctggactctagggaacagcactgtgagcaggggctgtccagccccacccctaagccgtctttcccaggaatcctgggtggagtccaacacaatcacacggagaccaccatctgagcctatgtcatttgtcctcattctcattccagcatgagcgtttctgagtctcttcaagacgaatctagttttcaccttcacaggatataaagggatcaacctagaggtgggtgggagggtcctagagggcaggggaacaaccattttccaaccttggctttaataataaaaaccagctgcactgagact

SEQ ID NO: 23446 - DNA, 843 bp, Homo sapiens
caaagctacagtaatcagaacagtgtggtcctggcataagtaatgttggacaagtgagccccaaagtgagacttagcccatgaggttcttggctttgccaggaaagaattcaaggccaagccaatggtagaagaaaacagctttattgaaggggcagtgttatagctccagccctgttacaactctgattactcctgcacagcaggctctggcagagactagcagctcagggcagttttgcagtcatttatatctactttaaacacatgcagattaaggggtgatttgtgcaaaaatttctagggaatgggtaataacttttgggtcatcgagtcaatgccatggaagagaggggggataaccccctggtgttgcgatggcaacggtaaactgacatggcaactgatgagcgtgtcttacggaaagctcattccaccccagccctgtttcagctagtcctcaatttggtccagtgtccgagccctgcctctggagtcaagtcccacctcctacctcataaggagagacataaatcaatggaatagaatcgagagtccagaaataaactcatacctcgatgatcaattgattttcaacaacggtgccaagaccattcagtgggggaaagaatcatattttcaacaaatggtgccagataacgacatccaaaggagtgcaactgggcccctatctcacaccatctacagaaattaagtcaaagtgcctcaaacactaagagctaagactataacattcttagaagaatacagggatacctctttatgatcttgatttggtaattgatttttagataacactaaaagcacaagcaacaataggaaa

SEQ ID NO: 23447 - DNA, 1045 bp, Homo sapiens
atttaggttgatttcatgtctttgctattgtgaatagtgctgcagtgaacatacgcgtgcatgtatctttatgacagaatgatttatattcctttggatctatgggatcgctgggtcaaattcctatacgttttagttcaggtctagaaaagtaaaatcattaattaagggaagttagcagagttattttggccctgagaggctgtgatttaaaatattcagaaaatgtagttgaagtagttgatttggcttcaacttgaattccctatgtaattgcagggaattcaagggactctgaattcaattcagggaattcaaacagacctctttgcctttgagctagttttccccctaggcttttcttagcctgcaaaaatcctggttatctttgaggacccagttgagttggtcttgctcctaaatcattgacaagcccctaccctcaggcagagcagtttgtcctttgtgctccaaatactttttgttgtcactgtagttagggtttgcggtttaatcatctattgctgctgccagaaagcagaatcttggagggtagggagctttatatctttgcgagcctcaaccaacacaaagcttggcgtcagattgaattcaaattcaccttacgttgctagtatgaaaccaattgtgttgttgctttcatacaaatccagcagttttctgctaatgagacctgcaatgtaaaatttaaaaagaaaaaagaaaaaatatccaacaggtttctaccgtccaagtcactgatagaatctacaacagatcgacagagttacagctgtttcctgccccagttttaggcaccataaagattttctagaaggcttgccaatcatcatcatcctgtaagttcttacactgctacgcactaaactaattgcctttccccctcttaaaggtaacaggtttattgaggtataatttacatagggtgaaatttatgacatataatttacataccataaaactcacccacttttgtgtacaatgtaatgatttttagtgcctttacagttatgcaaccatgatc

SEQ ID NO: 23448 - DNA, 280 bp, Homo sapiens
tgtgaaattcaaaacaatttttaaaagaatattataagcttgttagtaaaactcatttgtatatgtgacaattctcttttagccctgaaagactatttgcgcagatgccagttacttaacaaatttgaagtattaggataaggcacattataaatgtagtgtttttccaaattgagttgtgattctaataggcaatgtaatagctcttgaaattcgaattattttataatattaactgtatgcataaattcggattaaatattttgtggtattaactgta

SEQ ID NO: 23449 - DNA, 552 bp, Homo sapiens
attaaacaacacgttctttttttttttcttttgaacagtgtcttgctctgtcacccaggctggagtgcggtagcataaccatagctcactgcaccctgaactcctgggatcaagtgatcctcccacctcagcctcccgagtagctaggaccacaggctcaagccaccacagccagctaactttttatttttattttttggtagaggtgaagttttgctttgttgcctgaaatgatctcaaactcctgacctcaagcaatccccccaccgcagcctcccaaaatgctgggattacactgtaaaccattacaagcatgagccactacacctggataaacaatacgttcctaaaacaatcaatgagtcaaagaactcataaaagaaggtataaaacactttgagatgaataaaaacaaaaccacaacacttcaaaactcatgggacgctgttaaaaatgtgccaagagaaattatagctgtaaacacttactttattaaaagatgtcgacgcggcccgcgatttagtagtagtagtccgacccgggaatccggga

SEQ ID NO: 23450 - DNA, 668 bp, Homo sapiens
attaaacaacacgttctttttttttttcttttgaacagtgtcttgctctgtcacccaggctggagtgcggtagcataaccatagctcactgcaccctgaactcctgggatcaagtgatcctcccacctcagcctcccgagtagctaggaccacaggctcaagccaccacagccagctaactttttatttttattttttggtagaggtgaagttttgctttgttgcctgaaatgatctcaaactcctgacctcaagcaatccccccaccgcagcctcccaaaatgctgggattacactgtaaaccattacaagcatgagccactacacctggataaacaatacgttcctaaaacaatcaatgagtcaaagaactcataaaagaaggtataaaacactttgagatgaataaaaacaaaaccacaacacttcaaaactcatgggacgctgttaaaaatgtgccaagagaaattatagctgtaaacacttactttattaaaagatttccaatctgaccaggtgcagtgactcacgcctgtaatcccagcactttgggaggccaaggcgggcggatccacctgagggcaggagttcgagaccagcctggtcaacatggtaaaaccccatctctactaaaaatacaaaaattagccaggcgtggtggcacatgc

SEQ ID NO: 23451 - DNA, 277 bp, Homo sapiens
atcataaacagacactcggttcacttgttgcctacacattgtagctcttcaatgtgtacaatgtgactgtcatcaccacaatcaactaatgattacatgaagcccttatgtggtaggtcacctgaacatccagtccctgtgcaaaatcataactaaaggaaaaacctgaaccaaagttgtgttctttgatcttgctttatttagctagtgatgggcaaagaggtcaatgacattgatattttctgagcatgcccttgtaccaggtactgtgatatgt

SEQ ID NO: 23452 - DNA, 5358 bp, Homo sapiens
gccagcctggccaagtgaacctacaacttttggaccaacaggtgtccctgctccaattcccgttttgtcagtgacacagactttgaccactggacctgattcagctgtatcccaagctcatttaacaccctctccagttcctgtgtcaatacaggcagttaaccagcccttgatgcctttgcctcagacattgagcctttatcaagacccactctatcctgggtttccttgtaatgaaaagggagatcgagccattgtaccaccttattcactgtgtcagactggggaggacctacctaaagataagaatattcttcgattcttcttcaatcttggtgtgaaggcatacagttgtcctatgtgggccccacattcttacctgtaccctctgcaccaggcctacctggcagcctgcaggatgtacccaaaggtccctgtccctgtttatcctcataatccctggttccaagaggctcctgctgctcagaatgaaagtgattgtacctgtactgatgcccactttcctatgcagactgaggccagtgttaatggtcaaatgccacagccagagattggaccgccgacattttcttcacctctggttatccctccatctcaggtgtctgaaagtcatggacaattgtcttaccaggctgatcttgaatctgagacccctgggcagcttctgcatgctgattatgaagagtcactaagtggcaagaatatgttcccccagccatcttttggacccaatccattcttaggcccagttcctattgcacctcctttctttcctcatgtttggtatgggtacccttttcagggattcatagaaaatccagtaatgaggcagaatattgtcctgccctctgatgaaaaaggagaattggatctgtctctggaaaatctggatctgtctaaagattgtggttcagtttcaacagtagatgagtttccagaagccaggggtgaacatgtacattctctccctgaagcaagtgtgagcagtaagccggacgaaggccggacagagcaatcttcccagacacgaaaggcagatacggcattggcttccatccctcctgtagcagagggaaaggctcatcctcccactcagattctaaacagagagagagaaactgtgcctgttgaacttgaacctaaaaggaccattcaaagcctgaaagaaaaaacagaaaaagtaaaagatcctaagactgctgctgatgtggtcagccctggggccaactctgttgatagcagagtgcaaagaccaaaagaagagagttcagaagatgaaaatgaagtgtctaatattttgagaagtggtagatccaagcagttctataatcaaacttatggaagcaggaagtacaaaagtgattggggctattctggtaggggtggatatcaacatgtgagaagtgaggagtcctggaaaggacagccaagcagaagtcgggatgaaggttatcagtaccatcgaaatgtcagagggcgaccatttaggggagataggaggagatcagggatgggagatggccataggggacagcacacttgatggttgttgccgaagtattttctaacagaaactcttaggtggaatgtttctgaaggctttaaaaaaaatacaataaagtaaaaaccgcagttggaactctttcctctccccagccccccttaccttcactcccatactggacaagacattttggacatgagttcaagggggcaggttaattcctggcattgccagttttcttcattcagaatctgtttgttgatcaagtgactgtccccgtaaaaagtagaagataagtttgttaaagtattttttataaacagcttaatataaaacattatagatttagtgtttggcttttttccttataagtttataagtttgatttcagatgttggaaatgtgtgctttatagtgtttactaaagtgacaagaaaatataccatttgacacactatagattccaaacataacgttgcaccaaatagaaatgtatattttattatgcaatgccttagtcataaactgggctcaaacaattctcagcctaaaacactgttgtcttttaaaatgcttccaacccaaaggcctttcatctcaatatctgtcaaacttgaataatgtcttctctttaatattcacataaggcagcctattaactgtgtcttagcaatgttgtatatagttcttttaatattcataaggtatatttttgaattttggtatttgttgagattgcatagaagaatagtaggaaatccaatgaaatggctgtttccaccaagaattcttagcactggtgtaaatatcatggtgcctactcgaaagaaatgtagatgctatgcattttgaaaataatctgcatcagttagaactgcagaagtttttttaatgccactttaacactaatgcactgacagattctaaatattttgtgagaagaaatgttaaaaatttttagcttgacaggtttctagagttgttttcttcctcccccccccccccccccccccccccccgcaccattggttgtgtatcactttcactttacacttgcatgttctacttgtcagggctggaactattgtatagaagataatatgattgtgacttctagttcttttctagaggatgctgctagaaaatggttttgctttgtattttatagcttgttacccttaggtaggtaacatcttacattctgttttcttccagtctttgcagtattcactagaggttccctttgcatgttgcactctgttctcatttggagattgaactctgaattaacacagtattcattcatctgtgttattttgtaaaaataactgtagcttatattctttatttgtgcataccaatgtgaaaatccactcttttattatgttgagattatcttctgatcaggaagtttgagtgctatgcaaataacatagtagtaatttctctttgcatgccatgtgtaatatacctagccaaaaccagatgcggtgactttctttttttgtaaagcaaattacttaagaaaatacaattcacttgaatttgacaaactgaaacagatgggttttctgggttctctgataacctatgggaatgtttggatgccagttgggctagtgaatcgccactgtactgtaataatggttatttacctctgtgctgttttaattacctaacgtctgtgtaactgctgatttgagtagtgattagcatttagataatgtaacaggattttagagagcactttgaaagataacattttattatgatggtgctaggtaaaaaattgtaaagactgggatggttgtgtggaaaacttttcttgagagaacctattgaaaggaatttgttgtcaccttcttaactagaatagttgttgaaggtaccgcttaagccatttttttcttaacatcggtggctcagttaaggaatgagaagatagagggtcctccactttcagctcatgcttttttatgtaggactagcttacctgattttaatgaaaatcacattttgatacaaacaccagatttgaaagttcaatgtgtttgatctcaggagtccaaaataagttgttgcttctagtgtcctgcattttattgactggggtttgatctcagcttctgaaaatgtttaaaaattggaaggaaatactactcatatcttcattgtcactttgtcttacctcaattgagtaacagaatatagctcctgaaggaaacactgatttgctttctgtttcccatatctcacctctaggatatgatggaagaagtgcttgaaagagaattttagcagatggtacttttcttagtgacctctggaataaaagaactgacttttgatagttttaaaattaatctttgcatgaaggttggtttcgctttttttcctttaagtttgtttttaaatgtattagtccaggggattttgccttatgctgaggtcaaactaaggataagcaagcttttgtccttcattttaactgttatgtcatactgttatgttgacatatttctttataagagaatagaggcaaaagtatagaactgaggatcatttgtatttttgagttggaaattatgaaacttcaccatattatgatcatacatattttgaagaacagactgaccaaagctcacctgttttttgtgttaggtgctttggctgaacttgattccagcccccttttccctttggtgttgtgtatgtctcttcatttcctctcaaatcttcaactcttgccccatgtctccttggcagcaggatgctggcatctgtgtagtcctcatactgtttactgataacccacaaattcattttcatggcagacctaagctcagaccctgccttgtcctggcaagcataggttttcccagaccacaatgctgatatatcttatttaatgcagactgtattcttgcagcgtgttgtttcctttgtgactcaaggttgaattaaaatgcctgtgaactgcaaacttgcttatgattgacttggtgcaataaagttcctttctaaccatttctggtttagaaaacattcagccatcctagaaactagcaatatttatttttgcctctttcgttttaccttcatttttagatgaggtaaatgttttgtcttttacttaagggtactaagcaaggtccactctagtgtagctgaagagaatgcatatttggctacactatttctgtttactgtattttgcttcctactttatgtctaaatgctattgtttgtttaaaatcctaataatgtctcatttccaatatgttattttcagataactaaggttttgctactaatgtcagccatttactctcccactaattgggattattttttaaaagaggtctttctccccgaaatacaagttttagaaaatcttagaagaggggtgggtgcatgtcttaatgctgggaagcggcaactttggggttgaacttacttgaatggattaaaaattgcattgtgttacagagctagaaaattttatgtatgaaaaacgataatagccttacactgagtacaaataatactttaagagcatgtgaagatgtgatcatttgtgatgttacttgtaaaaaaaagtatatatacatatcttttgaagtgttaaaaggaaactagtactttatattctttatcatatcactttttgtaagtgttgaatatattcctgtttatttttctatgttctgttttgtagccttaagaagtgtttcaaacatatctgaatgtataaaataagagtaaatgccctacatggtgtgatgctgcattatatataaaactgtgtgcatatattaaattttgtctcttga

SEQ ID NO: 23453 - DNA, 5272 bp, Homo sapiens
ggatgctttgcctcaaggctggttaactgctgtattgacaacaggaactggagagggtgttaaatgagcttgggatacagcccttgatgcctttgcctcagacattgagcctttatcaagacccactctatcctgggtttccttgtaatgaaaagggagatcgagccattgtaccaccttattcactgtgtcagactggggaggacctacctaaagataagaatattcttcgattcttcttcaatcttggtgtgaaggcatacagttgtcctatgtgggccccacattcttacctgtaccctctgcaccaggcctacctggcagcctgcaggatgtacccaaaggtccctgtccctgtttatcctcataatccctggttccaagaggctcctgctgctcagaatgaaagtgattgtacctgtactgatgcccactttcctatgcagactgaggccagtgttaatggtcaaatgccacagccagagattggaccgccgacattttcttcacctctggttatccctccatctcaggtgtctgaaagtcatggacaattgtcttaccaggctgatcttgaatctgagacccctgggcagcttctgcatgctgattatgaagagtcactaagtggcaagaatatgttcccccagccatcttttggacccaatccattcttaggcccagttcctattgcacctcctttctttcctcatgtttggtatgggtacccttttcagggattcatagaaaatccagtaatgaggcagaatattgtcctgccctctgatgaaaaaggagaattggatctgtctctggaaaatctggatctgtctaaagattgtggttcagtttcaacagtagatgagtttccagaagccaggggtgaacatgtacattctctccctgaagcaagtgtgagcagtaagccggacgaaggccggacagagcaatcttcccagacacgaaaggcagatacggcattggcttccatccctcctgtagcagagggaaaggctcatcctcccactcagattctaaacagagagagagaaactgtgcctgttgaacttgaacctaaaaggaccattcaaagcctgaaagaaaaaacagaaaaagtaaaagatcctaagactgctgctgatgtggtcagccctggggccaactctgttgatagcagagtgcaaagaccaaaagaagagagttcagaagatgaaaatgaagtgtctaatattttgagaagtggtagatccaagcagttctataatcaaacttatggaagcaggaagtacaaaagtgattggggctattctggtaggggtggatatcaacatgtgagaagtgaggagtcctggaaaggacagccaagcagaagtcgggatgaaggttatcagtaccatcgaaatgtcagagggcgaccatttaggggagataggaggagatcagggatgggagatggccataggggacagcacacttgatggttgttgccgaagtattttctaacagaaactcttaggtggaatgtttctgaaggctttaaaaaaaatacaataaagtaaaaaccgcagttggaactctttcctctccccagccccccttaccttcactcccatactggacaagacattttggacatgagttcaagggggcaggttaattcctggcattgccagttttcttcattcagaatctgtttgttgatcaagtgactgtccccgtaaaaagtagaagataagtttgttaaagtattttttataaacagcttaatataaaacattatagatttagtgtttggcttttttccttataagtttataagtttgatttcagatgttggaaatgtgtgctttatagtgtttactaaagtgacaagaaaatataccatttgacacactatagattccaaacataacgttgcaccaaatagaaatgtatattttattatgcaatgccttagtcataaactgggctcaaacaattctcagcctaaaacactgttgtcttttaaaatgcttccaacccaaaggcctttcatctcaatatctgtcaaacttgaataatgtcttctctttaatattcacataaggcagcctattaactgtgtcttagcaatgttgtatatagttcttttaatattcataaggtatatttttgaattttggtatttgttgagattgcatagaagaatagtaggaaatccaatgaaatggctgtttccaccaagaattcttagcactggtgtaaatatcatggtgcctactcgaaagaaatgtagatgctatgcattttgaaaataatctgcatcagttagaactgcagaagtttttttaatgccactttaacactaatgcactgacagattctaaatattttgtgagaagaaatgttaaaaatttttagcttgacaggtttctagagttgttttcttcctcccccccccccccccccccccccccccgcaccattggttgtgtatcactttcactttacacttgcatgttctacttgtcagggctggaactattgtatagaagataatatgattgtgacttctagttcttttctagaggatgctgctagaaaatggttttgctttgtattttatagcttgttacccttaggtaggtaacatcttacattctgttttcttccagtctttgcagtattcactagaggttccctttgcatgttgcactctgttctcatttggagattgaactctgaattaacacagtattcattcatctgtgttattttgtaaaaataactgtagcttatattctttatttgtgcataccaatgtgaaaatccactcttttattatgttgagattatcttctgatcaggaagtttgagtgctatgcaaataacatagtagtaatttctctttgcatgccatgtgtaatatacctagccaaaaccagatgcggtgactttctttttttgtaaagcaaattacttaagaaaatacaattcacttgaatttgacaaactgaaacagatgggttttctgggttctctgataacctatgggaatgtttggatgccagttgggctagtgaatcgccactgtactgtaataatggttatttacctctgtgctgttttaattacctaacgtctgtgtaactgctgatttgagtagtgattagcatttagataatgtaacaggattttagagagcactttgaaagataacattttattatgatggtgctaggtaaaaaattgtaaagactgggatggttgtgtggaaaacttttcttgagagaacctattgaaaggaatttgttgtcaccttcttaactagaatagttgttgaaggtaccgcttaagccatttttttcttaacatcggtggctcagttaaggaatgagaagatagagggtcctccactttcagctcatgcttttttatgtaggactagcttacctgattttaatgaaaatcacattttgatacaaacaccagatttgaaagttcaatgtgtttgatctcaggagtccaaaataagttgttgcttctagtgtcctgcattttattgactggggtttgatctcagcttctgaaaatgtttaaaaattggaaggaaatactactcatatcttcattgtcactttgtcttacctcaattgagtaacagaatatagctcctgaaggaaacactgatttgctttctgtttcccatatctcacctctaggatatgatggaagaagtgcttgaaagagaattttagcagatggtacttttcttagtgacctctggaataaaagaactgacttttgatagttttaaaattaatctttgcatgaaggttggtttcgctttttttcctttaagtttgtttttaaatgtattagtccaggggattttgccttatgctgaggtcaaactaaggataagcaagcttttgtccttcattttaactgttatgtcatactgttatgttgacatatttctttataagagaatagaggcaaaagtatagaactgaggatcatttgtatttttgagttggaaattatgaaacttcaccatattatgatcatacatattttgaagaacagactgaccaaagctcacctgttttttgtgttaggtgctttggctgaacttgattccagcccccttttccctttggtgttgtgtatgtctcttcatttcctctcaaatcttcaactcttgccccatgtctccttggcagcaggatgctggcatctgtgtagtcctcatactgtttactgataacccacaaattcattttcatggcagacctaagctcagaccctgccttgtcctggcaagcataggttttcccagaccacaatgctgatatatcttatttaatgcagactgtattcttgcagcgtgttgtttcctttgtgactcaaggttgaattaaaatgcctgtgaactgcaaacttgcttatgattgacttggtgcaataaagttcctttctaaccatttctggtttagaaaacattcagccatcctagaaactagcaatatttatttttgcctctttcgttttaccttcatttttagatgaggtaaatgttttgtcttttacttaagggtactaagcaaggtccactctagtgtagctgaagagaatgcatatttggctacactatttctgtttactgtattttgcttcctactttatgtctaaatgctattgtttgtttaaaatcctaataatgtctcatttccaatatgttattttcagataactaaggttttgctactaatgtcagccatttactctcccactaattgggattattttttaaaagaggtctttctccccgaaatacaagttttagaaaatcttagaagaggggtgggtgcatgtcttaatgctgggaagcggcaactttggggttgaacttacttgaatggattaaaaattgcattgtgttacagagctagaaaattttatgtatgaaaaacgataatagccttacactgagtacaaataatactttaagagcatgtgaagatgtgatcatttgtgatgttacttgtaaaaaaaagtatatatacatatcttttgaagtgttaaaaggaaactagtactttatattctttatcatatcactttttgtaagtgttgaatatattcctgtttatttttctatgttctgttttgtagccttaagaagtgtttcaaacatatctgaatgtataaaataagagtaaatgccctacatggtgtgatgctgcattatatataaaactgtgtgcatatattaaattttgtctcttga

SEQ ID NO: 23454 - DNA, 5085 bp, Homo sapiens
gccagcctggccaagtgaacctacaacttttggaccaacaggtgtccctgctccaattcccgttttgtcagtgacacagactttgaccactggacctgattcagctgtatcccaagctcatttaacaccctctccagttcctgtgtcaatacaggcagttaaccagcccttgatgcctttgcctcagacattgagcctttatcaagacccactctatcctgggtttccttgtaatgaaaagggagatcgagccattgtaccaccttattcactgtgtcagactggggaggacctacctaaagataagaatattcttcgattcttcttcaatcttggtgtgaaggcatacagttgtcctatgtgggccccacattcttacctgtaccctctgcaccaggcctacctggcagcctgcaggatgtacccaaaggtccctgtccctgtttatcctcataatccctggttccaagaggctcctgctgctcagaatgaaagtgattgtacctgtactgatgcccactttcctatgcagactgaggccagtgttaatggtcaaatgccacagccagagattggaccgccgacattttcttcacctctggttatccctccatctcaggtgtctgaaagtcatggacaattgtctaaagattgtggttcagtttcaacagtagatgagtttccagaagccaggggtgaacatgtacattctctccctgaagcaagtgtgagcagtaagccggacgaaggccggacagagcaatcttcccagacacgaaaggcagatacggcattggcttccatccctcctgtagcagagggaaaggctcatcctcccactcagattctaaacagagagagagaaactgtgcctgttgaacttgaacctaaaaggaccattcaaagcctgaaagaaaaaacagaaaaagtaaaagatcctaagactgctgctgatgtggtcagccctggggccaactctgttgatagcagagtgcaaagaccaaaagaagagagttcagaagatgaaaatgaagtgtctaatattttgagaagtggtagatccaagcagttctataatcaaacttatggaagcaggaagtacaaaagtgattggggctattctggtaggggtggatatcaacatgtgagaagtgaggagtcctggaaaggacagccaagcagaagtcgggatgaaggttatcagtaccatcgaaatgtcagagggcgaccatttaggggagataggaggagatcagggatgggagatggccataggggacagcacacttgatggttgttgccgaagtattttctaacagaaactcttaggtggaatgtttctgaaggctttaaaaaaaatacaataaagtaaaaaccgcagttggaactctttcctctccccagccccccttaccttcactcccatactggacaagacattttggacatgagttcaagggggcaggttaattcctggcattgccagttttcttcattcagaatctgtttgttgatcaagtgactgtccccgtaaaaagtagaagataagtttgttaaagtattttttataaacagcttaatataaaacattatagatttagtgtttggcttttttccttataagtttataagtttgatttcagatgttggaaatgtgtgctttatagtgtttactaaagtgacaagaaaatataccatttgacacactatagattccaaacataacgttgcaccaaatagaaatgtatattttattatgcaatgccttagtcataaactgggctcaaacaattctcagcctaaaacactgttgtcttttaaaatgcttccaacccaaaggcctttcatctcaatatctgtcaaacttgaataatgtcttctctttaatattcacataaggcagcctattaactgtgtcttagcaatgttgtatatagttcttttaatattcataaggtatatttttgaattttggtatttgttgagattgcatagaagaatagtaggaaatccaatgaaatggctgtttccaccaagaattcttagcactggtgtaaatatcatggtgcctactcgaaagaaatgtagatgctatgcattttgaaaataatctgcatcagttagaactgcagaagtttttttaatgccactttaacactaatgcactgacagattctaaatattttgtgagaagaaatgttaaaaatttttagcttgacaggtttctagagttgttttcttcctcccccccccccccccccccccccccccgcaccattggttgtgtatcactttcactttacacttgcatgttctacttgtcagggctggaactattgtatagaagataatatgattgtgacttctagttcttttctagaggatgctgctagaaaatggttttgctttgtattttatagcttgttacccttaggtaggtaacatcttacattctgttttcttccagtctttgcagtattcactagaggttccctttgcatgttgcactctgttctcatttggagattgaactctgaattaacacagtattcattcatctgtgttattttgtaaaaataactgtagcttatattctttatttgtgcataccaatgtgaaaatccactcttttattatgttgagattatcttctgatcaggaagtttgagtgctatgcaaataacatagtagtaatttctctttgcatgccatgtgtaatatacctagccaaaaccagatgcggtgactttctttttttgtaaagcaaattacttaagaaaatacaattcacttgaatttgacaaactgaaacagatgggttttctgggttctctgataacctatgggaatgtttggatgccagttgggctagtgaatcgccactgtactgtaataatggttatttacctctgtgctgttttaattacctaacgtctgtgtaactgctgatttgagtagtgattagcatttagataatgtaacaggattttagagagcactttgaaagataacattttattatgatggtgctaggtaaaaaattgtaaagactgggatggttgtgtggaaaacttttcttgagagaacctattgaaaggaatttgttgtcaccttcttaactagaatagttgttgaaggtaccgcttaagccatttttttcttaacatcggtggctcagttaaggaatgagaagatagagggtcctccactttcagctcatgcttttttatgtaggactagcttacctgattttaatgaaaatcacattttgatacaaacaccagatttgaaagttcaatgtgtttgatctcaggagtccaaaataagttgttgcttctagtgtcctgcattttattgactggggtttgatctcagcttctgaaaatgtttaaaaattggaaggaaatactactcatatcttcattgtcactttgtcttacctcaattgagtaacagaatatagctcctgaaggaaacactgatttgctttctgtttcccatatctcacctctaggatatgatggaagaagtgcttgaaagagaattttagcagatggtacttttcttagtgacctctggaataaaagaactgacttttgatagttttaaaattaatctttgcatgaaggttggtttcgctttttttcctttaagtttgtttttaaatgtattagtccaggggattttgccttatgctgaggtcaaactaaggataagcaagcttttgtccttcattttaactgttatgtcatactgttatgttgacatatttctttataagagaatagaggcaaaagtatagaactgaggatcatttgtatttttgagttggaaattatgaaacttcaccatattatgatcatacatattttgaagaacagactgaccaaagctcacctgttttttgtgttaggtgctttggctgaacttgattccagcccccttttccctttggtgttgtgtatgtctcttcatttcctctcaaatcttcaactcttgccccatgtctccttggcagcaggatgctggcatctgtgtagtcctcatactgtttactgataacccacaaattcattttcatggcagacctaagctcagaccctgccttgtcctggcaagcataggttttcccagaccacaatgctgatatatcttatttaatgcagactgtattcttgcagcgtgttgtttcctttgtgactcaaggttgaattaaaatgcctgtgaactgcaaacttgcttatgattgacttggtgcaataaagttcctttctaaccatttctggtttagaaaacattcagccatcctagaaactagcaatatttatttttgcctctttcgttttaccttcatttttagatgaggtaaatgttttgtcttttacttaagggtactaagcaaggtccactctagtgtagctgaagagaatgcatatttggctacactatttctgtttactgtattttgcttcctactttatgtctaaatgctattgtttgtttaaaatcctaataatgtctcatttccaatatgttattttcagataactaaggttttgctactaatgtcagccatttactctcccactaattgggattattttttaaaagaggtctttctccccgaaatacaagttttagaaaatcttagaagaggggtgggtgcatgtcttaatgctgggaagcggcaactttggggttgaacttacttgaatggattaaaaattgcattgtgttacagagctagaaaattttatgtatgaaaaacgataatagccttacactgagtacaaataatactttaagagcatgtgaagatgtgatcatttgtgatgttacttgtaaaaaaaagtatatatacatatcttttgaagtgttaaaaggaaactagtactttatattctttatcatatcactttttgtaagtgttgaatatattcctgtttatttttctatgttctgttttgtagccttaagaagtgtttcaaacatatctgaatgtataaaataagagtaaatgccctacatggtgtgatgctgcattatatataaaactgtgtgcatatattaaattttgtctcttga

SEQ ID NO: 23455 - DNA, 326 bp, Homo sapiens
gccagcctggccaagtgaacctacaacttttggaccaacaggtgtccctgctccaattcccgttttgtcagtgacacagactttgaccactggacctgattcagctgtatcccaagctcatttaacaccctctccagttcctgtgtcaatacaggcagttaaccagcccttgatgcctttgcctcagacattgagcctttatcaagacccactctatcctgggtttccttgtaatgaaaagggagatcgagccattgtaccaccttattcactgacaacgcctcactgacaacgcctcactgacaacgccctcactgacaacgcct

SEQ ID NO: 23456 - DNA, 5577 bp, Homo sapiens
ccaattagctggttatactttcttcatattttggtttttagctgaactcttgcagaggaaggatttggaatatttcattttcaacattatccctccctgattagaggtctaacttaatccttacattcggagtactcttgggggctcctagaattgcagagtcctgacattggagatcatctactcttatactgacattcccagtaaaacaaattcagatgttaactggcctgcatggggtcacacagtgagttagtggtagagcccgaatgtgaatgcaggtctggctaaacagtcagtgatggagatactatctcctatcaacctatgaggacttcagattggttttaggacaggagcaagcaatggagtcttaaagcagtgaattttgtaattcattttcacgttggttatcacagtgatttagtatttggactatagattatatggtctttgtaggcatgagaaacttattttgaccctagtacttgtagattgatatccacccaaacctctcttttttctcctcttttgtttatttaactgttttttgtctcttcaggcatacagttgtcctatgtgggccccacattcttacctgtaccctctgcaccaggcctacctggcagcctgcaggatgtacccaaaggtccctgtccctgtttatcctcataatccctggttccaagaggctcctgctgctcagaatgaaagtgattgtacctgtactgatgcccactttcctatgcagactgaggccagtgttaatggtcaaatgccacagccagagattggaccgccgacattttcttcacctctggttatccctccatctcaggtgtctgaaagtcatggacaattgtcttaccaggctgatcttgaatctgagacccctgggcagcttctgcatgctgattatgaagagtcactaagtggcaagaatatgttcccccagccatcttttggacccaatccattcttaggcccagttcctattgcacctcctttctttcctcatgtttggtatgggtacccttttcagggattcatagaaaatccagtaatgaggcagaatattgtcctgccctctgatgaaaaaggagaattggatctgtctctggaaaatctggatctgtctaaagattgtggttcagtttcaacagtagatgagtttccagaagccaggggtgaacatgtacattctctccctgaagcaagtgtgagcagtaagccggacgaaggccggacagagcaatcttcccagacacgaaaggcagatacggcattggcttccatccctcctgtagcagagggaaaggctcatcctcccactcagattctaaacagagagagagaaactgtgcctgttgaacttgaacctaaaaggaccattcaaagcctgaaagaaaaaacagaaaaagtaaaagatcctaagactgctgctgatgtggtcagccctggggccaactctgttgatagcagagtgcaaagaccaaaagaagagagttcagaagatgaaaatgaagtgtctaatattttgagaagtggtagatccaagcagttctataatcaaacttatggaagcaggaagtacaaaagtgattggggctattctggtaggggtggatatcaacatgtgagaagtgaggagtcctggaaaggacagccaagcagaagtcgggatgaaggttatcagtaccatcgaaatgtcagagggcgaccatttaggggagataggaggagatcagggatgggagatggccataggggacagcacacttgatggttgttgccgaagtattttctaacagaaactcttaggtggaatgtttctgaaggctttaaaaaaaatacaataaagtaaaaaccgcagttggaactctttcctctccccagccccccttaccttcactcccatactggacaagacattttggacatgagttcaagggggcaggttaattcctggcattgccagttttcttcattcagaatctgtttgttgatcaagtgactgtccccgtaaaaagtagaagataagtttgttaaagtattttttataaacagcttaatataaaacattatagatttagtgtttggcttttttccttataagtttataagtttgatttcagatgttggaaatgtgtgctttatagtgtttactaaagtgacaagaaaatataccatttgacacactatagattccaaacataacgttgcaccaaatagaaatgtatattttattatgcaatgccttagtcataaactgggctcaaacaattctcagcctaaaacactgttgtcttttaaaatgcttccaacccaaaggcctttcatctcaatatctgtcaaacttgaataatgtcttctctttaatattcacataaggcagcctattaactgtgtcttagcaatgttgtatatagttcttttaatattcataaggtatatttttgaattttggtatttgttgagattgcatagaagaatagtaggaaatccaatgaaatggctgtttccaccaagaattcttagcactggtgtaaatatcatggtgcctactcgaaagaaatgtagatgctatgcattttgaaaataatctgcatcagttagaactgcagaagtttttttaatgccactttaacactaatgcactgacagattctaaatattttgtgagaagaaatgttaaaaatttttagcttgacaggtttctagagttgttttcttcctcccccccccccccccccccccccccccgcaccattggttgtgtatcactttcactttacacttgcatgttctacttgtcagggctggaactattgtatagaagataatatgattgtgacttctagttcttttctagaggatgctgctagaaaatggttttgctttgtattttatagcttgttacccttaggtaggtaacatcttacattctgttttcttccagtctttgcagtattcactagaggttccctttgcatgttgcactctgttctcatttggagattgaactctgaattaacacagtattcattcatctgtgttattttgtaaaaataactgtagcttatattctttatttgtgcataccaatgtgaaaatccactcttttattatgttgagattatcttctgatcaggaagtttgagtgctatgcaaataacatagtagtaatttctctttgcatgccatgtgtaatatacctagccaaaaccagatgcggtgactttctttttttgtaaagcaaattacttaagaaaatacaattcacttgaatttgacaaactgaaacagatgggttttctgggttctctgataacctatgggaatgtttggatgccagttgggctagtgaatcgccactgtactgtaataatggttatttacctctgtgctgttttaattacctaacgtctgtgtaactgctgatttgagtagtgattagcatttagataatgtaacaggattttagagagcactttgaaagataacattttattatgatggtgctaggtaaaaaattgtaaagactgggatggttgtgtggaaaacttttcttgagagaacctattgaaaggaatttgttgtcaccttcttaactagaatagttgttgaaggtaccgcttaagccatttttttcttaacatcggtggctcagttaaggaatgagaagatagagggtcctccactttcagctcatgcttttttatgtaggactagcttacctgattttaatgaaaatcacattttgatacaaacaccagatttgaaagttcaatgtgtttgatctcaggagtccaaaataagttgttgcttctagtgtcctgcattttattgactggggtttgatctcagcttctgaaaatgtttaaaaattggaaggaaatactactcatatcttcattgtcactttgtcttacctcaattgagtaacagaatatagctcctgaaggaaacactgatttgctttctgtttcccatatctcacctctaggatatgatggaagaagtgcttgaaagagaattttagcagatggtacttttcttagtgacctctggaataaaagaactgacttttgatagttttaaaattaatctttgcatgaaggttggtttcgctttttttcctttaagtttgtttttaaatgtattagtccaggggattttgccttatgctgaggtcaaactaaggataagcaagcttttgtccttcattttaactgttatgtcatactgttatgttgacatatttctttataagagaatagaggcaaaagtatagaactgaggatcatttgtatttttgagttggaaattatgaaacttcaccatattatgatcatacatattttgaagaacagactgaccaaagctcacctgttttttgtgttaggtgctttggctgaacttgattccagcccccttttccctttggtgttgtgtatgtctcttcatttcctctcaaatcttcaactcttgccccatgtctccttggcagcaggatgctggcatctgtgtagtcctcatactgtttactgataacccacaaattcattttcatggcagacctaagctcagaccctgccttgtcctggcaagcataggttttcccagaccacaatgctgatatatcttatttaatgcagactgtattcttgcagcgtgttgtttcctttgtgactcaaggttgaattaaaatgcctgtgaactgcaaacttgcttatgattgacttggtgcaataaagttcctttctaaccatttctggtttagaaaacattcagccatcctagaaactagcaatatttatttttgcctctttcgttttaccttcatttttagatgaggtaaatgttttgtcttttacttaagggtactaagcaaggtccactctagtgtagctgaagagaatgcatatttggctacactatttctgtttactgtattttgcttcctactttatgtctaaatgctattgtttgtttaaaatcctaataatgtctcatttccaatatgttattttcagataactaaggttttgctactaatgtcagccatttactctcccactaattgggattattttttaaaagaggtctttctccccgaaatacaagttttagaaaatcttagaagaggggtgggtgcatgtcttaatgctgggaagcggcaactttggggttgaacttacttgaatggattaaaaattgcattgtgttacagagctagaaaattttatgtatgaaaaacgataatagccttacactgagtacaaataatactttaagagcatgtgaagatgtgatcatttgtgatgttacttgtaaaaaaaagtatatatacatatcttttgaagtgttaaaaggaaactagtactttatattctttatcatatcactttttgtaagtgttgaatatattcctgtttatttttctatgttctgttttgtagccttaagaagtgtttcaaacatatctgaatgtataaaataagagtaaatgccctacatggtgtgatgctgcattatatataaaactgtgtgcatatattaaattttgtctcttga

SEQ ID NO: 23457 - DNA, 4648 bp, Homo sapiens
gccagcctggccaagtgaacctacaacttttggaccaacaggtgtccctgctccaattcccgttttgtcagtgacacagactttgaccactggacctgattcagctgtatcccaagctcatttaacaccctctccagttcctgtgtcaatacaggcagttaaccagcccttgatgcctttgcctcagacattgagcctttatcaagacccactctatcctgggtttccttgtaatgaaaagggagatcgagccattgtaccaccttattcactgtgtcagactggggaggacctacctaaagataagaatattcttcgattcttcttcaatcttggtgtgaaggcatacagttgtcctatgtgggccccacattcttacctgtaccctctgcaccaggcctacctggcagcctgcaggatgtacccaaaggtccctgtccctgtttatcctcataatccctggttccaagaggctcctgctgctcagaatgaaagtgattgtacctgtactgatgcccactttcctatgcagactgaggccagtgttaatggtcaaatgccacagccagagattggaccgccgacattttcttcacctctggttatccctccatctcaggtgtctgaaagtcatggacaattgtcttaccaggctgatcttgaatctgagacccctgggcagcttctgcatgctgattatgaagagtcactaagtggcaagaatatgttcccgacagccaagcagaagtcgggatgaaggttatcagtaccatcgaaatgtcagagggcgaccatttaggggagataggaggagatcagggatgggagatggccataggggacagcacacttgatggttgttgccgaagtattttctaacagaaactcttaggtggaatgtttctgaaggctttaaaaaaaatacaataaagtaaaaaccgcagttggaactctttcctctccccagccccccttaccttcactcccatactggacaagacattttggacatgagttcaagggggcaggttaattcctggcattgccagttttcttcattcagaatctgtttgttgatcaagtgactgtccccgtaaaaagtagaagataagtttgttaaagtattttttataaacagcttaatataaaacattatagatttagtgtttggcttttttccttataagtttataagtttgatttcagatgttggaaatgtgtgctttatagtgtttactaaagtgacaagaaaatataccatttgacacactatagattccaaacataacgttgcaccaaatagaaatgtatattttattatgcaatgccttagtcataaactgggctcaaacaattctcagcctaaaacactgttgtcttttaaaatgcttccaacccaaaggcctttcatctcaatatctgtcaaacttgaataatgtcttctctttaatattcacataaggcagcctattaactgtgtcttagcaatgttgtatatagttcttttaatattcataaggtatatttttgaattttggtatttgttgagattgcatagaagaatagtaggaaatccaatgaaatggctgtttccaccaagaattcttagcactggtgtaaatatcatggtgcctactcgaaagaaatgtagatgctatgcattttgaaaataatctgcatcagttagaactgcagaagtttttttaatgccactttaacactaatgcactgacagattctaaatattttgtgagaagaaatgttaaaaatttttagcttgacaggtttctagagttgttttcttcctcccccccccccccccccccccccccccgcaccattggttgtgtatcactttcactttacacttgcatgttctacttgtcagggctggaactattgtatagaagataatatgattgtgacttctagttcttttctagaggatgctgctagaaaatggttttgctttgtattttatagcttgttacccttaggtaggtaacatcttacattctgttttcttccagtctttgcagtattcactagaggttccctttgcatgttgcactctgttctcatttggagattgaactctgaattaacacagtattcattcatctgtgttattttgtaaaaataactgtagcttatattctttatttgtgcataccaatgtgaaaatccactcttttattatgttgagattatcttctgatcaggaagtttgagtgctatgcaaataacatagtagtaatttctctttgcatgccatgtgtaatatacctagccaaaaccagatgcggtgactttctttttttgtaaagcaaattacttaagaaaatacaattcacttgaatttgacaaactgaaacagatgggttttctgggttctctgataacctatgggaatgtttggatgccagttgggctagtgaatcgccactgtactgtaataatggttatttacctctgtgctgttttaattacctaacgtctgtgtaactgctgatttgagtagtgattagcatttagataatgtaacaggattttagagagcactttgaaagataacattttattatgatggtgctaggtaaaaaattgtaaagactgggatggttgtgtggaaaacttttcttgagagaacctattgaaaggaatttgttgtcaccttcttaactagaatagttgttgaaggtaccgcttaagccatttttttcttaacatcggtggctcagttaaggaatgagaagatagagggtcctccactttcagctcatgcttttttatgtaggactagcttacctgattttaatgaaaatcacattttgatacaaacaccagatttgaaagttcaatgtgtttgatctcaggagtccaaaataagttgttgcttctagtgtcctgcattttattgactggggtttgatctcagcttctgaaaatgtttaaaaattggaaggaaatactactcatatcttcattgtcactttgtcttacctcaattgagtaacagaatatagctcctgaaggaaacactgatttgctttctgtttcccatatctcacctctaggatatgatggaagaagtgcttgaaagagaattttagcagatggtacttttcttagtgacctctggaataaaagaactgacttttgatagttttaaaattaatctttgcatgaaggttggtttcgctttttttcctttaagtttgtttttaaatgtattagtccaggggattttgccttatgctgaggtcaaactaaggataagcaagcttttgtccttcattttaactgttatgtcatactgttatgttgacatatttctttataagagaatagaggcaaaagtatagaactgaggatcatttgtatttttgagttggaaattatgaaacttcaccatattatgatcatacatattttgaagaacagactgaccaaagctcacctgttttttgtgttaggtgctttggctgaacttgattccagcccccttttccctttggtgttgtgtatgtctcttcatttcctctcaaatcttcaactcttgccccatgtctccttggcagcaggatgctggcatctgtgtagtcctcatactgtttactgataacccacaaattcattttcatggcagacctaagctcagaccctgccttgtcctggcaagcataggttttcccagaccacaatgctgatatatcttatttaatgcagactgtattcttgcagcgtgttgtttcctttgtgactcaaggttgaattaaaatgcctgtgaactgcaaacttgcttatgattgacttggtgcaataaagttcctttctaaccatttctggtttagaaaacattcagccatcctagaaactagcaatatttatttttgcctctttcgttttaccttcatttttagatgaggtaaatgttttgtcttttacttaagggtactaagcaaggtccactctagtgtagctgaagagaatgcatatttggctacactatttctgtttactgtattttgcttcctactttatgtctaaatgctattgtttgtttaaaatcctaataatgtctcatttccaatatgttattttcagataactaaggttttgctactaatgtcagccatttactctcccactaattgggattattttttaaaagaggtctttctccccgaaatacaagttttagaaaatcttagaagaggggtgggtgcatgtcttaatgctgggaagcggcaactttggggttgaacttacttgaatggattaaaaattgcattgtgttacagagctagaaaattttatgtatgaaaaacgataatagccttacactgagtacaaataatactttaagagcatgtgaagatgtgatcatttgtgatgttacttgtaaaaaaaagtatatatacatatcttttgaagtgttaaaaggaaactagtactttatattctttatcatatcactttttgtaagtgttgaatatattcctgtttatttttctatgttctgttttgtagccttaagaagtgtttcaaacatatctgaatgtataaaataagagtaaatgccctacatggtgtgatgctgcattatatataaaactgtgtgcatatattaaattttgtctcttga

SEQ ID NO: 23458 - DNA, 1652 bp, Homo sapiens
gccagcctggccaagtgaacctacaacttttggaccaacaggtgtccctgctccaattcccgttttgtcagtgacacagactttgaccactggacctgattcagctgtatcccaagctcatttaacaccctctccagttcctgtgtcaatacaggcagttaaccagcccttgatgcctttgcctcagacattgagcctttatcaagacccactctatcctgggtttccttgtaatgaaaagggagatcgagccattgtaccaccttattcactgtgtcagactggggaggacctacctaaagataagaatattcttcgattcttcttcaatcttggtgtgaaggcatacagttgtcctatgtgggccccacattcttacctgtaccctctgcaccaggcctacctggcagcctgcaggatgtacccaaaggtccctgtccctgtttatcctcataatccctggttccaagaggctcctgctgctcagaatgaaagtgattgtacctgtactgatgcccactttcctatgcagactgaggccagtgttaatggtcaaatgccacagccagagattggaccgccgacattttcttcacctctggttatccctccatctcaggtgtctgaaagtcatggacaattgtcttaccaggctgatcttgaatctgagacccctgggcagcttctgcatgctgattatgaagagtcactaagtggcaagaatatgttcccccagccatcttttggacccaatccattcttaggcccagttcctattgcacctcctttctttcctcatgtttggtatgggtacccttttcagggattcatagaaaatccagtaatgaggcagaatattgtcctgccctctgatgaaaaaggagaattggatctgtctctggaaaatctggatctgtctaaagattgtggttcagtttcaacagtagatgagtttccagaagccaggggtgaacatgtacattctctccctgaagcaagtgtgagcagtaagccggacgaaggccggacagagcaatcttcccagacacgaaaggcagatacggcattggcttccatccctcctgtagcagagggaaaggctcatcctcccactcagattctaaacagagagagagaaactgtgcctgttgaacttgaacctaaaaggaccattcaaagcctgaaagaaaaaacagaaaaagtaaaagatcctaagactgctgctgatgtggtcagccctggggccaactctgttgatagcagagtgcaaagaccaaaagaagagagttcagaagatgaaaatgaagtgtctaatattttgagaagtggtagatccaagcagttctataatcaaacttatggaagcaggaagtacaaaagtgattggggctattctggtaggggtggatatcaacatgtgagaagtgaggagtcctggaaaggacagccaagcagaagtcgggatgaaggttatcagtaccatcgaaatgtcagagggcgaccatttaggggagataggaggagatcagggatgggagatggccataggggacagcacacttgatggttgttgccgaagtattttctaacagaaactcttaggtggaatgtttctgaaggctttaaaaaaaatacaataaagtaaaaaccgc

SEQ ID NO: 23459 - DNA, 592 bp, Homo sapiens
tttgattccttaccggggaccttttgtgggaggtgctgggagggcaccgggacctcagagtgagcgctgcgtcagggctccctgggctttcaaacctcctcagcttctgggatgggatgtgtgcgtttggcgctgtcctgaagagatgcaaggcccttcctgccagccctcgtgaattgctgggattacaataggtgtgagccactgcgcccggccgacatgattcttaagcacatgaaatgcagggttatctcctttgtcctcactcagccattcattacaggagtcagcaaactgtttccaggggacaggtagcaaactgtttccaggggacaggtagcaaacgtcagcgcctttgtgggccacactgttcctgtcccagctggtcatgctgttgtcacattgaagcagatgcagacagtatgtagacagtgggcatgggtgtgcaccaataaagctttatttataaacaggtgccatgtccgatttatgatattaataaccatgggttactgagatgaaatgaggaaaagaatctagtgagaaagtacatgtagtcacccttgggtatatgcagagattggctccagga

SEQ ID NO: 23460 - DNA, 229 bp, Homo sapiens
agtcgatgagctcggtactttttaactgagcacatggcaaaatcatagactttcgagttgaaatgaaacttagacattctcttagatgactacagcacagacatcccggtgaggaagtataccgcgacgccgctctctaatctcagtgtcctgttccgcatttcccattcccgactgtcttttagggcaaaggacaaataaaatctggttctagagcttcgagcaccta

SEQ ID NO: 23461 - DNA, 965 bp, Homo sapiens
tttgattccttaccggggaccttttgtgggaggtgctgggagggcaccgggacctcagagtgagcgctgcgtcagggctccctgggctttcaaacctcctcagcttctgggatgggatgtgtgcgtttggcgctgtcctgaagagatgcaaggcccttcctgccagccctcgtgaatgctgggaggtcagccggccctcgtgaatgctgctgctgctggcaaggcttcacttggggatgatcacctggccacaggtgtctgtctttttctggactttaaaaatactttttattggccaggcacggtggctcacgcctgtaatcccagcactttgggaggccaaggcgggtggatcacgagatcaggagatcgagaccatcctggctaacacggtgaaaccccgtctatactaaaaataaaaaaattagccgggcatggtggcgggcgcctgtagtcccagcttcttgggaggctgaggcaggagaatggcgtgaacccgggaggcggaggttgctgtgagccaacatcatgccactgcaccccagcctgggcgacagagcaagactccatctcaaaaaaaaaaaaattttttttaatttaagtattttcagacctccagcaaagttgcaaaattctacgaataagtcctgtgtaccctttattcatttcaccacatggcacaatctcgcccccggcccccccatgtattacttttttttctgagacatgaatgtaagttgtaaacattgtgcccttttatccctgaaaactaatgttatttcctaaaattactgtccctcaacataaagacattctcttagatgactacagcacagacatcccggtgaggaagtataccgcgacgccgctctctaatctcagtgtcctgttccgcatttcccattcccgactgtcttttagggcaaaggacaaataaaatctggttctagagcttcgagcaccta

SEQ ID NO: 23462 - DNA, 760 bp, Homo sapiens
tactactactactactaaattcgcggccgcgtcgaccacctggccacaggtgtctgtctttttctggactttaaaaatactttttattggccaggcacggtggctcacgcctgtaatcccagcactttgggaggccaaggcgggtggatcacgagatcaggagatcgagaccatcctggctaacacggtgaaaccccgtctatactaaaaataaaaaaattagccgggcatggtggcgggcgcctgtagtcccagcttcttgggaggctgaggcaggagaatggcgtgaacccgggaggcggaggttgctgtgagccaacatcatgccactgcaccccagcctgggcgacagagcaagactccatctcaaaaaaaaaaaaattttttttaatttaagtattttcagacctccagcaaagttgcaaaattctacgaataagtcctgtgtaccctttattcatttcaccacatggcacaatctcgcccccggcccccccatgtattacttttttttctgagacatgaatgtaagttgtaaacattgtgcccttttatccctgaaaactaatgttatttcctaaaattactgtccctcaacataaagacattctcttagatgactacagcacagacatcccggtgaggaagtataccgcgacgccgctctctaatctcagtgtcctgttccgcatttcccattcccgactgtcttttagggcaaaggacaaataaaatctggttctagagcttcgagcaccta

SEQ ID NO: 23463 - DNA, 2698 bp, Homo sapiens
  misc_feature (2666)..(2666): n is a, c, g, or t
tttattttatgaagtaatgttaattttactaagaataaaacatccaaattttaagtattatgaaatactaaaactacatgttttaaaacagaggtccagtttattctaacatcttgctgacttctgtagaatttctgattgcatgactattatttatcttcttttagtgtagaaaataattttttacaaaaagtcacttttgggctgggcgcagtggctcacgcctgtaatcccagcactttgggaggctgaggcaggtggatcacaatgtcaggagtttgagactagcctggccaatatggtgaaaccctgtctctactaaaaatacaaaaattagccgggtgtggtggtgggcacctgtagtcccagctactcgggaggctgaggcaggagaattgcttgaacctaggaggctgagattgcagtgagccgaaatcacgccactacactccagcctgggcaacagagggagactccatctcaaaaaaaaaaaaagtcacttttggctaatcatgcagtcttctgaaaaggtttaatagagaaatgctgtttaggctgggcttggtggctcacatctgtaataccagcgctttgggaggctgaggcaggaggattgcttgaggccaggagtttaagttacagaactatgatcacactgccgcactgaagcctggatgacagagtgagaccttatctcaaaaaaaaaaaaaaaaagagagagagagagaaaaagaaatgctgtgtttaatcttcttaaaatgtatcttgtcctacatagttctcagaatacatatggggtatagttaggagataacaataacaagacctaaacaaattgcttatgggagatagcactgtaattagagaatttatttcatataaaataataatataaagtttgaactgattagaatgttccttaaatcatggtttcgtttgttgcagctgtcagctaacatttggttgagctcatataatccaaacctaattgtccaactattgtattgccactattgttaatttgttccttccttactttcttattgttggatcttatatgactgtatgactgtagataatagacagctagctaaatgtagagcaccatttttctcaatgagtttgttttcaaaggctttgcactggagaagatatgtgtagaatttttgttttatttttaaaatgtgtaaaacatcttttgttttatatgcttttaagaatgtagattgtaatttaggaaatggcatatattctgcaaagtggtataatgttgtatatatgaaaaacaggtatatttggtttagttctgtgtttcagtgactgataaacaaaaatgaagctaaaatgaatcaacggctcattcatagttactaaagccatgtcatgactgtcattctattatgaagaaaacagttttatttgagtgctttaatataatgcaacatttaagtcatcttaaggtgaaaagttattgaagtgttcttctctcaagttaacaaaattttacaaatgttcctgaagtgtatcgattgagggaattattttattctagcctgtcatgagtctgtctgagcatgatacttaacatgaacttgatgtagtaggtgcacatttgcctaacaggataaattcagtgatagcccaagctggtcaggagagacagaagtgctggctaggaggtctcagcctcgggcactacaatgtttatctttttctttttgaacaatattgtgaaaatgattgcattctcattgagcatgaaagtcaaaactggaattttctaaagctttggagaaaaggagagaattagtagggcaagatcaaagcatacattggaaataaacagtagaaataagcaaacaatataaagagacacgggaaatgcttctcgtgaagggcaaatgtaacaccataacagtagggaataaactgtgtcccacctgtttacttgtgtttatttgttgttatgatgagtatgcacctaccattttcctttattgtgatcactaaaatgaggccaaggtttaggaggtgagaaaaagtatcccttttacggattcagttcctgctaggatgttgtatcagaatcatgtgagaactcaggaagagatagagcagaaataaaaaggaagaaaatgtagattagaaaataagacttctgagaaaaagttcaaggaataaagattgtttgactctggagaggagaaagctgttgagatagtttgctaagtttgctaataaagctttattgagtcttttattgaagggttcaaagtaagaaatactatgccatagtgttctccatctctagtgaagacagaaccagagggaataaggatcttttttttaaagacagcatggaaagtttaagatttaggaacttcttgagaaatcttcataatatcttctattcaaaatcttttttttatttttaagggaataaaaattttaaaaattaagagatatacagatgactttttaagggtccttctttccagcacattattcccggtcgcctaaggctcaggcccaggtcatgggttatccattgaaatagccaacactggtgagaacgagcagcggaatcggcggcataaccgcaacgataacgtctaagatgtctagagcacttgcgcccggaagagatatccttggttatctttccngctgctagagcctatgaccagtacaccacgcc

SEQ ID NO: 23464 - DNA, 316 bp, Homo sapiens
agatagtttgctaagtttgctaataaagctttattgagtcttttattgaagggttcaaagtaagaaatactatgccatagtgttctccatctctagtgaagacagaaccagagggaataaggatcttttttttaaagacagcatggaaagtttaagatttaggaacttcttgagaaatcttcataatatcttctattcaaaatcttttttttatttttaagggaataaaaattttaaaaattaagagatatacagatgactttttaagggtccttctttccagcacattttttttaaaaactcaggttagaacaaa

SEQ ID NO: 23465 - DNA, 874 bp, Homo sapiens
  misc_feature (627)..(627): n is a, c, g, or t
  misc_feature (655)..(655): n is a, c, g, or t
  misc_feature (669)..(669): n is a, c, g, or t
aatcgcgggcctgtctgcaagacttgagttcaggactcccaatccttcgccatccgaacctggagggcatccagtcgacacctacaggggtcggacatgtccaaggctaactgagaggccttccagacgcttcatttttgttgtttgggtttgcggcagggcacaaagaggatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccccccgggggggggggggnaaacccccaaatttttccttgggcaaantttttcccaaaaanttttttcccccccccctttttttctccccaggctgagggggaaaccgggccccccccccaaaacgaggacaggggcaagagggtggttttcctgaagcagctggctagtggcttattacttgtgactggacctctggtcctcaatcgagttcctctacgaagaacacaccagaaatttgtcattgccacttcaaccaaaatcgat

SEQ ID NO: 23466 - DNA, 777 bp, Homo sapiens
aatcgcgggcctgtctgcaagacttgagttcaggactcccaatccttcgccatccgaacctggagggcatccagtcgacacctacaggggtcggacatgtccaaggctaactgagaggccttccagacgcttcatttttgttgtttgggtttgcggcagggcacaaagaggatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgagaaaactgcgagccagcattacccccgggaccattctgatcatcctcactggacgccacaggggcaagagggtggttttcctgaagcagctggctagtggcttattacttgtgactggacctctggtcctcaatcgagttcctctacgaagaacacaccagaaatttgtcattgccacttcaaccaaaatcgat

SEQ ID NO: 23467 - DNA, 720 bp, Homo sapiens
aatcgcgggcctgtctgcaagacttgagttcaggactcccaatccttcgccatccgaacctggagggcatccagtcgacacctacaggggtcggacatgtccaaggctaactgagaggccttccagacgcttcatttttgttgtttgggtttgcggcagggcacaaagaggatggcgggtgaaaaagttgagaagccagatactaaagagaagaaacccgaagccaagaaggttgatgctggtggcaaggtgaaaaagggtaacctcaaagctaaaaagcccaagaaggggaagccccattgcagccgcaaccctgtccttgtcagaggaattggcaggtattcccgatctgccatgtattccagaaaggccatgtacaagaggaagtactcagccgctaaatccaaggttgaaaagaaaaagaaggagaaggttctcgcaactgttacaaaaccagttggtggtgacaagaacggcggtacccgggtggttaaacttcgcaaaatgcctagatattatcctactgaagatgtgcctcgaaagctgttgagccacggcaaaaaacccttcagtcagcacgtgaacaggggcaagagggtggttttcctgaagcagctggctagtggcttattacttgtgactggacctctggtcctcaatcgagttcctctacgaagaacacaccagaaatttgtcattgccacttcaaccaaaatcgat

SEQ ID NO: 23468 - DNA, 371 bp, Homo sapiens
cttttccacggtgggcctcaaagcgctccaaatatacacttcctgattctacaaaaggagtgtttcaaaaccgctcaatcataagataggttcaaccctgtgagatgaatgcacacatcacaaagaagtttctcagtatgtttctgtttagtttttatttgaagatatttctttttccaccaaaggccacaaatggctccaaatatctacttgcagtttctgccaaaagagagattcaaaactgctcaatcaaaagataggttcaactctgggagttgaatgtacacatcccaaagaagtttctcagaatgcttctgtgtagtttttatatgaagatatttgcttttcctcagtaggcctcaaagggcagc

SEQ ID NO: 23469 - DNA, 463 bp, Homo sapiens
aacatttctcgttaaagtataatgttcagcaatggggaccaatctatactcctcatctgtagtctgtcaataaataggttgctccgactttaaattctcagcttgaattgtttcttttttgtgtgtggaatttatgaccctctgtgatgttgaccctacctaaagcaagtagaatagctacaccagcaaaatgaaataccataacaacaacgtatgcttatgtttatatagtgcttactgtgtgcctggcatggcattgaataaatatatatatttaataaatagagttggggtctcgctttgttgcctaccttgtgttgaactcctggcctcaagtgatccttctgcctccgccccgtcaaagtgctaggattacaggcatgagccactgctcccagccagcattgaatatatttttttttttatttcatcctgagaacaaccttatgaggtactttcaggt

SEQ ID NO: 23470 - DNA, 465 bp, Homo sapiens
agggagaaccaggcagttaatgctccagctctgagctggtctgggttcacatcctgacttcccgatcacctagctgtgactcacctgctcgaggcctcagtttcctcatctgtaaaaacagtagaggggattataaaaccaacagactcaagagactgtaatgagggtgacaggaccatgcatggttgggacctcagcacaatctgacaatcccaaggcctaagacctgtgaccttgaaggtggaaacaggaaaaaggagcagctaaacacatggaccctggagggttcacatccagctctgctctgtgtggccttgggcaagttacctaaccttactggcctcagttgctctgtctgtaaagtggggctattaatgacagttctcaccttatcaggttgtgctggggcttaaattagataactcaggttctgtacttagaacagcacctggcaccagtaacact

SEQ ID NO: 23471 - DNA, 400 bp, Homo sapiens
atgttgccccacactattgggaggtgtagatgttgctactgcatctggaaagcattgtgacaaacatgtgaccagagtattaaacaatgttctcacatttattcttgaaattccacacagagaaaggtgtttcggggaagtagaatattagcagagctatttgtaaaaataatgcacaggcatttgctgctgtatcctatgagcgaaaaattgggaagtgtgatatctgtgtctgcctccatactgtacagaaatcactgaatataggccagtgcggtggctcatgcctgtaatcccagcactttgggaggccgaggcaggtggatcacttgaggtcagcagtctagacccacctggccggcatgacgaagccccgtctctactaaaaatacaaaaaaaa

SEQ ID NO: 23472 - DNA, 510 bp, Homo sapiens
tcgtctgcatcaatgctcttgcatcttgagcttttaaaaaattgccattcaaaccagcaatttgctgacaaggttcacgcgctatgaccatgactgcagttgatcctggggagtggcttgcttgtctgcctggggatggcagccgcgtgcgttccctgtgctgtcctgtagggttgtggtggctttctgatattcaggttggtcccttttccttctttttggatgggctttcgaggttgggagaggaagctcagggatggaactgactaaacatatgtgagatgtttccttgtttgctgctcatggaggtttcatttctgaagtcttttcttgggagggaaaaggatgtgtggatatatgaggtgactctagaaccctcattttatggatgaagaaactgtgattcacagagggagagtgatttgtccagtgtcacgtggggagctggccggggagccagacctcctgtaccttttattgcagggtttattttatatatatttgctggca

SEQ ID NO: 23473 - DNA, 409 bp, Homo sapiens
caattcatttattctttttgttacctgtgttttacgtgtcatatccaataaatcactgtcaaatccaatattgtgaagcttttcccctatgttgtcttctaagagttttatatttttgctcttatatttaggtctttgatccattttgaattaatttttgtgtataatgtaaagacccagtttgattattttgccaacactattgttgaaaaaactgttctttctccattgaatggtcttaagcatcttgttgtaaatcatttgaccatatatgttgactttggttttatagtaataccattgttacaatatggtttgatacatgtaatttttatttgatgtttctgaactttgtttaaaatattggacttgttccatggctgaatgattgataataaaataataaata

SEQ ID NO: 23474 - DNA, 959 bp, Homo sapiens
gattttttacatttttttttttaatttcatgagaggctttgcagtgttccaaatgacaatttactatttctgtttcctttgtgtataaacggattggactcttctgaccatttgaccatttattccttggaatatggttattgaccttatatatttcatatttgtaatagatttatatacatatatataagcttgtaaacgtttatcagctattttcctcctctattactgtcccttttttacatttcattgggcaaaactattttatttttatatattcatacctattcaatttgtctctgatgatatcctttatttcacaatagtcagaagtttatcttccttccacagctggaataaatatgctattccaattttttttttaacatggaactctgcgacccatctgaatgggattgcagctgtgtgggaggaagcagttctaattttctgaactgatagccaggtggatacccagctaccccaactacatgtcttcagcagcacatcctctcaccattgtcatgttgcttctggtttgtaatattaaagtctttaagagtttaagtaatttccaaaactttttcttgttcccttgaatcacttctcattttctaacctaaaattgtatgtagataattaaaaaaaaaaaatactgttctggcaagtgaaataagaaatggagtattaatatttgaaaaaagagataaaattatgtttacttggtgataatgaaattcttttaaaaatctaaattcaagcagccaggtgcagtggctcacccctgtcatgccagcactttggggaggctgaggtgggcggatcacctgagcccaggagtttgagaccagcctgagcaacatgtcaaaactccgtctctaccaaaaatacaaaaattaaccagtctcataacccggtctatagatagatagatagataaaaaaatattttttaatcta

SEQ ID NO: 23475 - DNA, 448 bp, Homo sapiens
ggggacagacaaaccataaccaaaccagagtagctcccttaagaacatttaggactaccacttctgagcaacttctgactgtctagttgtagcagctttaatttctttccctatgtacccagaaggagtggccttgcctggctctacctcttctcattccctaaccagcagatcgatttcagagggcttttcctgtgaggttcatactctgtactttttttgacaaagtaggagatgaggtggtaatgatgtgtagagagggttggggagatggggattagtaaagagaagatagaggacatggaaattgcaggagctgagtggtaaacaggaagccttatggcaagagtgtcagggatggtggcctgtggaaaaaacggggaaggagaagagaaggggggattgcagagagagcgaggaaaaccaaggaggccaatgaccttgtctg

SEQ ID NO: 23476 - DNA, 371 bp, Homo sapiens
gctcgacctgcctcccaagtagctgggattaccgggatgcacccccatgcctggctaattttgtatttttgggaggcagaggcaggagaatcgcttgaacccgggaggtggaggttgcggtgagccaagatcatgccattgcactctagcctgggtgacagagcaagactccatctcaaaaaaaagaaaaccaaaaccaagctatacactgtctacaagagactcactttgtgtatacacagataggtctagaataaatagaaggaaaagaccagtttggctgggtgtggcggctcacatctgtaatctcagcactttcggaggtcaatgcaggtgggtcacttgaggcaaggagatcgagatcagcctgg

SEQ ID NO: 23477 - DNA, 289 bp, Homo sapiens
taagtcactgaagtgtaccctttaagccagggagggacagggccacactttcagtgctaacaattggtttctctctgagaatgaagtctgcaatctgtcacatcagaacaggaagagaggatttgagggagaaccccttctcagatctccagagtgtggaagggacgttttggtgctggctatggctttgtgacactgcagttgaaacgggcaaagtgggctcctcacttgaagaactttgatgcctctaaatgctctgatgagaaaaaacttgtcctcaaaatcgatg

SEQ ID NO: 23478 - DNA, 205 bp, Homo sapiens
ctatcagactgctaaacagcaatcatttgttcacataagatttagtaaacttctcttatgcaccatgtagtgcgctaggtgctggagatgtagaagtgaatataacaaaatccttatcatgaaaaattagatggcaatccagtgggaaaaaactgacacgtaaacatataatgaaatctggaagtgatatgatgaagtttgttca

SEQ ID NO: 23479 - DNA, 171 bp, Homo sapiens
gtaatgtctaatctgctaataaacctacctagcatatttttatctcaagtataatttgtgtccctagaagttttatctggattcttttgtttcgttttttgttggtttgttgctgttgttgttgttgttgagacgggatctctctatgtagcccaggctggtcttgaactc

SEQ ID NO: 23480 - DNA, 818 bp, Homo sapiens
gccccagacacatcctgcagctccccaagtgtgttcacagggagagagtcactgtgaggggttcctggcctggttttcctgtaaacctaccagaggaacccacatgtcatgcacagcaattagcatgccctgctaagacatctgcaggtagtggtagtgggtttaggactgtctccccagctttccacatgtgtcagagaactgtgaggaatgacagagctcttactcaaaaagcttatttgagattaggtaaagtccagtgagggtaaaattgcacaccttttaccacattcacctggggtcagtgtagacgccaaggttgtcaagcagctcttgcataaggactatgctggcagagaaaaaggcagtttccctgaggtcaaaggaggtgtttcaggcactcctggctccagacagtccctttctggcagagagggccagaaggagagctcagcagcgcagggccacctttctgcagccatcatcacaagtaagggcgagtgcttttgaaacctcaaatgcatccagctccaggaaggggataagtggctagctaaaagaaaaagtctttcaggtttcagtcacattgctggttacctcagcaaaatgttcccagaacacccactcaggtccctgtgtgtcatagtaatgatgcatctagtgactggtggtggcagaattctaagtagacccagctcttaagaaagcagtgttattccccttacctgtagtttgtctttattacttttaaatttttcttccagagaaaagtagtaacaggtcaggaaaatcccaggcgaaggagtaagccttctata

SEQ ID NO: 23481 - DNA, 418 bp, Homo sapiens
cctgaagattctggattttgaagacttagaaaaagcattattttgtctgctactctggttagattatttgcctttgcttggaatgggcaagacaaaactggacattaaattatgaattgctgttcatatatatcgaagcccattttaaaaagtagctgtaggttgggcatggtggttcacacctataatcccagcactttgggagtacgaggcaggcagatcattgacgccaggagtttgagaccagcctggccaacatggcaaaaccccatctctactaaaaatacaaaaacttcgccaggtgtaatgacatgtgcctgtagtcccagctacttggggcagggggcgggtgaaatgggagaatcacctgagcctggggaggttgaagttgcagtgagctgtgattgcgccgttgcac

SEQ ID NO: 23482 - DNA, 334 bp, Homo sapiens
aactactgggtactaggctcagtacctgggtgattaaataatctatacaacaaacccccatgacacaagtttacctgtataacaaacctgcacaggcacccctaaacctaaaataaaattttgaaaaaatcacattgctaacatggggcacctcctgggttcactgttctctgttcctctgtgtgtctcccactgcccgtgctgcaccacagctgtccgatgtcccgaaatcaggcatgcagttccttctagtcatcgtatttcagcgctgttttagctatccttgttactttgcttttccatatacgttttagaataatcttgtctttaccta

SEQ ID NO: 23483 - DNA, 1392 bp, Homo sapiens
tcaaaaagatgtttttccagtgttcttgaagtcatgaaaaaatgaacttttatatttttgttaggagtacaaattaaaacagttctttgtgaggtgaatttggctctatctcatcaaagttataaataagcaaatcctttcgctaaatagttcctcttggaatatatccttcagaggtacttaactaatgctctaatatttgtatacactgatgtgcattgcagtatttttgtaataatgaaatattgggaacaacctaaatgttcagagactggttatagtacataacattatagaatgtgttatgaatattaaaaagaagaggtaggtatgtactgacatggaaagatgcctatgagaagtgagcaaagcaaggtgcagagcagtatggatctcacctttgtcaaaacaaattaaataaatgcatgctatatattcacatacctatgtgtataatatacacattgagtctttaaagttacattttatgtgaatgtacatgaaaagatttgaaggcatacatgctcactcaggatactcctaggattggggtgggagagggggaggtgataagggaagaatgttcacatctttatataatttgttatctatagttataaaaaggaaatataaatggtaccacaagatctaattacttgaggtgaacgaagattgtcagttcatgacttgcaaactactagatggattaaggagttataaaagaaatctatcaaagtatttgttcttaatttttaaacttaaaaatgaaaggaaaaaaaattttttaaatgatccccagtactggtcagagcatgaggcatagtaaatatttttacacactgcttgtgggattagaaattggcacaacttgtgcagagggagtaatttggcagtgtattgagagtgttctatctcttgactcactaagcccgcttctgagagtcttaaaggaacaaaaggaagcgagagcaaaaaaatgtttacacaaaatgttttcattgattattaaagaatatattggtgggaggtgtgcactggatatttccagggaaggagtggctaagtaaattaaggtatgctcatttgacagaatatctattatatgactcaaaatggatgcatataataaccttaacatgggaagattattggttatcatagtaaattttttaaaaggaaaaatctaagatttgatagcccttatgagctcacctctgtttaaatgtattatttatacagagattaaactggtgtaaaattaaagatagaaaactaagacaaacataagtacaaatgtgttttctgaatttctggcttaccctagagctgacctgtagggaacaggtggcaaaatagttggtgactgttgtccctaatttgtgccctcatttt

SEQ ID NO: 23484 - DNA, 379 bp, Homo sapiens
ctgctgaattgggcctcagaacaatagacccctagcttagtggaagaactgcatcccctcataccttaaagagtacatatgtgcctcaagtcacaggtgctatagtaattttcaagacactgagcctaggaacccactccacagctgctttgagcacctgtgcctgggatcccagtgccattatggctgcctataggctgtgtcagatccaataccaagaaagaccccctcagctaagactccacactgttaggacgataagaacagaagtatccctaaagcccctgaccttataacctatccagccactgccactgccacaaactcctgaagcctaggtcactgaagcacttgtgtgcattgttaacattgatcctaa

SEQ ID NO: 23485 - DNA, 494 bp, Homo sapiens
cccccccttgttttctatgcaagaagactgaggccagtgagaggaaatgatgtgctcaggcatgcacagtgagacagcgattggagccaagactagacttcagtgccctcatttccaccctagacctgctccaagactctatggagccttcattgaggagcgtgggagtaggggttagtctaaaattgaaaaaagaatttgggtcgagtgcagtggctcacagctgtaatccccacactttgggaggctgaggtgggcagatcacatgaggccaggattttgagaccagcctggtcaacatggcgaaaccccatctctactgaaaaaaataaataaataaaaaaattagacagacatggtggtgcacatctgtaatacagctcctcgggaggctgaggcacgagaatctcttgaacccaggaggcagaggttgcagtgagctgagatcatgccattgtgctccagcctgggtgacagagcaagactctgtctca

SEQ ID NO: 23486 - DNA, 509 bp, Homo sapiens
taatctagcttttaaatctcataacttattaatatagatcctgtttggatgggagattccaatatttcatcactgttaattctctttcttattttggggtatgtctttgttagacatggcagagggcgctttctaaacagagctctttccaccaagtattatatttagaagctcatagggactctgaatggaacaaaagcttatgctaagataaaaaatacaggctgggcttggtggctcacacctgtaatcccagcactttgggaggccgaggcaggcagatcacttgaggtcaggagtttgagaccagcctggccaaaatggtgaaacccctcctgcctactaaaaatacaaaaattagccaggcgtcatggcacacacctgtaatcccagctacttgggaggctgaggcaggagaattgcttgaacccgggaggtggaggttgcagtgagccgagagcacgccattgcactccagcctgggcaacaagagcgagacgctgtctcaa

SEQ ID NO: 23487 - DNA, 434 bp, Homo sapiens
tgaggtcaggagtttgagaccagcctggccaacatggtgaaacctatctctgctaaaaatataaaaattagccagccatggtggcaggcacctgtaatctcagctactcaggagactgaagcaggagaatcacttgaacctgggaggcagaggttgcactgagccaagattgcaccactgcactccagcctaggcaacaaagcgagaatccgtctcaaaaaaaaaaacaactaaaaaaataaaaataaagggatgttctttgatgagcagcgggacaaatcatctaagttttgtttcacattgtagggagattaacctgtggggggatgctcagactggcatggggcgacccaggatgaatgagggtcttcaggtggtgagattaggcaagtgggatcttgctgtgttgcccaggctgatctccaattcctggg

SEQ ID NO: 23488 - DNA, 1414 bp, Homo sapiens
  misc_feature (1365)..(1365): n is a, c, g, or t
  misc_feature (1404)..(1404): n is a, c, g, or t
accccacaggtatatgatctgtaaaacaggctgcgcccagtctttttatttttaaaaataataataaaaaatagtaaactttatttttagagcaattttatgttcacagtaaaattgagaggcagctctttttttgtttttacagtagaatttcagttaataaatagaaggagtgatggaaatagaaaatcatcattaggcgatctccatggcaggttcttgttgcaggcaagaatcaaccaatggatgctaaaattagtgggtgaaagtgtggtaagaaacacggtatttaaataggctctaagtatctgccctacaaaatacttattcattacaaaggggaacctttgtaatgtaacactggagaaatctggatataccactctaacctggtgacacattgacatctgtcagaagacaaaaattttgacaaaccaagtttaaagattaattggcttttattagcaattcatgaatcaggcagcatcccatctaaagatttacaaaggcactccaatgagctgagcagtggaggcaggctttattggtagaaaaaagctgaagaaggcagaaacaaggaaaaagagtgattgctcattacaaaattactttccttgtagggttaaaacagaggaacttcattatcttgctagcacaaataaactggccccttctgattggttgctgtgaatggcctgtttgttggaaaactggcccattttattgttcagtttgattatgtggtgcctagcaggagtgactccattcaggttttgtgtgctctgttggagtctagtgtagaaactcagcccaaaacagtggctttctatacgtttatttaacacgtcagatgcttcctgatgcagtgcactgagaaggacatagcatcgcctctgtggtattttttgccaggaaaggtaatttttgtctaatcatgagaaaacagagataaacccaaattgaggaacattctacaagataacttcccagtactttaaaaaagtctcaaagtcataaacaagaaagaactgagggactattgcatattggagcgatctaaagaagtattacaatttgtggaattcttgattaaatcctggaccagcaaaaggacattagtgggaaaattgatgaaattcaaatgagatcttatattgaagttaattgtgtcagtgtacatttcctggttttcataattgcaagtgattatgtaaggtttgttaatattaggagcacctgagcctggaaagttgaggctgcagtgagctgagatcatgccactgcactccagcctgggtgacagagcaagctctgtctcaaaaataaataaaaataaaaaagaagagaaaaaaagtctattataancacaccacaacacaaacatgttttaaatggcaaggtagntgatgtggtg

SEQ ID NO: 23489 - DNA, 465 bp, Homo sapiens
catggctggtgctgctgttcctgatggtgctgctcctatgctgagcaccgggcatctgctcaaccaggacagcaaagaatcctccaggtaaaatatcgcttagtgtggaggttgggaactcctgatctttgtccaccgtggggatggaaggaagccagggtgaaggggataaggaactgtctgtgtgagctacccccctaagaaatggcagtgaaggccctctcctgaagtcagcatctccagacggtggtgttcccaccagtgatggctaaacccaggaaggcagacgaacccctggcccacatgatggacacatttccacgtttcctgggaaagactagatgatgacagagttggacagggatatatcagtcccttatcagttgcttttataagggaagaatatgaacctacatgtatgatttttgcattataaaatttataaactcagaaataatttagtaa

SEQ ID NO: 23490 - DNA, 464 bp, Homo sapiens
ggtgctgctcctaggtaggcaccggggatgctgctcaacctcccgcaaggcacaagacagccccccgacagcaaagaatcctccaggtaaaatatcgcttagtgtggaggttgggaactcctgatctttgtccaccgtggggatggaaggaagccagggtgaaggggataaggaactgtctgtgtgagctacccccctaagaaatggcagtgaaggccctctcctgaagtcagcatctccagacggtggtgttcccaccagtgatggctaaacccaggaaggcagacgaacccctggcccacatgatggacacatttccacgtttcctgggaaagactagatgatgacagagttggacagggatatatcagtcccttatcagttgcttttataagggaagaatatgaacctacatgtatgatttttgcattataaaatttataaactcagaaataatttagtaa

SEQ ID NO: 23491 - DNA, 303 bp, Homo sapiens
tccaggctggtctcaaactcctggcctcaactgatcctcccaccctggcctcccaaagtgctaggattataggcatgagccattgcacccagccagattgttttgtaatgaaaactacttccttctagagttaagataacactttctgaacagtatctaaggaagaaggtacacaaaataaaaataaattggtgttcatatattaaaaaaatgcatatatgcataatatgctcactgatataagaaaataggtatttttccatatggcccagcaattccattgctaggtatatacccaaaaga

SEQ ID NO: 23492 - DNA, 2247 bp, Homo sapiens
  misc_feature (1)..(1): n is a, c, g, or t
ncggcacctggaaatggaaagccagtgaaggctgctttgggccggggcagcgggtgggaccgggcgggagggattccaaagagaccgccgggaaggctagagcttggaattccggctcctcggagtcctggccctcccccaccgccgcctcggagctcagcacaccttggatgggggaggcgggcagctcctagccccgcaccccaggaggcgcgctcggagggaagccgccaccgcgccgcctctgcctcggcgcggaacaaacggttaaagattttgggcagcgcctcgcggggggaggagccaggggcccaatccgcaattaaagatgaactttgggtgaactaattgtctgaccaagcggaggaagttcctgcagatgaagcgcaggaaatacggcttcatctacaagacgcatctgttcgggcggcccaccgtacgggtgatgggcgcggacaatgtgcggcgcatcttgctcggagagcaccggctggtgtcggtccactggccagcgtcggtgcgcaccattctgggatctggctgcctctctaacctgcacgactcctcgcacaagcagcgcaagaaggtgattatgcgggccttcagccgcgaggcactcgaatgctacgtgccggtgatcaccgaggaagtgggcagcagcctggagcagtggctgagctgcggcgagcgcggcctcctggtctaccccgaggtgaagcgcctcatgttccgaatcgccatgcgcatcctactgggctgcgaaccccaactggcgggcgacggggactccgagcagcagcttgtggaggccttcgaggaaatgacccgcaatctcttctcgctgcccatcgacgtgcccttcagcgggctgtaccggggcatgaaggcgcggaacctcattcacgcgcgcatcgagcagaacattcgcgccaagatctgcgggctgcgggcatccgaggcgggccagggctgcaaagacgcgctgcagctgttgatcgagcactcgtgggagaggggagagcggctggacatgcaggcactaaagcaatcttcaaccgaactcctctttggaggacacgaaaccacggccagtgcagccacatctctgatcacttacctggggctctacccacatgttctccagaaagtgcgagaagagctgaagagtaagggtttactttgcaagagcaatcaagacaacaagttggacatggaaattttggaacaacttaaatacatcgggtgtgttattaaggagacccttcgactgaatcccccagttccaggagggtttcgggttgctctgaagacttttgaattaaatggataccagattcccaagggctggaatgttatctacagtatctgtgatactcatgatgtggcagagatcttcaccaacaaggaagaatttaatcctgaccgattcatgctgcctcacccagaggatgcatccaggttcagcttcattccatttggaggaggccttaggagctgtgtaggcaaagaatttgcaaaaattcttctcaaaatatttacagtggagctggccaggcattgtgactggcagcttctaaatggacctcctacaatgaaaaccagtcccaccgtgtatcctgtggacaatctccctgcaagattcacccatttccatggggaaatctgatgagcttgaatgttcaaacctgagacttattggaagtgtacatatgagtttttaaggagtgttgtgttgactttatatttaatttctaaatgtatattataatatttatgtgttttgactatactaccacaatctttaaatattaaaataatgaatttgtatcatttccaaataaagtaaaatttgaaggtacttttctggtattttaagattcctgttgggtaaaactcaccagtttagtattttcttagtgtatttaaccagattttacaatgcctacctggacttatttgtcatctttgcatctgttttctgtgagaagaaatcttagctgttttttatgttaacagttattagaaaatatatgtctgtgtgtgttattccagacgtatctctgtaaattcttctatagtcacttagattccctatttggaaaattgatccaagttaatttaatttttttttggtttgctgtactttagggaaagatgaacctgaaaaggtaacactgagaactgtcactctaacctctccagcttatctaacatgtcataaacataataaatctgtgttgtccaata

SEQ ID NO: 23493 - DNA, 2093 bp, Homo sapiens
gaattcggcacgagtggcgcgggaggtcgcggcgcgccatggggctcccggcgctgctggccagtgcgctctgcaccttcgtgctgccgctgctgctcttcctggctgcgatcaagctctgggacctgtactgcgtgagcggccgcgaccgcagttgtgccctcccattgccccccgggactatgggcttccccttctttggggaaaccttgcagatggtactgcagcggaggaagttcctgcagatgaagcgcaggaaatacggcttcatctacaagacgcatctgttcgggcggcccaccgtacgggtgatgggcgcggacaatgtgcggcgcatcttgctcggagagcaccggctggtgtcggtccactggccagcgtcggtgcgcaccattctgggatctggctgcctctctaacctgcacgactcctcgcacaagcagcgcaagaagccgcgaggcactcgaatgctacgtgccggtgatcaccgaggaagtgggcagcagcctggagcagtggctgagctgcggcgagcgcggcctcctggtctaccccgaggtgaagcgcctcatgttccgaatcgccatgcgcatcctactgggctgcgaaccccaactggcgggcgacggggactccgagcagcagcttgtggaggccttcgaggaaatgacccgcaatctcttctcgctgcccatcgacgtgcccttcagcgggctgtaccggggcatgaaggcgcggaacctcattcacgcgcgcatcgagcagaacattcgcgccaagatctgcgggctgcgggcatccgaggcgggccagggctgcaaagacgcgctgcagctgttgatcgagcactcgtgggagaggggagagcggctggacatgcaggcactaaagcaatcttcaaccgaactcctctttggaggacacgaaaccacggccagtgcagccacatctctgatcacttacctggggctctacccacatgttctccagaaagtgcgagaagagctgaagagtaagggtttactttgcaagagcaatcaagacaacaagttggacatggaaattttggaacaacttaaatacatcgggtgtgttattaaggagacccttcgactgaatcccccagttccaggagggtttcgggttgctctgaagacttttgaattaaatggataccagattcccaagggctggaatgttatctacagtatctgtgatactcatgatgtggcagagatcttcaccaacaaggaagaatttaatcctgaccgattcatgctgcctcacccagaggatgcatccaggttcagcttcattccatttggaggaggccttaggagctgtgtaggcaaagaatttgcaaaaattcttctcaaaatatttacagtggagctggccaggcattgtgactggcagcttctaaatggacctcctacaatgaaaaccagtcccaccgtgtatcctgtggacaatctccctgcaagattcacccatttccatggggaaatctgatgagcttgaatgttcaaacctgagacttattggaagtgtacatatgagtttttaaggagtgttgtgttgactttatatttaatttctaaatgtatattataatatttatgtgttttgactatactaccacaatctttaaatattaaaataatgaatttgtatcatttccaaataaagtaaaatttgaaggtacttttctggtattttaagattcctgttgggtaaaactcaccagtttagtattttcttagtgtatttaaccagattttacaatgcctacctggacttatttgtcatctttgcatctgttttctgtgagaagaaatcttagctgttttttatgttaacagttattagaaaatatatgtctgtgtgtgttattccagacgtatctctgtaaattcttctatagtcacttagattccctatttggaaaattgatccaagttaatttaatttttttttggtttgctgtactttagggaaagatgaacctgaaaaggtaacactgagaactgtcactctaacctctccagcttatctaacatgtcataaacataataaatctgtgttgtccaata

SEQ ID NO: 23494 - DNA, 376 bp, Homo sapiens
aaatacggcttcatctacaagacgcatctgttcgggcggcccaccgtacgggtgatgggcgcggacaatgtgcggcgcatcttgctcggagagcaccggctggtgtcggtccactggccagcgtcggtgcgcaccattctgggatctggctgcctctctaacctgcacgactcctcgcacaagcagcgcaagaaggtgggggcaggaggcgacggctggacagggagggggaccccatttatgagcggaattccggctgatggatgctaggcgcgggctagcagcttgaggtgggctaggaccctctgccagctccaggttagctttcccagctcggagagtgccatgtgtctggcaggactgggggtgtctggaa

SEQ ID NO: 23495 - DNA, 1723 bp, Homo sapiens
gaattcggcacgagtggcgcgggaggtcgcggcgcgccatggggctcccggcgctgctggccagtgcgctctgcaccttcgtgctgccgctgctgctcttcctggctgcgatcaagctctgggacctgtactgcgtgagcggccgcgaccgcagttgtgccctcccattgccccccgggactatgggcttccccttctttggggaaaccttgcagatggtactgcagcggaggaagttcctgcagatgaagcgcaggaaatacggcttcatctacaagacgcatctgttcgggcggcccaccgtacgggtgatgggcgcggacaatgtgcggcgcatcttgctcggagagcaccggctggtgtcggtccactggccagcgtcggtgcgcaccattctgggatctggctgcctctctaacctgcacgactcctcgcacaagcagcgcaagaaggtgattatgcgggccttcagccgcgaggcactcgaatgctacgtgccggtgatcaccgaggaagtgggcagcagcctggagcagtggctgagctgcggcgagcgcggcctcctggtctaccccgaggtgaagcgcctcatgttccgaatcgccatgcgcatcctactgggctgcgaaccccaactggcgggcgacggggactccgagcagcagcttgtggaggccttcgaggaaatgacccgcaatctcttctcgctgcccatcgacgtgcccttcagcgggctgtaccggggcatgaaggcgcggaacctcattcacgcgcgcatcgagcagaacattcgcgccaagatctgcgggctgcgggcatccgaggcgggccagggctgcaaagacgcgctgcagctgttgatcgagcactcgtgggagaggggagagcggctggacatgcaggcactaaagcaatcttcaaccgaactcctctttggaggacacgaaaccacggccagtgcagccacatctctgatcacttacctggggctctacccacatgttctccagaaagtgcgagaagagctgaagagtaagggtttactttgcaagagcaatcaagacaacaagttggacatggaaattttggaacaacttaaatacatcgggtgtgttattaaggagacccttcgactgaatcccccagttccaggagggtttcgggttgctctgaagacttttgaattaaatggataccagattcccaagggctggaatgttatctacagtatctgtgatactcatgatgtggcagagatcttcaccaacaaggaagaatttaatcctgaccgattcatgctgcctcacccagaggatgcatccaggttcagcttcattccatttggaggaggccttaggagctgtgtaggcaaagaatttgcaaaaattcttctcaaaatatttacagtggagctggccaggcattgtgactggcagcttctaaatggacctcctacaatgaaaaccagtcccaccgtgtatcctgtggacaatctccctgcaagattcacccatttccatggggaaatctgatgagcttgaatgttcaaacctgagacttattggaagtgtacatatgagtttttaaggagtgttgtgttgactttatatttaatttctaaatgtatattataatatttatgtgttttgactatactaccacaatctttaaatattaaaataatgaatttgtatcatttccaaataaagtaaaatttgaaggt

SEQ ID NO: 23496 - DNA, 332 bp, Homo sapiens
gggaaaccttgcagatggtactgcaggtaagggagggtggggcgggacaggctgcttccccggagcccggcgcggctctgggcttctgctgaagtcggggtaggcgcccccgggaggcatgctattgcggctaggagcagggctggcgggagcgcggcgctccccggcgccccctcatgcccacttctctcctccgccttcctcccacagcggaggaagttcctgcagatgaagcgcaggaaatacggcttcatctacaagacgcatctgttcgggcggcccaccgtacgggtgatgggcgcggacaatgtgcggcgcatcttgctcggaga

SEQ ID NO: 23497 - DNA, 206 bp, Homo sapiens
agattccacaaaaagagtgtttcaaacctgctctgtgaaagggaatgttcaactctgtgacttgaatgcaaacatcccaaagatgtttctgagaatgcttctgtctagattttatatgaagatattcccgtttccagcgaaatcctcaaagctgtccaaatatccacatgcaaattctacaaaaagagtgtttcaaaactgctcta

SEQ ID NO: 23498 - DNA, 349 bp, Homo sapiens
taggaacttgaaaaatgaatgctttttttttgtcttgttacattaggaatatttacattaggttgatcttcaataatgaattttttttaaaagcctgatttaatggatcaagaataattttagttagagagcaagccgggcatggtggctcatgcctgtaatcccagcactttgggaggccgaggcgggtggatcatgaggtcaggagatcgagaccatcctggctaacatagtgaaacccccgtctctactaaacataaaaaaaattagccaggtatggtggcgggcacctgtagtcccagctactcaggaggctgaggcaggagaatgacgtgaatccaggaggcag

SEQ ID NO: 23499 - DNA, 468 bp, Homo sapiens
ttgggaggctgaggcaggagaattgcttgaacctgggaggtggaggttgcagtgagctgagattgcgccacagcactccaacctcggggacgaagcaaaactctgtctcgaaaaaaaaaagaaaagaaaagaaggaaagcgaaaaaaaaaagaaaagaaaagaaggaaaggagagggaggaggagggggagaaaagaaaggagagggtggagaagaaaaatgaaagaaaaaagaaaaaaggaaaagaaagatgacttctatagttgttgtgggttagaaacaatcttcagtgtaggaaggcaagtttaacactgaaacaggtttcagatttggttttcttcataaaataaacaacaaaccaaatatggaaatgttcaaacagaaagaagaggtgcaaaaggagttttcaagttttgctaatgtgcaccaagaaacactatactaattaataaaaacatctatatataa

SEQ ID NO: 23500 - DNA, 496 bp, Homo sapiens
attaaagtctttacttaaaggaaatcaatatgtattaataggatttttaataaataaaaaactagggccgggtgcggtggctcacgcctgtaatcccagcactttgggaggccaaggcaggcagatcgcttgaggccaggagtttgagaccagccgcctgggcaacgtggtgaaaccccatctctactgaaagtgcaaaaaattatctgggcatggtggcacatgcctgtggtccaagctactcaggaggctgaggtgggaaaatcacctgagctgcggaagtccaagctgcagtgagttgtgatcaggccactgcactccggcctgggtgatgggagcaagaccctgtctaaataagtaaataagaaactaggactacaatatttattcttataagctattatatctatcttccctgggcagaaccccctaaagaaagtgacaacaaaagagaacacggaaaagcagtagataaaaaggcaagttgggggaagaa

SEQ ID NO: 23501 - DNA, 440 bp, Homo sapiens
ttttgagatggagtcttgatctgtcgcccaggctggaatgtagtggcgcgacctcagctcactgcaacctccaccttctgggttcaagcaattctcctgcctcagcctcctgagtggctgggactacaggtgcacgccatcacacccggctaatttttgtattttagtagagacggggtttcaccatgttggccaggacggtctcgatatcctgacctcatgatccatcaactcagccttccaaagtgcagggattacaggcgtgagcccaccgcgcccggccaagaaactgatttttttttaaggcacccccactggggatatactggcccaggtgattaacttcagcaccaggtggtaacacctggaatggttcccagtgctccagtttccagttagggtccttatgatttgaggataaaatgtgaaatgggttcact

SEQ ID NO: 23502 - DNA, 234 bp, Homo sapiens
gtagaagatggcaccaagccatttcaggaaatgttattgtttatgagggtctttagtgtgatatcctaagaaaaaggtaaaatggtgtccatcagtcatgcagccctatccctatttttgtatttcacaacatctttaaagtctgaatgaggaatgttggctacttttgcctaaactggcccttttctttccattgctgaatattaattaaaagaaagtataggccaggtgagg

SEQ ID NO: 23503 - DNA, 375 bp, Homo sapiens
aagactctcagaaaaaaaaaaaaaaaaaaaaaaaaaaagattgtaatgaagctggaaaattcctattgacgtcatagccatcataatgtcatagagcaatgcattactcacatgggtgtggtgatcctggtgtaaactaacctactgcattgccagtcatgcgaaagtatagcacatgccatcacgtatagtacgtaatacttgataatgataataattttcatttttattttctgtacttgctgtactgtacagatattattttctgtacttgctgtactgtactctttatcataactttacagtgtactccttctatttgtttaaaaacaagttaactgtaaaacaagcaggtccttccaaggtattccagag

SEQ ID NO: 23504 - DNA, 585 bp, Homo sapiens
aacagaggccctgaagttattcgtgagcaagtctgggaaatggaaatggaggttccaattcctgtttttactaatttaatgtgtataaaatgttatctatatcttttcttcattcctttgttccttcctttcttttgagggactttcataggttcattcaagagttttaacccctaactcatttttctcacaaggccttaaattccacaacctcatcatctaccacctttggtgctttcagaatcatgactctcaatgttgaagaatgggctactgcatggaaggtgggtgcaaacccctaaaatttccacccctggttctggaaagtgagaaattggggatttcaatactgcaagccatccttcacattctaaactcattgtctttacttagttccgtcagcatttctttcttccagtcagtggggtattggcatggacttgtactggctcataagagctgattggtaagttttcaggaatttgcaagctggttgttaagcacagtcattattgaaagcaaattatgtaaacttacaattaaataaattatatcaaaaccaaaaataataaatactcagaactt

SEQ ID NO: 23505 - DNA, 1042 bp, Homo sapiens
aggctctgttgtccctcagacggcgctgctgcagtgcgtcttcgcacttacgcggagcggtaatgtgaggaagcctcccgccaaacagatgagggaggaggaggaggggagaggccagagagagaagcggctttcgggaaggaaagtgtgatctaggaggtggaatagtcctctccaaactttgacctgaggtgagaatgaccctctatttggatttggattacacaaagtttaacgttttttggaaaaatcctacctaggtaatgtgtagttctcaatgcatcatgtcaggcagcttatgatgccaatttgtcccatggaaagaaaaatgtactgtatttcactgtgctgaatgcaactgccaatcaagatagtctgcagcctacctgtggaccttaatgatttcacatgttctgcggaagaatttctcccccacctccaatgactatggcattccttgggaaagttagcttggtatttacttttccccagcaggtcccaagctgaccaaaaaaataaataaaaataaaaaataaaatcaacaacaacaacaacaacaacaaaaacacaaaacaacaatcagttagccaggctgtttcaatggcccaataagttccatgatagcaagaattctatgaataataatgggacatggaatcccatgcagcctcgcgagagctcagccaaatcacccggaaattctgcttcatcacagccctttctcttgccataaaactgcttgggctctgtctttgcttccacatcatttaagcctttctgccgaccctccagcaattccatccctggggcctccgcccgtcactatgctggggctccccagggcttctcaagaggctccgtcagctccatcctagaggcctcttcacagcaccagatgaagtccacacctccttttgtaggacgttcaagcaacacaggccagagtaaggatcaaagtaaaagtcatcctaaattcaccactgagagataccactgccggtaaacaggagactgctttttcggatgtctacgcatttataca

SEQ ID NO: 23506 - DNA, 477 bp, Homo sapiens
  misc_feature (125)..(125): n is a, c, g, or t
ggaaggatttcaggcatggcttgatccagctactcaaaaaaggttgtcagaaatgtctgtccgttcttcatttattctttctcatttgtgggctttgttcccagataagatcactccttctgggnacaagatggtcactagtagatccaggtttactttctatcagctgagcaacctctcaagaaaaaataaataaataaataaacctctcttggattacaggcatgagccactgcactcggctgtaccgtgattattagttcaaggttctctttcactggggtaaagaccttaagagagcagtttttgggctttatattctcaatttcccgcacagtgcctagcacatagcaaggactcaacaaatttcattgaatgaatgaaaaaacatagtttaccaaatgtcagtgtactcaaactcttttaactgctagctatagaaatccaattaagactcacttgggtaaaaaaaaataa

SEQ ID NO: 23507 - DNA, 1064 bp, Homo sapiens
aggctctgttgtccctcagacggcgctgctgcagtgcgtcttcgcacttacgcggagcggtaatgtgaggaagcctcccgccaaacagatgagggaggaggaggaggggagaggccagagagagaagcggctttcgggaaggaaagtgtgatctaggaggtggaatagtcctctccaaactttgacctgaggtgagaatgaccctctatttggatttggattacacaaagtttaacgttttttggaaaaatcctacctaggtaatgtgtagttctcaatgcatcatgtcaggcagcttatgatgccaatttgtcccatggccttaaattccacaacctcatcatctaccacctttggtgctttcagaatcatgactctcaatgttgaagaatgggctactgcatggaaggtgctgatccttttagaggcagccgtggaagaggaaaagagatcagaagaggtgagcaacttcccgacagtaaggccctggctagacctcaggatggtccctgcctcctggacattaggaagcccaaaggccagaacaaaaacacatgcctagtgggggaaggctcactaagagggcaccaagtggggcaaatacccctggtaacccatttatggaggctgccacagaaatgctagttggaaattttcctccttcagtctatcatgaatttcttttttctcttttgagatgaagtcgcccgggctgcagttcagtggtgcaatctcagctcactgcaagctctgcctcccaggttccaacgattgtcttgtctcagcctcctgagtagctgggattacaggcatgagccactgcactcggctgtaccgtgattattagttcaaggttctctttcactggggtaaagaccttaagagagcagtttttgggctttatattctcaatttcccgcacagtgcctagcacatagcaaggactcaacaaatttcattgaatgaatgaaaaaacatagtttaccaaatgtcagtgtactcaaactcttttaactgctagctatagaaatccaattaagactcacttgggtaaaaaaaaataa

SEQ ID NO: 23508 - DNA, 1200 bp, Homo sapiens
aggctctgttgtccctcagacggcgctgctgcagtgcgtcttcgcacttacgcggagcggtaatgtgaggaagcctcccgccaaacagatgagggaggaggaggaggggagaggccagagagagaagcggctttcgggaaggaaagtgtgatctaggaggtggaatagtcctctccaaactttgacctgaggtgagaatgaccctctatttggatttggattacacaaagtttaacgttttttggaaaaatcctacctaggtaatgtgtagttctcaatgcatcatgtcaggcagcttatgatgccaatttgtcccatggccttaaattccacaacctcatcatctaccacctttggtgctttcagaatcatgactctcaatgttgaagaatgggctactgcatggaaggtgctgatccttttagaggcagccgtggaagaggaaaagagatcagaagaggtgagcaacttcccgacagtaaggccctggctagacctcaggatggtccctgcctcctggacattaggaagcccaaaggccagaacaaaaacacatgcctagtgggggaaggctcactaagagggcaccaagtggggcaaatacccctggtaacccatttatggaggctgccacagaaatgctagttggaaattttcctccttcagtctatcatgaatttcttttttctcttttgagatgaagtcgcccgggctgcagttcagtggtgcaatctcagctcactgcaagctctgcctcccaggttccaacgattgtcttgtctcagcctcctgagtagctgggattataggcacgcaccatcatacccgactaatttttgtatttatagtagagatggggttttgccatgttggccaggctggtcttgaactcctgaccttagggtgatccacccatcttggcctccaaaagtgctgggattacaggcatgagccactgcactcggctgtaccgtgattattagttcaaggttctctttcactggggtaaagaccttaagagagcagtttttgggctttatattctcaatttcccgcacagtgcctagcacatagcaaggactcaacaaatttcattgaatgaatgaaaaaacatagtttaccaaatgtcagtgtactcaaactcttttaactgctagctatagaaatccaattaagactcacttgggtaaaaaaaaataa

SEQ ID NO: 23509 - DNA, 1076 bp, Homo sapiens
aggctctgttgtccctcagacggcgctgctgcagtgcgtcttcgcacttacgcggagcggtaatgtgaggaagcctcccgccaaacagatgagggaggaggaggaggggagaggccagagagagaagcggctttcgggaaggaaagtgtgatctaggaggtggaatagtcctctccaaactttgacctgaggtgaggccttaaattccacaacctcatcatctaccacctttggtgctttcagaatcatgactctcaatgttgaagaatgggctactgcatggaaggtgctgatccttttagaggcagccgtggaagaggaaaagagatcagaagagaaaaggatattggtttgcggaacatgtgggacaagaagttcccagaagaatttgtgagcaacttcccgacagtaaggccctggctagacctcaggatggtccctgcctcctggacattaggaagcccaaaggccagaacatacccctggtaacccatttatggaggctgccacagaaatgctagttggaaattttcctccttcagtctatcatgaatttcttttttctcttttgagatgaagtcgcccgggctgcagttcagtggtgcaatctcagctcactgcaagctctgcctcccaggttccaacgattgtcttgtctcagcctcctgagtagctgggattataggcacgcaccatcatacccgactaatttttgtatttatagtagagatggggttttgccatgttggccaggctggtcttgaactcctgaccttagggtgatccacccatcttggcctccaaaagtgctgggattacaggcatgagccactgcactcggctgtaccgtgattattagttcaaggttctctttcactggggtaaagaccttaagagagcagtttttgggctttatattctcaatttcccgcacagtgcctagcacatagcaaggactcaacaaatttcattgaatgaatgaaaaaacatagtttaccaaatgtcagtgtactcaaactcttttaactgctagctatagaaatccaattaagactcacttgggtaaaaaaaaataa

SEQ ID NO: 23510 - DNA, 863 bp, Homo sapiens
aggctctgttgtccctcagacggcgctgctgcagtgcgtcttcgcacttacgcggagcggtaatgtgaggaagcctcccgccaaacagatgagggaggaggaggaggggagaggccagagagagaagcggctttcgggaaggaaagtgtgatctagtgctgatccttttagaggcagccgtggaagaggaaaagagatcagaagagaaaaggatattggtttgcggaacatgtgggacaagaagttcccagaagaatttgtgagcaacttcccgacagtaaggccctggctagacctcaggatggtccctgcctcctggacattaggaagcccaaaggccagaacaaaaacacatgcctagtgggggaaggctcactaagagggcaccaagtggggcaaatacccctggtaacccatttatggaggctgccacagaaatgctagttggaaattttcctccttcagtctatcatgaatttcttttttctcttttgagatgaagtcgcccgggctgcagttcagtggtgcaatctcagctcactgcaagctctgcctcccaggttccaacgattgtcttgtctcagcctcctgagtagctgggattacaggcatgagccactgcactcggctgtaccgtgattattagttcaaggttctctttcactggggtaaagaccttaagagagcagtttttgggctttatattctcaatttcccgcacagtgcctagcacatagcaaggactcaacaaatttcattgaatgaatgaaaaaacatagtttaccaaatgtcagtgtactcaaactcttttaactgctagctatagaaatccaattaagactcacttgggtaaaaaaaaataa

SEQ ID NO: 23511 - DNA, 579 bp, Homo sapiens
ctattaattcatttaattctcatagcaaccccataggtactgtaatccccgttttagggattggggaaccaaggcgtagagaaatcatatcatttccccagtaatcccagctgataaatggcacagaagaatttgggccaaggcagcatgagctccagacttccatttagagcattttattgcctactcaccttgactgtcagtctggttcagattctgccacttcccgctgcacgtccctggcattcagtttctttccctgtcaagttgttgtcataataccctccttggaggctttttgggagagttcagtgagagagactgtgtcacgctccacacggagtacctgaacataacaagtgtagctactggaccttctttttggttaacgtgaattaagaattagctctctacaaaaaaatataaaaattagctgggcgtggtggcacacacctgtaggtccagctacttaggaggctgaggtgggaggatcgcttgagcctgggaggtagagattgcagtgatccaagatcacaccactgcactccagcctgggtgacagtaagaccctgtctcaaa

SEQ ID NO: 23512 - DNA, 535 bp, Homo sapiens
cctcccagtagtgaattgctcatgacattgtcacacagaccttaatgaatgatatggaaagatactgaatatttttcctcccggaatgccaaccaagcttcagtgtcccagcgccttcattccagctgatcatggcaaaggcttggtactgagatccagtgagacctttgtcctacaaaaaccacattctcactggatgcctacaagtcctctctatgggactgttacccaagcctgtttacagaattttcaacaattacatctgcccatttgctgagtctcacttctctgcactaattgttgacttcaatttatatttttaatgtacaaatgctatcaccaacttcagtgcatgaagacctctctttcttctcttcaaacccatgactttgcttggaataacagggatggctttatggcatggctttctcattatttcatgtgtcttcattttgctttcccaagccagattgtaaattccttgaaagaggagaccctgaaaactagaaatacctatacagacagatagacagta

SEQ ID NO: 23513 - DNA, 245 bp, Homo sapiens
cttagtggtacttttttacggcagccctgggaaactaatacaatggccttttgtggctgacttcacttagcataatgttttcaacactcatccatgttgcagatgtatccgaacctcattcctttctagtgccttgagtatcagtttaaaaaaaacattgccagaccagacacagtggttcatgcctgtaatcctagcacgttgggaggccaacaccagaggattgcttgatcccaggagttcaa

SEQ ID NO: 23514 - DNA, 1854 bp, Homo sapiens
tctggcggggagcgacagacctaaatcaaattagggatggccagggtggccaccttcttggacatttacgaagatggaatcttggacattgtagtgctaagtaaaggatatacaaagaatgattttgccattcatacactaaaaaataactttgaagcagatgcttattttgttaaagttattgttcttagtggtctgtgttctaatgactgtcctcgtaagataacaccctttggagtgaatcaacctggaccttatatcatgtatacaactgtagatgcaaatgggtatctgaaaaatggatcagctggccaactcagccaatccgcacatttagctctccaactaccatacaacgtgcttggtttaggtcggagcgcaaattttcttgaccatctctacgttggtattccccgtccatctggagaaaaatctatacgaaaacaagagtggactgcaatcattccaaattcccagctaattgtcattccataccctcacaatgtccctcgaagttggagtgccaaactgtatcttacaccaagtaatattgttctgcttactgctatagctctcatcggtgtctgtgttttcatcttggcaataattggcattttacattggcaggaaaagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttttaaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataattaaatgagcaggaatttttgtgtccacttgacttggtcttgcttcttattctaatgatgcaaattatacttttgtgaatatatcacggagtcattaggcattcagcttcatcacagcaggtcaggggtctcactgatggcatacaatatagtgatcgggtactctgacttggtagcacagtaagacagacttgccttaaactcctaattcaaccacttacaaagtcattgtttgaacttggctcttgtttaacctctgtaaacctcagttttcttgtttattcagtggggctaatacttgagttactgtaaacattaaatgggatgatgtatgtgaagtgcttagcttggtgcctagcacagagtaagtggtcaatatgtggtagttgtcattattaatattttagatgatcttattagacttatacatctaattatagaaatacatagacttgatagaattttattttcaggcatgaagaaatattctttggaaaagctaaatttttggtgattgacataaagatttacttgctcatattaactaaaaattatagtactctccaagaattaatgtgccctaaaaattttcctccaaaaacttatccttatcatgtgataatgaagaacatttgatttcttgaaaggaaactgctgtaggcagcatctgggaatgcaaatcttcaatcacatttctattctcaaacacttggagaagtctataatttacattcagacttcaatgcaaattttgtattgtgaacttcacatttccaaaaagttactttaaaaagactttaagactgaaaaaaaaaagtttatcaatgctaata

SEQ ID NO: 23515 - DNA, 780 bp, Homo sapiens
caccacaattactgaaggaataccttaaagacccacacaaccacagctttttgaaagaccagggctgcatttacaatgacaggagaaacagacacagcttccgtgttgcctgaactggcataaacaacagaagaaatgaacagtgtcagattggcacacatctgcctggccagggcctcattcccacactccgtccgttctcccaaaaggattccccacccaccaccccccagatggctagtatccaaccatcagggctcaatcctaagcaaaatattgaactagctgttttcttctcactggcctggtatctgcaaagctaaccatccggctgccctaccttcaactttccttccaaacatagtactcctcagtctctccttcctcctagcctatacaaagtcaaagtttatgttaattttattaaagctatgccaacaacaacaaaaagtctcaaatcatatctaagacataccaggtgacaaaaattcatttataaacaaaaaagtttggataaagtagacatttttttagtttactatgaactgatgatatactggcaaacttactagatggagggctttgagccagctacttacacatcatgtcctaatctatgaaatagcccacgctgcagttgtagggatgaggggtaaagttcataagccacccagtgcacagccaaccacagtgggtgctcataattggtagctattcctaggatgatgagaaacaaggatatattagaaaacattcagaattcatctgtagaacaggtgg

SEQ ID NO: 23516 - DNA, 394 bp, Homo sapiens
atagctttatattgctgagtttaaacataaatggagaggattattttgattatttacatgcaagcacacaagcttaactgcacacacatgtcacactccagtagtctcctcacctttgctgagggccttttatgtgacaggaactgtattttacagacactctctcctgtaatccacagagccaccctgtcagacagttatcattaggttcactttagagatgctatcatctcaacttgggtatttcaaaagcaattcaaactctagcacgaacaaatagatctctttatgctcttgccctatcattactcccatttccaccccagtctaggctttcccattgttttccactttgatcaatggcctcactctttgttcagccacagaagccaaa

SEQ ID NO: 23517 - DNA, 509 bp, Homo sapiens
tttcctgcactgtaaaaggggaatcataatatccatcaatctccttataagattggaaagataaagaaactatatgtaaaattcttagcacaatgttcgatccatgtgcatgctcaataagtggttattcctcaaattagtttcatttgtattgggataaatcattgttccctcccataggtacattttctatttaaccagttgccagttctcagaatcttctcctgccccccacaccacacaggctgcagattgtagggatagatgacagaggatgggaggctcatctcactctctatttcaatacgttctacttcaacagcagggcttgtttttattaccttattgagttcacatgggtagcttttggcagcagcaattattctccttattactctacagatgaagaaatagatttggctctgatatgttggattttctcaagcaagtcccatatcgaaaataaaagcgtttaattctaatcagagacagccgggaaaaaaaaaaaa

SEQ ID NO: 23518 - DNA, 349 bp, Homo sapiens
ctttttttaacttgggaaaatacgttctaagcatactttttggagtaaaacctgttcgaaagttggagactgcctgtacccaggttgatagtcaattgtttttaatgctagtaaatcttaacactaatacaagtaaaaatatttgtgtggaaaactaatcctttctttattcgtgcatttttaactttataggtattaaaactttctttgtatgatcataattttttgatctttttgttttgcaagaaagtgaatggtagcctttcatttgtatgtttgattttcttaaaaatttcatatttattatgttattttacaaatgaaaaattatttgtgagaaatgttttgt

SEQ ID NO: 23519 - DNA, 503 bp, Homo sapiens
cctacttaactctaatcttgcttctgacaatatccatttagaacttcttagcttcaactttctgagaccactttttgtttcatatcatattatcagttcagtgccttgctcacaggacttcttctgcctggaatgtcttccttccctactctctagactttcctttcttaactcaatccaagtcctacctgctccaggaagccagctctcattctggtcctcagggtggccttgtctctccaaagtcctatgggtctcactatctttgctcatggaaccagcccatggcatgcctcctcaggctgcctggaagactctacacagatatggagaatccttgactcaggctgaggggcagtctagtaccaggctcttaatcttcagagatggaagaccaagaagggaattttagtccaagtctgggaaaagaagaaggtatattgagatttcagagggtaggatttagggaaggggctaagaagagggaaagcaaaaaaaaaaaa

SEQ ID NO: 23520 - DNA, 254 bp, Homo sapiens
gagatgagagtttcactcttgttgcccaggctggagttcaatgacgccatctgggctgaccgcaacctccgcctcccaggttcaagcctcaggttcaagattatcctgcctcagcctccggagtagctgggattacaggcgcctgccaccacagccagctaattttgtatttattatttttctgacaatgggaaagaggcagcagttgtaatatggatggctgttattcctattaccttctattaagaggcgct

SEQ ID NO: 23521 - DNA, 340 bp, Homo sapiens
ccggcccttccacctcaacgtgagaagtgtctctctcctagtaaacctcagtggccttaggctagggttggacatgtgagggtggtgtctattcctggagaaataacatcgcatttgattttgccacaggagctttctatacaaggttaacagcaatcctgttgtgaattccttggcgcctcatgtctcctaaacccagctaaactgacggaggccatggaaaccactaattttaacagtgccggtgacatcccttatcttttagctttcccaggcaggaaccgttgccccagcagacatgatgaagtagaggcaggagccagatcgtgaggtgcttaaa

SEQ ID NO: 23522 - DNA, 1499 bp, Homo sapiens
tgaaagcatctggaacaacaggtggttacggaccatttctatcatcttgtacttgaacaaacaagatatgctggcagaaaaagtcttggcagggaaatcaaaaattgaagactatttcccagaatatgcaaattatactgttcctgaagacgcaacaccagatgcaggagaagatcccaaagttacaagagccaagttctttatccgggacctgtttttgaggatcagcacggccaccggtgacggcaaacattactgctacccgcacttcacctgcgccgtggacacagagaacatccgcagggtgttcaacgactgccgcgacatcatccagcggatgcacctcaagcagtatgagctcttgtgaggatgctgccgccaccctgcgacggagcggcgccccggactgcctgactgccagccccatgccatggtaggaggcagagtctctagttccatctcgctgccgtctgtcccgttctgtgtcgaccaccaagcctctggctacctctgtcccctcaggtttggttgtgtagcttctgttgtcattgaatacggcctcccgcagcatcccacccccaaaccaccgactctcattgccgacactgcagcagaatctctccgggtgggagccccattattcattctccctttattgattcatcgaggagaacttggtagatggggagaaaacacagttggtttttttttccacgttatcaaccgtgactgcaagagcgttcgtgcagtgccctgagccacggccgtctctgattctccctttatgaagctgcaggctgacgagagatggtcccttcccattggccttagcccaagacttggagtcgaccccaagcgacagagtgaccagaaacccttttacagtcacattcagagtcgctgctggcctcaggcatttgaattagagctactttgagcctcttaggcagaaaacctaccacattcactactgcaaaatgtgtcctgtctaaaaatgattctctaaactttccctatacttaggcatagtcttctttcttagattctctttgttgttgtccctattgctggtttattacactgtacagaccacaaaatgtaatattcttttgtataactactaaagaaaaatccttgtagatctttgtgccttcaccatggctatctatacctgtacatgaaatgtgtttgtattgtgctgaagagcttaatgtcaacattacctgctgcttactctgaaaaaaggaatgaatggtagctgtagaatttaggatattttatcaggttggcactttataaaatactccctgatttaaaaaattgtaagttatacacgttaatcatccacattctatcgacaatgtaccaacatcacaagctgttgcaaccacctgctgttacttctctgagctgtaaaaacctgaactcaattcaggggtacaaattgcaatctaatcttttcagggaaccagggatttttttctctctctctagacaat

SEQ ID NO: 23523 - DNA, 513 bp, Homo sapiens
gacgccctttctacctttctctgtaccctgggtcactccaaaaggaggaagtggactaaggtatgccttttctcccctctctttccagatacttaacaacccatcttcaagcctgcactttcctcgagtgcagcctggatctcttttaatcgtcagaccctgaagtttgctttaggaaagtcccaacttcactcacatatagagtatttaaactctgctggaaggatgttaggttactcttaaatcaaaccctaactgctgctgagaaacagttggccctgtaggcagcaaagaaatttggagatgaactttgtgtctcatacagtgccagggaaggggaagagccttatccaattgggagagtaatagtgcccttaaaggaccctaaatgtgaccataataatagcattggtgagtggagaagaaaactctttcaaatgcgtatattggagaagccacaaaggactatagccaaacctattaactactacaagctttccataatagataata

SEQ ID NO: 23524 - DNA, 815 bp, Homo sapiens
aaactatacgggctaaggtagcgaggccctggcgggtttatgcgtctctgtgcctgacatgacccaaacggccagcaattttctccttctccagttaaacctgtccaacattgaggaacctatctacatgagaactggcaactctaatttaccccgaagcctttctgcaggagattcaaatatttgctaatgcttactgataccttcactggttagatcgaggcattccccaccccatctgaaaaatgtttaccagaagaaataactcctcagtttgggtaatctaaaagcctgcaaagtgacaatggcccatctttcacagcaggcgtaacccaacacctatctcagctttaagaatccaatattaccttcactctgtgtggagactgcagtcctctggaaaggtgaaagggctaatcctactctacagaagactccagctaaatcagacgcctgactatctccaacacccatagcttactgcgggtttgaactgctccaaagtaaaacgtataattaagtcctgttgagttaacatgtggaaggcctttcctaacgacagatctcctaatagatgaaaagactcatcaattacaaaaatatgtcatcaatctgggacaggtgcaaaggcactccgtgcatatggaaacaagagtcttcccctcccacatgggaggaaaattcagtttcagctcagctagggatttagtcttactaaagacgtgggaggaagttctccagctgagcagctttccccaacgtggaagggaccacgcaaggacacctgagttctccaacagacgttcaacgccaag

SEQ ID NO: 23525 - DNA, 795 bp, Homo sapiens
aaaacaggtgactcagccctgtgagctctgtgcctgacatgacccaaacggccagcaattttctccttctccagttaaacctgtccaacattgaggaacctatctacatgagaactggcaactctaatttaccccgaagcctttctgcaggagattcaaatatttgctaatgcttactgataccttcactggttagatcgaggcattccccaccccatctgaaaaatgtttaccagaagaaataactcctcagtttgggtaatctaaaagcctgcaaagtgacaatggcccatctttcacagcaggcgtaacccaacacctatctcagctttaagaatccaatattaccttcactctgtgtggagactgcagtcctctggaaaggtgaaagggctaatcctactctacagaagactccagctaaatcagacgcctgactatctccaacacccatagcttactgcgggtttgaactgctccaaagtaaaacgtataattaagtcctgttgagttaacatgtggaaggcctttcctaacgacagatctcctaatagatgaaaagactcatcaattacaaaaatatgtcatcaatctgggacaggtgcaaaggcactccgtgcatatggaaacaagagtcttcccctcccacatgggaggaaaattcagtttcagctcagctagggatttagtcttactaaagacgtgggaggaagttctccagctgagcagctttccccaacgtggaagggaccacgcaaggacacctgagttctccaacagacgttcaacgccaag

SEQ ID NO: 23526 - DNA, 381 bp, Homo sapiens
aaccttgacaatccataaatagttgaatcttatattcatatgactatgagtggtacacaggtgagtgaaaatagtgtgcaattttataatagttttaccatatcataacctaaatcaagtcactcccaggatgcaatacagaaggctaagttggatggtctcaagtaaaatttggctgctgttagggaattctattggtacccccaaggcttgctggaacctggagaaattagtacagcagtgacctaagcatggagaagtgatccctgcttgttgctggaaacccaggagaagtgctctgaaatgctttcagtaatgtgctttaaaaactggcaagcatgcatgcaaaacatcttctaaagctattaatcagaaagggat

SEQ ID NO: 23527 - DNA, 561 bp, Homo sapiens
gtgacacactcggttggggaaggagaggctggcacactccactagctgcttatctctgccacctccgcctccatttgtccctggcttcctggggcccagagccatctctgccagagcagggaggccgattaagtgacccgcgggctccttctgcctgactcagctcagctccagccctctctggggagaatgagtcattttttcaaccctgaaatgtttctcttcatgtgggaaaggggcgggggtggggagagcccctcctggtcctctccaaacttgttcctcagctctgagggacacttcagccacagacaaagggattctagggcagctctggagagggcagtcagacctgaagtcagtaaaccacagctgtggcagccgttggagtctccctggacagaagcacactgggctgagtgggtggagtgtccctgtcagtcccgcactgatggatggtttctcccttggggatgggcctctgccccctgcttcctctgcccacccagttaagaagctatatgagcccgggtgtggtggtgcacatctgtagtcccagct

SEQ ID NO: 23528 - DNA, 877 bp, Homo sapiens
aaaatatgctaatcaaaaattgatagaattaaagggagaaatagtcaattccatgaaaacacgagactgcaacatgcctctcttagcaattaatagaacaactagacaaagaaatcaataaagtcattgctgtggtttgaatatttgtcccctccaaaattcatgttgaaaattaatccctaatgtgatgattttgggaagcggagcttactgggaggtgtttggattatgggggcaggtacctcacaaattgcttgatgttgctttcgaggtagtgggttcttgctcgtgggagactgggttagttcttatgggaatggattggttttctcaagactggaagttgttataaagccaggacacccctcagattttgtctgtgaatgtgtccacccccgatctgttacgttgtgatgcagcacgaaagccctcaccagaagcccgggaccatgaccctgaacttctcagcttgcagaactatgaactaaataaacctttctataaaaacaataaatgacccagtctcaggtattcccttacagtaacacaaaatgaactaaaacaaacatagaataccagaacaatgctatcaaccaccttgacttgattgatgtttatagaatgttttaaccaacaaatgcagattacatattctcagctgtcaatggtatgttcaccaatataacatgaaggttagctgtgcagtaaaaatttcaataaatttaaaaggattgaaatcacacagagtatgttctctaattataataaaattacatcaaaaatagaaaacaataaaatctataaaaaccctaaaacctataaaaaccctaaatgttgggaaattaatcagctgttttctaagcaatctaaaggtcaa

SEQ ID NO: 23529 - DNA, 437 bp, Homo sapiens
ggcaacagagtgagactctgtattaaaaaaaaaaaaaaaaaaaagggctgggtgcagtggctcacacctgttatcccagcactttgggaggctgaggcgggcaaatcacgaggtcaggagttcaagaccagcttggccaacacagtgataccccatctctactaaaaatacaaaaattatctgggcatggtgacgtgcacctgtaatcccacctccccagcctcagtgctgggattataggcatgagccactgtagctgacctattgctgctttatacctagagaaattaagacagcacacagctaggtaagaggtggtgtcaaagtgacagaggtattgtcaagatgaaatatatgtgaaatacttggccttggtgccctggcagatggaagcactcgctaaagatatctaagacgtgttttcattcattgtggca

SEQ ID NO: 23530 - DNA, 236 bp, Homo sapiens
ggtgaggtaggaattaaaatccctcaggaaagaacacctcacttggaagactgactgtttttaccctttggcccaattacgagccagatttgaatttctgtttgattgtgggtgataatctctttgaccaggcacatttccacattgcctttccccttgtttaactagaatgtctctagggaatgctaacaaattgttaaaaatcaaatcaaaattaaaatgaaagaaatatcaaa

SEQ ID NO: 23531 - DNA, 527 bp, Homo sapiens
  misc_feature (352)..(352): n is a, c, g, or t
  misc_feature (393)..(393): n is a, c, g, or t
  misc_feature (425)..(425): n is a, c, g, or t
  misc_feature (439)..(439): n is a, c, g, or t
  misc_feature (473)..(473): n is a, c, g, or t
  misc_feature (493)..(493): n is a, c, g, or t
  misc_feature (512)..(512): n is a, c, g, or t
  misc_feature (522)..(522): n is a, c, g, or t
caatttgctaaggaaattcagtgatattagagctaggttattaaagattatattaaataatttaactgtattttgaaaatgattatgctgtgcatttccttctctgtataaaaagtgctgggattgcaggcatgagcactgcacccaacccctggaaaactaaatttttaagtgcttatttttatagaagtttgaaaatttaatgcaggcaggtgtgtaataaattatttttgaattgaacattaaaattctgcttcttaaagtcagcactcaacttggacatgttgaaattagaatctattcttgtatttgatagacaaaatatgtgggaaagattttttgcatgactttnctctcattttattcttccataatgtatttctactataaaanagaatccaacttggggttatatttgtccattnactttgttctgttnaggatttcgtccagttgtttttgggaaaaattcnaggaaatcagggatggacanatgcagcctttcccggggntgccgggacnggggg

SEQ ID NO: 23532 - DNA, 318 bp, Homo sapiens
tcccaaaataggaggcggttattttatatggacattagggaaagacccacaggctgataaggtcatatttgagctaatagaattgagggaatgagttctgtagttatctagagtaagagaattcctagaaaagaaatcaaagaaagccttttgagccattctaaggctttggtttttatttagagtgagatgggacaccattttggggttctgaacagagtgatggcctagatgccgagtgctttaagaaagagggagtgctaactcattttatgaggccagcatcatcctgataccaaagcctggcagacatacaac

SEQ ID NO: 23533 - DNA, 284 bp, Homo sapiens
atcgcgccactgcactccagcctgggcgacagagcaagactccgtctcggaggggcgggggtcggaaagagctctctctgtcaagggagagaacagctcagctcaaacatcacggtgctgaagggcaacctggtaaacacagaaatactcaaccaccagcatttactgaatacttgacgcaacaaaggtgtagtatgttgagtaagatgttgcaggctagactgtaaacaccactaagagccttcttttgctgggaaaatctgttctgaatccaaacaacttac

SEQ ID NO: 23534 - DNA, 335 bp, Homo sapiens
aattataatccaagtatttttagaatcatatactgtcttaaaatacatcagtgataatgttaacacttcttcctacctgcataaactgatgatcacaatgaaaaaatagattaatgtctttttttaatgctgaactcaagttctctttgttaagtatacttgcacatttttatcttggtatattgaactctcttggtcttatacagaccattccaagtggtctgacatacatacgcctgataaaatagggacattgccaaggattatttctactttctttccaaccaaaggaatgtgaccgccccacacatacacaccatggaatactatgcagg

SEQ ID NO: 23535 - DNA, 494 bp, Homo sapiens
aaattatgatgataaagacttaccatattggtattaagagtctctgcttctagaactggttatttgcaggaaaatacatgttattcaattagatgaagtgttttatataaactcttcatggacaactcataaatcacataaaaatccctttgcaatacaaatcttgagaacataaatttaaatttctacatttccacaatttatatttttaaatcagatacaatgttgcccaggctgttctcaaactcctgtgttcaagcaatcttactgtctcaaactcccaagtagcagggactacaggtgtacaccaccaaactcagctatttttctacaatttttaatacttttttagtctcactacagaaccaataatataagtagagaaacaatctctcctaaaaactatatgacacccaaatgataagtctttatcatcataattttgtcattgtagtttatttaaaatatttacttggccaggagtcgacgcggcc

SEQ ID NO: 23536 - DNA, 226 bp, Homo sapiens
tgaaactcttttagggaatagtgtttttaaatataaattttactaagtggaagtatttttaaggaagaccccaattgtggaaaaactgagatgaatcatctttcatcactgattaatatacaatagaagtgcagatgtgacttttgttttaaaatatctgtcttattaaagttatgtaaataatttttatgtgtttctatttcacttattctttaatgattggtat

SEQ ID NO: 23537 - DNA, 576 bp, Homo sapiens
tttggtactgatggaagcaattttggagggtggtggaagctacaatgattctggcaattacaacaatcagtcttcaaattttgaacccatgatgaaaggaaactttggaggcagaagctctggcagctatggtggtggaagccagtactttcccaaaccacaaaaccgaggtggctatggcagttccagtagcagcagtagctacagcagtggcagaagattttaattactgccagcaaacaaagcttaacaggagaggagagccagagaagtgacagcgaagctacaggttacaacagatttgtgaactcagccaagcacagtggtggcaaggcctagctgctacaaagaagacatgttttagacaaatactcatgtgtatgggcaaaaaactcgaggactgtatttgtgactaattgtataacaggttgttttagtttttcttctgtggaaaatgtaaagcattccaacaaaggattttaatgtagatttcttttttgtacccatgctgttgattgctaaatgtaacagtctgatcatgacgctgaataaatgtgtcttaaaaaaaaaaaaaaa

SEQ ID NO: 23538 - DNA, 370 bp, Homo sapiens
agtctctctactccaccaaaactgctcttgcagaagcccccagagtccatgttctcactcccaccctcatcctgcttgacctcactggggcatctggccaagtggtctctcctcccagacatgcccacccctagcttcccagttctcctacctttctgacaactcagcagcctccttcccaggactcccacaatcacctacacgcttatgcctcccaatttagaaaactctgaaccccactccactcataagctccagccccaatctaacccccaaatggatggccagcctgcatgggccagaggtacccaaactcactatctcatctttcatcatctagtggtggcctcccactttccactctcctttc

SEQ ID NO: 23539 - DNA, 346 bp, Homo sapiens
cttcatggaagtggtggggagcctgaacgtgcgctgcggatagggttttacttcctgctacccatcaaccatgggataatgcctgacaaagatgcgaatgaccccggaaatgtgagtgaaggccatgtaattatgtaggctttcactccttctttctcagccgattcagctcttagccagattctcttgttccatcaccaggttttatccctgctaactttctttccccaggaatgattttcattgagatcgtagtgtgtttcctcaaaagaagactagattgtaattgggtgtccttagatgtagaacaactctcctgtttagatttcaacatatatatctttag

SEQ ID NO: 23540 - DNA, 368 bp, Homo sapiens
ccatttttatatcccattaaaataccataaaaggaataagcaagaaaataataaggatacaaggataaataaaactggagaggaaaacagtagtaggtgaagcatggcctcagttggaagagtgatgactgacatagcagaggaagctgaaacctaagagcatacaggatcaataataaggagaggttgatacctcttgctccatcctggaaaatgtcagaaattgaagaagcctgggcaacatagggagactaccatctcttaaaaaaaatttaactgggtgtgggtgtggtggtacctgcctatagttccagctacttgttggggctgggagggagtcatgccattgcagtccagcctctagtctc

SEQ ID NO: 23541 - DNA, 286 bp, Homo sapiens
gagtcttattataaaagttgatcgcaaataaaaacactgtcattgttttaattcactttacaaaaagatgcacccctgcccccaacccaagtaagtctagcttcaccatgattttaggaaagctgatataaaacagcaaggcgtggtggctcatgcctgtaatcccagcactttgggaggccggcgtgggcagatcacaaggtcaggagtttgagaccagcctggcctacatggtgaaaccctgtccctattaaaaaaaaataaatatatacaaaaattagccagc

SEQ ID NO: 23542 - DNA, 423 bp, Homo sapiens
cttccccttctctgcctcaagagtttcctgtgacttctctgttggactttaatgttctcttcctagataccctattcaaggtatgattacctatttgcaattttggctcactctggagagggtgggtgtctgatatctctatagtctgccatcttgtttaattctttatgataagttaaaaaattaattcatcatcataagaggatgatagagagccagtttgtcatcttaaaaaataggccaatagctaggcataatgatgcatacctgatgtcttagttacttagaaggctgaggtgggaagatcccttgaggccagcctgggcaacatagaaagatcatgcctgttaacaaaaacaaaaattgaataggaagaaaaatcatttatcttgccttcgttatatgaactctgtcactggataa

SEQ ID NO: 23543 - DNA, 859 bp, Homo sapiens
tcctgtttctgatatagtaactaattcttaactcagagacattggtccattttaatactgaaaaccaattttcattggtacacattacaaaattgctaagaacactgtttgggagctttcattctcatattttggacattgttttaattgagtgaaataatcataactccttgctcccagagaagctatcacctccatttctaaaaccatttcaggtttgtttggtagtctttcttaatgtatttattatcgctttttgtgagtagggtcctgttttatccaggaaccaatttctgccctagcctatcatgccctgcttttgagagtaccaggtatctttgggattgggaagctggctgtttcagaagtatatgtctcatagtgtgcagaacttggtgaccaagtgagaagcgggaccaatgggagactcacaatggactgagtcttgggattatcttttccaaattcttccatgttagaatcacttcagaaaataagactttgatgctttgtctctgagcatcatttttctcctcataaaaacacttccttattgtatgtagcctgcctcctacagaggcctggtaggtgttactgcattctaaaagaaaaatgtcatctctgtaggagcgactatcaggcctagtgtgaaatattagggatcctaggcagaagagctattagtcctggccttcatatcttcaccaaatgaaaatactgtatataaaatttcaccaccaaacttaactaaattctttttctcaagtcaagcctcccaaagaaaaaagaaattaacttcctacagtgtcagcaagcaattttccatttagttttggtacaaataaaagtcatttgaaac

SEQ ID NO: 23544 - DNA, 2666 bp, Homo sapiens
ggcacgagggtgaggagggctgtgtttgcttccccttctgcgatgattctaagttttctgaggcctccccagccatgctgaactagcattggctgtgatgactacttaggctccgacaaagtcgtggacaaatgtggggtgtgtggaggagacaacacgggctgtcaggttgtgtcgggcgtgtttaagcatgccctcaccagcctgggctaccaccgcgtcgtggagattcccgagggagccacgaaaatcaacatcacggagatgtacaagagcaacaactatttggccctgagaagtcgttctggacgctccatcatcaatgggaactgggcaattgatcgaccaggaaaatacgagggcggagggaccatgttcacctacaagcgtccaaatgagatttcgagcactgccggagagtcctttttggcggaaggtcccaccaacgagatcttggatgtctacatgatacaccagcagccaaacccaggcgtgcactacgagtacgtgatcatggggaccaacgccatcagcccccaggtgccaccccacaggagaccaggggaacccttcaatggccagatggtgacagaaggcaggagccaggaggagggagaacagaaagggaggaacgaggagaaggaagacttgcgtggggaggcccctgagatgttcacctcagaatcggcacagaccttcccagtcaggcatccagacagattttctccccatcgaccggacaacttggtgccaccagcaccgcagcccccacggcgcagccgggatcacaactggaagcagcttgggacaacagaatgttccacgacctgtgggaaaggatcgcagtaccctattttccgctgtgtgcacagaagcactcatgaagaggctcctgagagttactgtgactccagcatgaagccgacccccgaggaggagccctgcaacatcttcccttgcccagccttctgggacatcggggagtggtctgagtgcagcaagacctgtggcctgggcatgcagcaccgccaggttctgtgccgccaggtgtacgccaaccgcagcctgacggtgcagccctaccgctgccagcacctggagaaacctgagaccaccagcacctgccaactcaagatctgcagcgagtggcagatccggaccgactggacctcgtgctcggtgccctgcggcgtgggacagaggacccgtgatgtgaagtgtgtgagcaacattggggatgtggttgacgatgaggaatgcaacatgaagctccggccgaatgacattgagaactgcgacatgggaccctgtgccaagagctggttcctcaccgagtggagcgaaaggtgctcagcggagtgtggggccggagtgcggacacgctcggtggtgtgcatgaccaaccatgtcagcagcctgcccctggagggctgtgggaacaaccggccggcagaggccaccccatgtgacaacggaccctgcacgggcaaggtggagtggtttgccgggagctggagtcagtgttccatcgagtgtgggagcgggacgcaacagagggaggtgatttgtgttagaaagaatgcagacacctttgaagtgttggacccctctgaatgttctttcctggagaaaccccccagccagcaatcctgccacctcaagccttgcggagccaaatggtttagcaccgaatggagcatgagtctacaaagagccatgctcaccaggccaagttgaaggagacaaacttcaaaaacaccccaaatgtccgtcagcaggtgaacggacaaaccatggtgcatccacacagcggaacaaaaaactcagccacaaaaatatggatgaacttccggtgcgttttgctaagtaaaaaaaaaagccaggttcaaaaaactacgtgttgtatgagtccatctatataatattctgtaaaaggagcagctacaaacgccaaatcagtgcctgctggaggatggggtgaccacatctgtgcaatctgaccgtagaggggcagcatgggaattttttgtctgcaatgaaaatatttcgtgtcttgtttgcggtaggagatacacaactgtatgaatttgtcaaaactgatagatgtgtataccacaaaaagggacatttttagatgcaaatttagaaaatatgaagtaaatggttactataatagcaaagactgatggaagctagacttctttgaatgtaccttgttttacaaatttgagtttggaactaagtaaatattttagataatcataaaagaaaattaagttttaaaaaagcaatcccccagaactgaaaatacaatgaaacaaattaatgtaaatatgtttctagttggtggcatcagcactattgcaagtgacttgaatacatagtaatttgacattctatccctaaaaaaaattactgcagaagaatgttcacactgtttgcaattatcctatttttggtgatagtgttgtgctggatatgatgattgggcatataatgtgtgagaaggtaaatgagtaattagatgatagtataattctgttagccccaatatccttgagaagtaggatgttcaaacttaggagaaagtagatacagatacaagatagatattgtatggcttaagtccgcaataaaaagcctgttgtcctgaatttgaattggaa

SEQ ID NO: 23545 - DNA, 4133 bp, Homo sapiens
ggcacgagggtgaggagggctgtgtttgcttccccttctgcgatgattctaagttttctgaggcctccccagccatgctgaactagcattggctgtgatgactacttaggctccgacaaagtcgtggacaaatgtggggtgtgtggaggagacaacacgggctgtcaggttgtgtcgggcgtgtttaagcatgccctcaccagcctgggctaccaccgcgtcgtggagattcccgagggagccacgaaaatcaacatcacggagatgtacaagagcaacaactatttggccctgagaagtcgttctggacgctccatcatcaatgggaactgggcaattgatcgaccaggaaaatacgagggcggagggaccatgttcacctacaagcgtccaaatgagatttcgagcactgccggagagtcctttttggcggaaggtcccaccaacgagatcttggatgtctacatgatacaccagcagccaaacccaggcgtgcactacgagtacgtgatcatggggaccaacgccatcagcccccaggtgccaccccacaggagaccaggggaacccttcaatggccagatggtgacagaaggcaggagccaggaggagggagaacagaaagggaggaacgaggagaaggaagacttgcgtggggaggcccctgagatgttcacctcagaatcggcacagaccttcccagtcaggcatccagacagattttctccccatcgaccggacaacttggtgccaccagcaccgcagcccccacggcgcagccgggatcacaactggaagcagcttgggacaacagaatgttccacgacctgtgggaaaggatcgcagtaccctattttccgctgtgtgcacagaagcactcatgaagaggctcctgagagttactgtgactccagcatgaagccgacccccgaggaggagccctgcaacatcttcccttgcccagccttctgggacatcggggagtggtctgagtgcagcaagacctgtggcctgggcatgcagcaccgccaggttctgtgccgccaggtgtacgccaaccgcagcctgacggtgcagccctaccgctgccagcacctggagaaacctgagaccaccagcacctgccaactcaagatctgcagcgagtggcagatccggaccgactggacctcgtgctcggtgccctgcggcgtgggacagaggacccgtgatgtgaagtgtgtgagcaacattggggatgtggttgacgatgaggaatgcaacatgaagctccggccgaatgacattgagaactgcgacatgggaccctgtgccaagagctggttcctcaccgagtggagcgaaaggtgctcagcggagtgtggggccggagtgcggacacgctcggtggtgtgcatgaccaaccatgtcagcagcctgcccctggagggctgtgggaacaaccggccggcagaggccaccccatgtgacaacggaccctgcacgggcaaggtggagtggtttgccgggagctggagtcagtgttccatcgagtgtgggagcgggacgcaacagagggaggtgatttgtgttagaaagaatgcagacacctttgaagtgttggacccctctgaatgttctttcctggagaaaccccccagccagcaatcctgccacctcaagccttgcggagccaaatggtttagcaccgaatggagcatgtgttccaagagctgccagggtggctttcgggtccgggaagtgcggtgtctgtctgatgacatgactctaagtaacctctgtgaccctcagttgaaaccagaagagagagaatcttgtaaccctcaggactgtgtccctgaagttgatgaaaactgcaaggacaagtactacaactgcaacgtggtggtccaggcaagactctgtgtctacaactactacaagaccgcctgctgtgcctcctgcacccgtgtggccaacaggcagacgggcttcctggggagcagataacactcctgcacccccatcagtagggcagcatcactgccttcccgggggcttcagcagtgcgcctggctggctgctgctccaccacgggccccctggcccaggcgctgccaaccaacttagtcaccacccctgcctccggtgaatgcaccccgtggtacccaggggctttttacacaagatgtttgaaagccacagtcagtcctttaagcatcaccatgtactgatgatcccctccttggacctggcatctgctaatggtgccctttgaaagtcaagcagtgggaagtacatggagctctcagccctgctcccatctggcaccttcaagtcagcagatgggccactgactgagcactgccccgtccctggtgctactggtctttctaaacttagcaccctggagagtccaaggaggcagcgcccccaacccagcgccccactaagccttgctgacacgcgtgcatccctctgtgacctcagcccagatgtgcctgttttcattctcaaagacattagactgttttcctgccctatgacacagatagctcacatgaatattgtgctttatttagcaggtgtactcacagatactagctccttagcagctcacaacatcccagaatgggaggcagggggtgactcattatccccattttactgacagggaaactgaggctcaacttaagtaattgacctgccaggtatattcacccatccagtggaagagctgagtccccgccccagtcatctaccagtatccagcctggggcctgtacttagatgtgaaaggtgctgcttcatttctgaccaagagactgagaagtttcccagaatgcaaacaaagcccaggcccctgaaatctttccggtcaagcctttatcccagcactcagttgttttggatgtctgttcctacttgcccttacccccaaagttacagatcctagttacaggactctgccagctttgttaaactgtccgtgagacaagaaagccattggggaaaccaggtgattgcctgaaattcttactccgttccaagtgctgttcctcccaggaaatcaaaggccagggtccttatggccgtggagccttcccgaccacagagccaacttgtgaagcacacagctctgcagcctgggctctgccctgcctcagccgcctcccccacgctcttcaccacgttcctggagagtccggccaacctgtcccagccaaaacactgctgtattagaaaaagtctctttctggtctttctggttttgtttatgaatttccctctgtggccacaaattcctcccctcccccatgactcacagtccatatggcccacccccagacttgagcaccaagctctgcattaatgcagttggcctgcgacaaggagctgtggacccttccccatctcttccaattcactttccccaactatccagttccagaggccgcaggcctggaaggatgcagtgcatattgaaaggtggaccctctgaaaacagttaagaggaatatatgtatgttttgcccattaagaaaaaatggcaagctaaacaaatgttaaacttacagaaaatttgtcttatggtcctgagcatatttcccttttagagcaagcctggattcttagcaaagtgtttcccccatttgctcttttagctgacaaatctgccactgtgatgatggtttgcagcttttggaagcagtatggcaacctggcctgacatgctctttaggcttccactaacctggggctttcagaaattctatttggcctttctgtgggtagctttccagcttctcttctagggagccccaggcatcatttcccaaaagcatccccatctcctgattctcttggaactcctacagataagcatcctggcagaggcccaggctcccaaaccgacaaagtgaaaagagaccagagaggccaagcatattgactggtgctgttcagggcctgctcttttccactcaccacttgttttgctgcttgtcacgaggagagttgttcctgtatgtggctgctctcagatctttccaagcaagccagtcatttgaagaggttttcttttcatgctggagggcaggctaagatcaatgagtggaagagagaaagacaatgcaatcggaatcctctggatc

SEQ ID NO: 23546 - DNA, 4688 bp, Homo sapiens
  misc_feature (12)..(12): n is a, c, g, or t
agttgggacccngcatgtgccgctcccaaaggcatgtgccgcttcccaaacggcatgtgccgctccccgagaagaagccctgcaacatctttcccttgcccagcctttctgggacatcggggagtggtctgagtgcagcaagacctgtggcctgggcatgcagcaccgccaggttctgtgccgccaggtgtacgccaaccgcagcctgacggtgcagccctaccgctgccagcacctggagaaacctgagaccaccagcacctgccaactcaagatctgcagcgagtggcagatccggaccgactggacctcgtgctcggtgccctgcggcgtgggacagaggacccgtgatgtgaagtgtgtgagcaacattggggatgtggttgacgatgaggaatgcaacatgaagctccggccgaatgacattgagaactgcgacatgggaccctgtgccaagagctggttcctcaccgagtggagcgaaaggtgctcagcggagtgtggggccggagtgcggacacgctcggtggtgtgcatgaccaaccatgtcagcagcctgcccctggagggctgtgggaacaaccggccggcagaggccaccccatgtgacaacggaccctgcacgggcaaggtggagtggtttgccgggagctggagtcagtgttccatcgagtgtgggagcgggacgcaacagagggaggtgatttgtgttagaaagaatgcagacacctttgaagtgttggacccctctgaatgttctttcctggagaaaccccccagccagcaatcctgccacctcaagccttgcggagccaaatggtttagcaccgaatggagcatgtgttccaagagctgccagggtggctttcgggtccgggaagtgcggtgtctgtctgatgacatgactctaagtaacctctgtgaccctcagttgaaaccagaagagagagaatcttgtaaccctcaggactgtgtccctgaagttgatgaaaactgcaaggacaagtactacaactgcaacgtggtggtccaggcaagactctgtgtctacaactactacaagaccgcctgctgtgcctcctgcacccgtgtggccaacaggcagacgggcttcctggggagcagataacactcctgcacccccatcagtagggcagcatcactgccttcccgggggcttcagcagtgcgcctggctggctgctgctccaccacgggccccctggcccaggcgctgccaaccaacttagtcaccacccctgcctccggtgaatgcaccccgtggtacccaggggctttttacacaagatgtttgaaagccacagtcagtcctttaagcatcaccatgtactgatgatcccctccttggacctggcatctgctaatggtgccctttgaaagtcaagcagtgggaagtacatggagctctcagccctgctcccatctggcaccttcaagtcagcagatgggccactgactgagcactgccccgtccctggtgctactggtctttctaaacttagcaccctggagagtccaaggaggcagcgcccccaacccagcgccccactaagccttgctgacacgcgtgcatccctctgtgacctcagcccagatgtgcctgttttcattctcaaagacattagactgttttcctgccctatgacacagatagctcacatgaatattgtgctttatttagcaggtgtactcacagatactagctccttagcagctcacaacatcccagaatgggaggcagggggtgactcattatccccattttactgacagggaaactgaggctcaacttaagtaattgacctgccaggtatattcacccatccagtggaagagctgagtccccgccccagtcatctaccagtatccagcctggggcctgtacttagatgtgaaaggtgctgcttcatttctgaccaagagactgagaagtttcccagaatgcaaacaaagcccaggcccctgaaatctttccggtcaagcctttatcccagcactcagttgttttggatgtctgttcctacttgcccttacccccaaagttacagatcctagttacaggactctgccagctttgttaaactgtccgtgagacaagaaagccattggggaaaccaggtgattgcctgaaattcttactccgttccaagtgctgttcctcccaggaaatcaaaggccagggtccttatggccgtggagccttcccgaccacagagccaacttgtgaagcacacagctctgcagcctgggctctgccctgcctcagccgcctcccccacgctcttcaccacgttcctggagagtccggccaacctgtcccagccaaaacactgctgtattagaaaaagtctctttctggtctttctggttttgtttatgaatttccctctgtggccacaaattcctcccctcccccatgactcacagtccatatggcccacccccagacttgagcaccaagctctgcattaatgcagttggcctgcgacaaggagctgtggacccttccccatctcttccaattcactttccccaactatccagttccagaggccgcaggcctggaaggatgcagtgcatattgaaaggtggaccctctgaaaacagttaagaggaatatatgtatgttttgcccattaagaaaaaatggcaagctaaacaaatgttaaacttacagaaaatttgtcttatggtcctgagcatatttcccttttagagcaagcctggattcttagcaaagtgtttcccccatttgctcttttagctgacaaatctgccactgtgatgatggtttgcagcttttggaagcagtatggcaacctggcctgacatgctctttaggcttccactaacctggggctttcagaaattctatttggcctttctgtgggtagctttccagcttctcttctagggagccccaggcatcatttcccaaaagcatccccatctcctgattctcttggaactcctacagataagcatcctggcagaggcccaggctcccaaaccgacaaagtgaaaagagaccagagaggccaagcatattgactggtgctgttcagggcctgctcttttccactcaccacttgttttgctgcttgtcacgaggagagttgttcctgtatgtggctgctctcagatctttccaagcaagccagtcatttgaagaggttttcttttcatgctggagggcaggctaagatcaatgagtggaagagagaaaggctgttttagctcaagttaaaggaacaccttctagccatcaaagccgcccaacagaggcaagggccaccacacatgagagagcgctctgtccttaaagggaattctctgttgagtgggaggtgaacaccctggttcttccaactcaggaattctcgtggctgggctgggtcagtgatggctttgtctctttatgtctaaagtgccctatggctgctgaaggttacctaaccattctttaaaaggagaatgaccctccatgggaatggccagcctgccaactgtgcaattgaagaagacccgatggatcaaccccatgtctcccttggggagaaagtgcataaaccagggtctctttttttttttttcaacaaaccattgagctgttctgggagttcatctctggagaggttatacattattagaagtttgattattattatagtttgatcaatttatttgtcttagagatccaatttttactaattccctagttttttatttcagcatctgaatgtctttctccctagcacagtgcatacaatcagggccttgggtatttccagtgataactttccttggagaggatctaagaaaagcccagatttcggtagccatctccctccaaatatgtctctttctgctttcttagtgcccattatttccccttctcctttcttctgtcactgccatctccttcttggtcttcccattgttctttaactggctgtaatgtggaattgatatttacattttgatacggtttttttcttggcctgtgtacgggattgcctcatttcctgctctgaattttaaaattagatattaaagctgtcatatggtttcctcacaaaagtcaacaaagtccaaacaaaaatagtttgccgttttactttcatccattgaaaaaggaaattgtgcctcttgcagcctaggcaaaggacatttagtactatcgattctttccaccctcacgatgacttgcggttctctctgtagaaaagggatggcctaagaaatacaactaaaaaaacaaacaaaaacaccaaaagaaaaaaaaaagccatttaaagccagccactagagggagtcagttcagttccgtaaaggtatgctcagtgcccgctgcctgcaagctgttggggaccccagggagggcaaggcagcctgtccccgcccccagggaactagaacatgacaagaattctccgcactgtgcctacctgtccctttaccttacctctctggcccagagttcttggagggttttttctttattttcttatgtactcatctacttattctcaaagtatttagcattcaacactctttttgctttaaaaagaatggccttacaaagggacagaaaagagaagacacgagcttggtgtattttcatcaagttatgtggcagagaaatccagatattaccaggacctgtct

SEQ ID NO: 23547 - DNA, 1950 bp, Homo sapiens
ggcacgagggtgaggagggctgtgtttgcttccccttctgcgatgattctaagttttctgaggcctccccagccatgctgaactagcattggctgtgatgactacttaggctccgacaaagtcgtggacaaatgtggggtgtgtggaggagacaacacgggctgtcaggttgtgtcgggcgtgtttaagcatgccctcaccagcctgggctaccaccgcgtcgtggagattcccgagggagccacgaaaatcaacatcacggagatgtacaagagcaacaactatttggccctgagaagtcgttctggacgctccatcatcaatgggaactgggcaattgatcgaccaggaaaatacgagggcggagggaccatgttcacctacaagcgtccaaatgagatttcgagcactgccggagagtcctttttggcggaaggtcccaccaacgagatcttggatgtctacatgatacaccagcagccaaacccaggcgtgcactacgagtacgtgatcatggggaccaacgccatcagcccccaggtgccaccccacaggagaccaggggaacccttcaatggccagatggtgacagaaggcaggagccaggaggagggagaacagaaagggaggaacgaggagaaggaagacttgcgtggggaggcccctgagatgttcacctcagaatcggcacagaccttcccagtcaggcatccagacagattttctccccatcgaccggacaacttggtgccaccagcaccgcagcccccacggcgcagccgggatcacaactggaagcagcttgggacaacagaatgttccacgacctgtgggaaaggatcgcagtaccctattttccgctgtgtgcacagaagcactcatgaagaggctcctgagagttactgtgactccagcatgaagccgacccccgaggaggagccctgcaacatcttcccttgcccagccttctgggacatcggggagtggtctgagtgcagcaagacctgtggcctgggcatgcagcaccgccaggttctgtgccgccaggtgtacgccaaccgcagcctgacggtgcagccctaccgctgccagcacctggagaaacctgagaccaccagcacctgccaactcaagatctgcagcgagtggcagatccggaccgactggacctcgtgctcggtgccctgcggcgtgggacagaggacccgtgatgtgaagtgtgtgagcaacattggggatgtggttgacgatgaggaatgcaacatgaagctccggccgaatgacattgagaactgcgacatgggaccctgtgccaagagctggttcctcaccgagtggagcgaaaggtgctcagcggagtgtggggccggagtgcggacacgctcggtggtgtgcatgaccaaccatgtcagcagcctgcccctggagggctgtgggaacaaccggccggcagaggccaccccatgtgacaacggaccctgcacgggcaaggtggagtggtttgccgggagctggagtcagtgttccatcgagtgtgggagcgggacgcaacagagggaggtgatttgtgttagaaagaatgcagacacctttgaagtgttggacccctctgaatgttctttcctggagaaaccccccagccagcaatcctgccacctcaagccttgcggagccaaatggtttagcaccgaatggagcatggtaagtcatggtgctcttgatggaggttgcattggcacaacgtcccccacctgaactcctatagacccctctgggccaggcactgggttcagccctgaaagagattccctacagcaatctaccttaggtggtagctgctggagtaccccgtgactcagcctgcttcgtggggaaggcctgagacctagatgatcttgctttctaaactgtagaaacagtgactctcacacttcagtgtgcataggaatc

SEQ ID NO: 23548 - DNA, 5548 bp, Homo sapiens
ggcacgagggtgaggagggctgtgtttgcttccccttctgcgatgattctaagttttctgaggcctccccagccatgctgaactagcattggctgtgatgactacttaggctccgacaaagtcgtggacaaatgtggggtgtgtggaggagacaacacgggctgtcaggttgtgtcgggcgtgtttaagcatgccctcaccagcctgggctaccaccgcgtcgtggagattcccgagggagccacgaaaatcaacatcacggagatgtacaagagcaacaactatttggccctgagaagtcgttctggacgctccatcatcaatgggaactgggcaattgatcgaccaggaaaatacgagggcggagggaccatgttcacctacaagcgtccaaatgagatttcgagcactgccggagagtcctttttggcggaaggtcccaccaacgagatcttggatgtctacatgatacaccagcagccaaacccaggcgtgcactacgagtacgtgatcatggggaccaacgccatcagcccccaggtgccaccccacaggagaccaggggaacccttcaatggccagatggtgacagaaggcaggagccaggaggagggagaacagaaagggaggaacgaggagaaggaagacttgcgtggggaggcccctgagatgttcacctcagaatcggcacagaccttcccagtcaggcatccagacagattttctccccatcgaccggacaacttggtgccaccagcaccgcagcccccacggcgcagccgggatcacaactggaagcagcttgggacaacagaatgttccacgacctgtgggaaaggatcgcagtaccctattttccgctgtgtgcacagaagcactcatgaagaggctcctgagagttactgtgactccagcatgaagccgacccccgaggaggagccctgcaacatcttcccttgcccagccttctgggacatcggggagtggtctgagtgcagcaagacctgtggcctgggcatgcagcaccgccaggttctgtgccgccaggtgtacgccaaccgcagcctgacggtgcagccctaccgctgccagcacctggagaaacctgagaccaccagcacctgccaactcaagatctgcagcgagtggcagatccggaccgactggacctcgtgctcggtgccctgcggcgtgggacagaggacccgtgatgtgaagtgtgtgagcaacattggggatgtggttgacgatgaggaatgcaacatgaagctccggccgaatgacattgagaactgcgacatgggaccctgtgccaagagctggttcctcaccgagtggagcgaaaggtgctcagcggagtgtggggccggagtgcggacacgctcggtggtgtgcatgaccaaccatgtcagcagcctgcccctggagggctgtgggaacaaccggccggcagaggccaccccatgtgacaacggaccctgcacgggcaaggtggagtggtttgccgggagctggagtcagtgttccatcgagtgtgggagcgggacgcaacagagggaggtgatttgtgttagaaagaatgcagacacctttgaagtgttggacccctctgaatgttctttcctggagaaaccccccagccagcaatcctgccacctcaagccttgcggagccaaatggtttagcaccgaatggagcatgtgttccaagagctgccagggtggctttcgggtccgggaagtgcggtgtctgtctgatgacatgactctaagtaacctctgtgaccctcagttgaaaccagaagagagagaatcttgtaaccctcaggactgtgtccctgaagttgatgaaaactgcaaggacaagtactacaactgcaacgtggtggtccaggcaagactctgtgtctacaactactacaagaccgcctgctgtgcctcctgcacccgtgtggccaacaggcagacgggcttcctggggagcagataacactcctgcacccccatcagtagggcagcatcactgccttcccgggggcttcagcagtgcgcctggctggctgctgctccaccacgggccccctggcccaggcgctgccaaccaacttagtcaccacccctgcctccggtgaatgcaccccgtggtacccaggggctttttacacaagatgtttgaaagccacagtcagtcctttaagcatcaccatgtactgatgatcccctccttggacctggcatctgctaatggtgccctttgaaagtcaagcagtgggaagtacatggagctctcagccctgctcccatctggcaccttcaagtcagcagatgggccactgactgagcactgccccgtccctggtgctactggtctttctaaacttagcaccctggagagtccaaggaggcagcgcccccaacccagcgccccactaagccttgctgacacgcgtgcatccctctgtgacctcagcccagatgtgcctgttttcattctcaaagacattagactgttttcctgccctatgacacagatagctcacatgaatattgtgctttatttagcaggtgtactcacagatactagctccttagcagctcacaacatcccagaatgggaggcagggggtgactcattatccccattttactgacagggaaactgaggctcaacttaagtaattgacctgccaggtatattcacccatccagtggaagagctgagtccccgccccagtcatctaccagtatccagcctggggcctgtacttagatgtgaaaggtgctgcttcatttctgaccaagagactgagaagtttcccagaatgcaaacaaagcccaggcccctgaaatctttccggtcaagcctttatcccagcactcagttgttttggatgtctgttcctacttgcccttacccccaaagttacagatcctagttacaggactctgccagctttgttaaactgtccgtgagacaagaaagccattggggaaaccaggtgattgcctgaaattcttactccgttccaagtgctgttcctcccaggaaatcaaaggccagggtccttatggccgtggagccttcccgaccacagagccaacttgtgaagcacacagctctgcagcctgggctctgccctgcctcagccgcctcccccacgctcttcaccacgttcctggagagtccggccaacctgtcccagccaaaacactgctgtattagaaaaagtctctttctggtctttctggttttgtttatgaatttccctctgtggccacaaattcctcccctcccccatgactcacagtccatatggcccacccccagacttgagcaccaagctctgcattaatgcagttggcctgcgacaaggagctgtggacccttccccatctcttccaattcactttccccaactatccagttccagaggccgcaggcctggaaggatgcagtgcatattgaaaggtggaccctctgaaaacagttaagaggaatatatgtatgttttgcccattaagaaaaaatggcaagctaaacaaatgttaaacttacagaaaatttgtcttatggtcctgagcatatttcccttttagagcaagcctggattcttagcaaagtgtttcccccatttgctcttttagctgacaaatctgccactgtgatgatggtttgcagcttttggaagcagtatggcaacctggcctgacatgctctttaggcttccactaacctggggctttcagaaattctatttggcctttctgtgggtagctttccagcttctcttctagggagccccaggcatcatttcccaaaagcatccccatctcctgattctcttggaactcctacagataagcatcctggcagaggcccaggctcccaaaccgacaaagtgaaaagagaccagagaggccaagcatattgactggtgctgttcagggcctgctcttttccactcaccacttgttttgctgcttgtcacgaggagagttgttcctgtatgtggctgctctcagatctttccaagcaagccagtcatttgaagaggttttcttttcatgctggagggcaggctaagatcaatgagtggaagagagaaaggctgttttagctcaagttaaaggaacaccttctagccatcaaagccgcccaacagaggcaagggccaccacacatgagagagcgctctgtccttaaagggaattctctgttgagtgggaggtgaacaccctggttcttccaactcaggaattctcgtggctgggctgggtcagtgatggctttgtctctttatgtctaaagtgccctatggctgctgaaggttacctaaccattctttaaaaggagaatgaccctccatgggaatggccagcctgccaactgtgcaattgaagaagacccgatggatcaaccccatgtctcccttggggagaaagtgcataaaccagggtctctttttttttttttcaacaaaccattgagctgttctgggagttcatctctggagaggttatacattattagaagtttgattattattatagtttgatcaatttatttgtcttagagatccaatttttactaattccctagttttttatttcagcatctgaatgtctttctccctagcacagtgcatacaatcagggccttgggtatttccagtgataactttccttggagaggatctaagaaaagcccagatttcggtagccatctccctccaaatatgtctctttctgctttcttagtgcccattatttccccttctcctttcttctgtcactgccatctccttcttggtcttcccattgttctttaactggctgtaatgtggaattgatatttacattttgatacggtttttttcttggcctgtgtacgggattgcctcatttcctgctctgaattttaaaattagatattaaagctgtcatatggtttcctcacaaaagtcaacaaagtccaaacaaaaatagtttgccgttttactttcatccattgaaaaaggaaattgtgcctcttgcagcctaggcaaaggacatttagtactatcgattctttccaccctcacgatgacttgcggttctctctgtagaaaagggatggcctaagaaatacaactaaaaaaacaaacaaaaacaccaaaagaaaaaaaaaagccatttaaagccagccactagagggagtcagttcagttccgtaaaggtatgctcagtgcccgctgcctgcaagctgttggggaccccagggagggcaaggcagcctgtccccgcccccagggaactagaacatgacaagaattctccgcactgtgcctacctgtccctttaccttacctctctggcccagagttcttggagggttttttctttattttcttatgtactcatctacttattctcaaagtatttagcattcaacactctttttgctttaaaaagaatggccttacaaagggacagaaaagagaagacacgagcttggtgtattttcatcaagttatgtggcagagaaatccagatattaccaggacctgtct

SEQ ID NO: 23549 - DNA, 5724 bp, Homo sapiens
acgctcctagacgaaccgtatgttcagtaaagcagtagaatatccgggaggtactgtgtgcatctacaatcagcagccattcatgggccggtttttatgaggtgggaaccatttgcagaattaaaaggcaatctcaaatgtgagtataactgccaggctatgggctaccgcttctatttactgccggctgagacagtcgtctgtattgcaccctctgtgacctgaacgagcctgctctctgtttgtctggactgtgccagagcattggctgtgatgactacttaggctccgacaaagtcgtggacaaatgtggggtgtgtggaggagacaacacgggctgtcaggttgtgtcgggcgtgtttaagcatgccctcaccagcctgggctaccaccgcgtcgtggagattcccgagggagccacgaaaatcaacatcacggagatgtacaagagcaacaactatttggccctgagaagtcgttctggacgctccatcatcaatgggaactgggcaattgatcgaccaggaaaatacgagggcggagggaccatgttcacctacaagcgtccaaatgagatttcgagcactgccggagagtcctttttggcggaaggtcccaccaacgagatcttggatgtctacatgatacaccagcagccaaacccaggcgtgcactacgagtacgtgatcatggggaccaacgccatcagcccccaggtgccaccccacaggagaccaggggaacccttcaatggccagatggtgacagaaggcaggagccaggaggagggagaacagaaagggaggaacgaggagaaggaagacttgcgtggggaggcccctgagatgttcacctcagaatcggcacagaccttcccagtcaggcatccagacagattttctccccatcgaccggacaacttggtgccaccagcaccgcagcccccacggcgcagccgggatcacaactggaagcagcttgggacaacagaatgttccacgacctgtgggaaaggatcgcagtaccctattttccgctgtgtgcacagaagcactcatgaagaggctcctgagagttactgtgactccagcatgaagccgacccccgaggaggagccctgcaacatcttcccttgcccagccttctgggacatcggggagtggtctgagtgcagcaagacctgtggcctgggcatgcagcaccgccaggttctgtgccgccaggtgtacgccaaccgcagcctgacggtgcagccctaccgctgccagcacctggagaaacctgagaccaccagcacctgccaactcaagatctgcagcgagtggcagatccggaccgactggacctcgtgctcggtgccctgcggcgtgggacagaggacccgtgatgtgaagtgtgtgagcaacattggggatgtggttgacgatgaggaatgcaacatgaagctccggccgaatgacattgagaactgcgacatgggaccctgtgccaagagctggttcctcaccgagtggagcgaaaggtgctcagcggagtgtggggccggagtgcggacacgctcggtggtgtgcatgaccaaccatgtcagcagcctgcccctggagggctgtgggaacaaccggccggcagaggccaccccatgtgacaacggaccctgcacgggcaaggtggagtggtttgccgggagctggagtcagtgttccatcgagtgtgggagcgggacgcaacagagggaggtgatttgtgttagaaagaatgcagacacctttgaagtgttggacccctctgaatgttctttcctggagaaaccccccagccagcaatcctgccacctcaagccttgcggagccaaatggtttagcaccgaatggagcatgtgttccaagagctgccagggtggctttcgggtccgggaagtgcggtgtctgtctgatgacatgactctaagtaacctctgtgaccctcagttgaaaccagaagagagagaatcttgtaaccctcaggactgtgtccctgaagttgatgaaaactgcaaggacaagtactacaactgcaacgtggtggtccaggcaagactctgtgtctacaactactacaagaccgcctgctgtgcctcctgcacccgtgtggccaacaggcagacgggcttcctggggagcagataacactcctgcacccccatcagtagggcagcatcactgccttcccgggggcttcagcagtgcgcctggctggctgctgctccaccacgggccccctggcccaggcgctgccaaccaacttagtcaccacccctgcctccggtgaatgcaccccgtggtacccaggggctttttacacaagatgtttgaaagccacagtcagtcctttaagcatcaccatgtactgatgatcccctccttggacctggcatctgctaatggtgccctttgaaagtcaagcagtgggaagtacatggagctctcagccctgctcccatctggcaccttcaagtcagcagatgggccactgactgagcactgccccgtccctggtgctactggtctttctaaacttagcaccctggagagtccaaggaggcagcgcccccaacccagcgccccactaagccttgctgacacgcgtgcatccctctgtgacctcagcccagatgtgcctgttttcattctcaaagacattagactgttttcctgccctatgacacagatagctcacatgaatattgtgctttatttagcaggtgtactcacagatactagctccttagcagctcacaacatcccagaatgggaggcagggggtgactcattatccccattttactgacagggaaactgaggctcaacttaagtaattgacctgccaggtatattcacccatccagtggaagagctgagtccccgccccagtcatctaccagtatccagcctggggcctgtacttagatgtgaaaggtgctgcttcatttctgaccaagagactgagaagtttcccagaatgcaaacaaagcccaggcccctgaaatctttccggtcaagcctttatcccagcactcagttgttttggatgtctgttcctacttgcccttacccccaaagttacagatcctagttacaggactctgccagctttgttaaactgtccgtgagacaagaaagccattggggaaaccaggtgattgcctgaaattcttactccgttccaagtgctgttcctcccaggaaatcaaaggccagggtccttatggccgtggagccttcccgaccacagagccaacttgtgaagcacacagctctgcagcctgggctctgccctgcctcagccgcctcccccacgctcttcaccacgttcctggagagtccggccaacctgtcccagccaaaacactgctgtattagaaaaagtctctttctggtctttctggttttgtttatgaatttccctctgtggccacaaattcctcccctcccccatgactcacagtccatatggcccacccccagacttgagcaccaagctctgcattaatgcagttggcctgcgacaaggagctgtggacccttccccatctcttccaattcactttccccaactatccagttccagaggccgcaggcctggaaggatgcagtgcatattgaaaggtggaccctctgaaaacagttaagaggaatatatgtatgttttgcccattaagaaaaaatggcaagctaaacaaatgttaaacttacagaaaatttgtcttatggtcctgagcatatttcccttttagagcaagcctggattcttagcaaagtgtttcccccatttgctcttttagctgacaaatctgccactgtgatgatggtttgcagcttttggaagcagtatggcaacctggcctgacatgctctttaggcttccactaacctggggctttcagaaattctatttggcctttctgtgggtagctttccagcttctcttctagggagccccaggcatcatttcccaaaagcatccccatctcctgattctcttggaactcctacagataagcatcctggcagaggcccaggctcccaaaccgacaaagtgaaaagagaccagagaggccaagcatattgactggtgctgttcagggcctgctcttttccactcaccacttgttttgctgcttgtcacgaggagagttgttcctgtatgtggctgctctcagatctttccaagcaagccagtcatttgaagaggttttcttttcatgctggagggcaggctaagatcaatgagtggaagagagaaaggctgttttagctcaagttaaaggaacaccttctagccatcaaagccgcccaacagaggcaagggccaccacacatgagagagcgctctgtccttaaagggaattctctgttgagtgggaggtgaacaccctggttcttccaactcaggaattctcgtggctgggctgggtcagtgatggctttgtctctttatgtctaaagtgccctatggctgctgaaggttacctaaccattctttaaaaggagaatgaccctccatgggaatggccagcctgccaactgtgcaattgaagaagacccgatggatcaaccccatgtctcccttggggagaaagtgcataaaccagggtctctttttttttttttcaacaaaccattgagctgttctgggagttcatctctggagaggttatacattattagaagtttgattattattatagtttgatcaatttatttgtcttagagatccaatttttactaattccctagttttttatttcagcatctgaatgtctttctccctagcacagtgcatacaatcagggccttgggtatttccagtgataactttccttggagaggatctaagaaaagcccagatttcggtagccatctccctccaaatatgtctctttctgctttcttagtgcccattatttccccttctcctttcttctgtcactgccatctccttcttggtcttcccattgttctttaactggctgtaatgtggaattgatatttacattttgatacggtttttttcttggcctgtgtacgggattgcctcatttcctgctctgaattttaaaattagatattaaagctgtcatatggtttcctcacaaaagtcaacaaagtccaaacaaaaatagtttgccgttttactttcatccattgaaaaaggaaattgtgcctcttgcagcctaggcaaaggacatttagtactatcgattctttccaccctcacgatgacttgcggttctctctgtagaaaagggatggcctaagaaatacaactaaaaaaacaaacaaaaacaccaaaagaaaaaaaaaagccatttaaagccagccactagagggagtcagttcagttccgtaaaggtatgctcagtgcccgctgcctgcaagctgttggggaccccagggagggcaaggcagcctgtccccgcccccagggaactagaacatgacaagaattctccgcactgtgcctacctgtccctttaccttacctctctggcccagagttcttggagggttttttctttattttcttatgtactcatctacttattctcaaagtatttagcattcaacactctttttgctttaaaaagaatggccttacaaagggacagaaaagagaagacacgagcttggtgtattttcatcaagttatgtggcagagaaatccagatattaccaggacctgtct

SEQ ID NO: 23550 - DNA, 4283 bp, Homo sapiens
  misc_feature (2)..(3): n is a, c, g, or t
  misc_feature (5)..(7): n is a, c, g, or t
  misc_feature (11)..(11): n is a, c, g, or t
  misc_feature (13)..(13): n is a, c, g, or t
  misc_feature (51)..(51): n is a, c, g, or t
  misc_feature (78)..(78): n is a, c, g, or t
cnntnnncctntncatcatttgaaagtggcttcagcagctgccagggcctnctgactaatgtgcccttcccctgtctnacagtgctcagcggagtgtggggccggagtgcggacacgctcggtggtgtgcatgaccaaccatgtcagcagcctgcccctggagggctgtgggaacaaccggccggcagaggccaccccatgtgacaacggaccctgcacgggcaaggtggagtggtttgccgggagctggagtcagtgttccatcgagtgtgggagcgggacgcaacagagggaggtgatttgtgttagaaagaatgcagacacctttgaagtgttggacccctctgaatgttctttcctggagaaaccccccagccagcaatcctgccacctcaagccttgcggagccaaatggtttagcaccgaatggagcatgtgttccaagagctgccagggtggctttcgggtccgggaagtgcggtgtctgtctgatgacatgactctaagtaacctctgtgaccctcagttgaaaccagaagagagagaatcttgtaaccctcaggactgtgtccctgaagttgatgaaaactgcaaggacaagtactacaactgcaacgtggtggtccaggcaagactctgtgtctacaactactacaagaccgcctgctgtgcctcctgcacccgtgtggccaacaggcagacgggcttcctggggagcagataacactcctgcacccccatcagtagggcagcatcactgccttcccgggggcttcagcagtgcgcctggctggctgctgctccaccacgggccccctggcccaggcgctgccaaccaacttagtcaccacccctgcctccggtgaatgcaccccgtggtacccaggggctttttacacaagatgtttgaaagccacagtcagtcctttaagcatcaccatgtactgatgatcccctccttggacctggcatctgctaatggtgccctttgaaagtcaagcagtgggaagtacatggagctctcagccctgctcccatctggcaccttcaagtcagcagatgggccactgactgagcactgccccgtccctggtgctactggtctttctaaacttagcaccctggagagtccaaggaggcagcgcccccaacccagcgccccactaagccttgctgacacgcgtgcatccctctgtgacctcagcccagatgtgcctgttttcattctcaaagacattagactgttttcctgccctatgacacagatagctcacatgaatattgtgctttatttagcaggtgtactcacagatactagctccttagcagctcacaacatcccagaatgggaggcagggggtgactcattatccccattttactgacagggaaactgaggctcaacttaagtaattgacctgccaggtatattcacccatccagtggaagagctgagtccccgccccagtcatctaccagtatccagcctggggcctgtacttagatgtgaaaggtgctgcttcatttctgaccaagagactgagaagtttcccagaatgcaaacaaagcccaggcccctgaaatctttccggtcaagcctttatcccagcactcagttgttttggatgtctgttcctacttgcccttacccccaaagttacagatcctagttacaggactctgccagctttgttaaactgtccgtgagacaagaaagccattggggaaaccaggtgattgcctgaaattcttactccgttccaagtgctgttcctcccaggaaatcaaaggccagggtccttatggccgtggagccttcccgaccacagagccaacttgtgaagcacacagctctgcagcctgggctctgccctgcctcagccgcctcccccacgctcttcaccacgttcctggagagtccggccaacctgtcccagccaaaacactgctgtattagaaaaagtctctttctggtctttctggttttgtttatgaatttccctctgtggccacaaattcctcccctcccccatgactcacagtccatatggcccacccccagacttgagcaccaagctctgcattaatgcagttggcctgcgacaaggagctgtggacccttccccatctcttccaattcactttccccaactatccagttccagaggccgcaggcctggaaggatgcagtgcatattgaaaggtggaccctctgaaaacagttaagaggaatatatgtatgttttgcccattaagaaaaaatggcaagctaaacaaatgttaaacttacagaaaatttgtcttatggtcctgagcatatttcccttttagagcaagcctggattcttagcaaagtgtttcccccatttgctcttttagctgacaaatctgccactgtgatgatggtttgcagcttttggaagcagtatggcaacctggcctgacatgctctttaggcttccactaacctggggctttcagaaattctatttggcctttctgtgggtagctttccagcttctcttctagggagccccaggcatcatttcccaaaagcatccccatctcctgattctcttggaactcctacagataagcatcctggcagaggcccaggctcccaaaccgacaaagtgaaaagagaccagagaggccaagcatattgactggtgctgttcagggcctgctcttttccactcaccacttgttttgctgcttgtcacgaggagagttgttcctgtatgtggctgctctcagatctttccaagcaagccagtcatttgaagaggttttcttttcatgctggagggcaggctaagatcaatgagtggaagagagaaaggctgttttagctcaagttaaaggaacaccttctagccatcaaagccgcccaacagaggcaagggccaccacacatgagagagcgctctgtccttaaagggaattctctgttgagtgggaggtgaacaccctggttcttccaactcaggaattctcgtggctgggctgggtcagtgatggctttgtctctttatgtctaaagtgccctatggctgctgaaggttacctaaccattctttaaaaggagaatgaccctccatgggaatggccagcctgccaactgtgcaattgaagaagacccgatggatcaaccccatgtctcccttggggagaaagtgcataaaccagggtctctttttttttttttcaacaaaccattgagctgttctgggagttcatctctggagaggttatacattattagaagtttgattattattatagtttgatcaatttatttgtcttagagatccaatttttactaattccctagttttttatttcagcatctgaatgtctttctccctagcacagtgcatacaatcagggccttgggtatttccagtgataactttccttggagaggatctaagaaaagcccagatttcggtagccatctccctccaaatatgtctctttctgctttcttagtgcccattatttccccttctcctttcttctgtcactgccatctccttcttggtcttcccattgttctttaactggctgtaatgtggaattgatatttacattttgatacggtttttttcttggcctgtgtacgggattgcctcatttcctgctctgaattttaaaattagatattaaagctgtcatatggtttcctcacaaaagtcaacaaagtccaaacaaaaatagtttgccgttttactttcatccattgaaaaaggaaattgtgcctcttgcagcctaggcaaaggacatttagtactatcgattctttccaccctcacgatgacttgcggttctctctgtagaaaagggatggcctaagaaatacaactaaaaaaacaaacaaaaacaccaaaagaaaaaaaaaagccatttaaagccagccactagagggagtcagttcagttccgtaaaggtatgctcagtgcccgctgcctgcaagctgttggggaccccagggagggcaaggcagcctgtccccgcccccagggaactagaacatgacaagaattctccgcactgtgcctacctgtccctttaccttacctctctggcccagagttcttggagggttttttctttattttcttatgtactcatctacttattctcaaagtatttagcattcaacactctttttgctttaaaaagaatggccttacaaagggacagaaaagagaagacacgagcttggtgtattttcatcaagttatgtggcagagaaatccagatattaccaggacctgtct

SEQ ID NO: 23551 - DNA, 337 bp, Homo sapiens
cacaaagctgtgaatatactaaaagccactgaattattcagtgggtgaattttgtgatatgaacattgcatctctggcctggtgcagtggctcacttctgtaatcctagcacagtgggaggccgaggtgggtggatcacctgaggtcaggagtttgagactggcctggccagcgtgatgaaaccccgtctctactaaaaatacaaaaattagccaggtgtggtggtgcatgcctgtagtctcagttactcgggaggctgatgcaggagaatcacttgaacccaggaggcataggttgcagtgagccgagattgtgccactgcacgccctctcgagcc

SEQ ID NO: 23552 - DNA, 1869 bp, Homo sapiens
agcggaagcgcgcttgtgtcttgtgagaagagccgcgcttgcagcgtctgggagaatctttcggtctccgcgagaggtgcttcattccacgaaaaaagtataattcaagctcagatttgtgttgaaaccagcctcaagtttcacctatcctcactgatccgtggacttctgtatgatcagggtgctgtcctgagagcgctgcgggataaaggaggagcgtcctgcttcccggctgccctgttgctgtcggagtcacaggatggcggctgtcgtcctgcccccaactgccgctctgtcttccctgttcccagcctctcagcgagaaggacacacagagggcggagagctggttaatgagctcctgaaaagctggctaaagggcttggtgacctttgaggatgtggccgtggagttcacccaggaggagtgggcattgctggaccctgcccaaaggacactgtacagggacgtgatgctggagaactgcaggaacctggcctcactggggaaccaagttgataaacctaggctgatctcccagctggagcaagaagataaagtgatgacagaagagagaggaattctctcaggtacctgtccagatgtggagaatccatttaaagccaaagggttaactcctaagctgcatgtttttcgaaaagaacaatctagaaatatgaaaatggagaggaatcatcttggagcaacactcaacgaatgtaatcagtgttttaaagtcttcagcacaaaatcttcccttacacggcacaggaagattcatactggagaaagaccctatggctgcagtgaatgtgggaaatcctacagcagtagatcttaccttgctgttcataagagaatccacaatggggagaaaccctatgaatgcaatgactgtgggaaaaccttcagcagcagatcttaccttactgttcataagagaatccacaatggggagaaaccctacgaatgcagtgactgtgggaaaaccttcagcaattcctcatacctcagaccgcacttgagaattcacactggagaaaaaccgtacaaatgtaaccagtgttttcgtgagttccgcactcagtcaatcttcacaaggcacaagagagttcatacgggggagggtcattatgtatgtaatcagtgtggaaaggctttcggcacgaggtcatctctttcttcgcactatagcattcatacaggggagtacccttacgaatgccacgattgtgggagaaccttcaggaggaggtcgaatctgacacagcacataagaactcatactggagaaaaaccctacacatgtaatgagtgtgggaaatcctttaccaatagcttttctcttacaattcacaggagaatacataatggagagaaatcctatgagtgcagtgattgtggaaaatcctttaatgttctctcatccgttaagaaacacatgagaactcacactggaaaaaaaccctatgaatgtaattattgcgggaaatccttcacaagtaactcctacctttctgtgcatacgagaatgcataataggcaaatgtgaattcaataactgtgggaaaagcattcattgatctttcatgcctcagataacatgagcaaactctaacaagatgtatgaatcacctgctactgtgtaacaaattaccccccaaaattttgtggcttcaaacaaaaacacttgttatctcaaaatttttgtaggtcaggaattcagaaacaacatagctctatagttcttcaggatatctcaagaggttacagtccagatgtcagcagaactgtaatcatccagaattgttactggtgaagggaccacttccaaatggcttacaagcccgacaagtgcatgctagctgt

SEQ ID NO: 23553 - DNA, 1075 bp, Homo sapiens
agcggaagcgcgcttgtgtcttgtgagaagagccgcgcttgcagcgtctgggagaatctttcggtctccgcgagaggtgcttcattccacgaaaaaagtataattcaagctcagatttgtgttgaaaccagcctcaagtttcacctatcctcactgatccgtggacttctgtatgatcagggtgctgtcctgagagcgctgcgggataaaggaggagcgtcctgcttcccggctgccctgttgctgtcggagtcacaggatggcggctgtcgtcctgcccccaactgccgctctgtcttccctgttcccagcctctcagcgagaaggacacacagagggcggagagctggttaatgagctcctgaaaagctggctaaagggcttggtgacctttgaggatgtggccgtggagttcacccaggaggagtgggcattgctggaccctgcccaaaggacactgtacagggacgtgatgctggagaactgcaggaacctggcctcactggggaaccaagttgataaacctaggctgatctcccagctggagcaagaagataaagtgatgacagaagagagaggaattctctcaggtacctgtccagatgtggagaatccatttaaagccaaagggttaactcctaagctgcatgtttttcgaaaagaacaatctagaaatatgaaaatggagaggaatcatcttggagcaacactcaacgaatgtaatcagtgttttaaagtcttcagcacaaaatcttcccttacacggcacaggaagattcatactggagaaagaccctatggctgcagtgaatgtgggaaatcctacagcagtagatcttaccttgctgttcataagagaatccacaatggggagaaaccctatgaatgcaatgactgtgggaaaaccttcagcagcagatcttaccttactgttcataagagaatccacaatggggagaaaccctacgaatgcagtgactgtgggaaaaccttcagcaattcctcatacctcagaccgcacttgagaattcacactggttacatttgtacggtttttctccagtgtgaattctca

SEQ ID NO: 23554 - DNA, 372 bp, Homo sapiens
aacattgcctaaaattttcacacccatatctctttcaccgaatgccttctcaaaaaccctcacctctcagattctgccttcactcacgtatgcattttactatttcaccatcaacttaaaatttgcctcttttctatcaacttaaatttctttttaacttgtttcagatgtggagaatccatttaaagccaaagggttaactcctaagctgcatgtttttcgaaaagaacaatctagaaatatgaaaatggtaagactaacatgggtgattcctggtttttttcatggtagaatgccctacatgagaaaagccacaaggactggccttgttggccaggcacagtggctcatgcctttaatcccagcaccttg

SEQ ID NO: 23555 - DNA, 1385 bp, Homo sapiens
agcggaagcgcgcttgtgtcttgtgagaagagccgcgcttgcagcgtctgggagaatctttcggtctccgcgagaggtgcttcattccacgaaaaaagtataattcaagctcagatttgtgttgaaaccagcctcaagtttcacctatcctcactgatccgtggacttctgtatgatcagggtgctgtcctgagagcgctgcgggataaaggaggagcgtcctgcttcccggctgccctgttgctgtcggagtcacaggatggcggctgtcgtcctgcccccaactgccgctctgtcttccctgttcccagcctctcagcgagaaggacacacagagggcggagagctggttaatgagctcctgaaaagctggctaaagggcttggtgacctttgaggatgtggccgtggagttcacccaggaggagtgggcattgctggaccctgcccaaaggacactgtacagggacgtgatgctggagaactgcaggaacctggcctcactggggaaccaagttgataaacctaggctgatctcccagctggagcaagaagataaagtgatgacagaagagagaggaattctctcaggtacctgtccagatgtggagaatccatttaaagccaaagggttaactcctaagctgcatgtttttcgaaaagaacaatctagaaatatgaaaatggagaggaatcatcttggagcaacactcaacgaatgtaatcagtgttttaaagtcttcagcacaaaatcttcccttacacggcacaggaagattcatactggagaaagaccctatggctgcagtgaatgtgggaaatcctacagcagtagatcttaccttgctgttcataagagaatccacaatggggagaaaccctatgaatgcaatgactgtgggaaaaccttcagcagcagatcttaccttactgttcataagagaatccacaatggggagaaaccctacgaatgcagtgactgtgggaaaaccttcagcaattcctcatacctcagaccgcacttgagaattcacactggagaaaaaccgtacaaatgtaaccagtgttttcgtgagttccgcactcagtcaatcttcacaaggcacaagagagttcatacgggggagggtcattatgtatgtaatcagtgtggaaaggctttcggcacgaggtcatctctttcttcgcactatagcattcatacaggggagtacccttacgaatgccacgattgtgggagaaccttcaggaggaggtcgaatctgacacagcacataagaactcatactggagaaaaaccctacacatgtaatgagtgtgggaaatcctttaccaatagcttttctcttacaattcacaggagaatacataatggagagaaatcct

SEQ ID NO: 23556 - DNA, 1848 bp, Homo sapiens
agcggaagcgcgcttgtgtcttgtgagaagagccgcgcttgcagcgtctgggagaatctttcggtctccgcgagaggtgcttcattccacgaaaaaagtataattcaagctcagatttgtgttgaaaccagcctcaagtttcacctatcctcactgatccgtggacttctgtatgatcagggtgctgtcctgagagcgctgcgggataaaggaggagcgtcctgcttcccggctgccctgttgctgtcggagtcacaggatggcggctgtcgtcctgcccccaactgccgcctctcagcgagaaggacacacagagggcggagagctggttaatgagctcctgaaaagctggctaaagggcttggtgacctttgaggatgtggccgtggagttcacccaggaggagtgggcattgctggaccctgcccaaaggacactgtacagggacgtgatgctggagaactgcaggaacctggcctcactggggaaccaagttgataaacctaggctgatctcccagctggagcaagaagataaagtgatgacagaagagagaggaattctctcaggtacctgtccagatgtggagaatccatttaaagccaaagggttaactcctaagctgcatgtttttcgaaaagaacaatctagaaatatgaaaatggagaggaatcatcttggagcaacactcaacgaatgtaatcagtgttttaaagtcttcagcacaaaatcttcccttacacggcacaggaagattcatactggagaaagaccctatggctgcagtgaatgtgggaaatcctacagcagtagatcttaccttgctgttcataagagaatccacaatggggagaaaccctatgaatgcaatgactgtgggaaaaccttcagcagcagatcttaccttactgttcataagagaatccacaatggggagaaaccctacgaatgcagtgactgtgggaaaaccttcagcaattcctcatacctcagaccgcacttgagaattcacactggagaaaaaccgtacaaatgtaaccagtgttttcgtgagttccgcactcagtcaatcttcacaaggcacaagagagttcatacgggggagggtcattatgtatgtaatcagtgtggaaaggctttcggcacgaggtcatctctttcttcgcactatagcattcatacaggggagtacccttacgaatgccacgattgtgggagaaccttcaggaggaggtcgaatctgacacagcacataagaactcatactggagaaaaaccctacacatgtaatgagtgtgggaaatcctttaccaatagcttttctcttacaattcacaggagaatacataatggagagaaatcctatgagtgcagtgattgtggaaaatcctttaatgttctctcatccgttaagaaacacatgagaactcacactggaaaaaaaccctatgaatgtaattattgcgggaaatccttcacaagtaactcctacctttctgtgcatacgagaatgcataataggcaaatgtgaattcaataactgtgggaaaagcattcattgatctttcatgcctcagataacatgagcaaactctaacaagatgtatgaatcacctgctactgtgtaacaaattaccccccaaaattttgtggcttcaaacaaaaacacttgttatctcaaaatttttgtaggtcaggaattcagaaacaacatagctctatagttcttcaggatatctcaagaggttacagtccagatgtcagcagaactgtaatcatccagaattgttactggtgaagggaccacttccaaatggcttacaagcccgacaagtgcatgctagctgt

SEQ ID NO: 23557 - DNA, 456 bp, Homo sapiens
aataattattttaaaattggtttcatagttcaatgtcatggcattatttcctaaactatttataatatttatatattattctacctggaaaaatagcgttcacattgtgactagagagtggttagcagcatattttagaaattgagaccttgtatgaagaaggaagcaacagttttatgatcacttatatttacatggagcttatatgaggaggtatgtaaatgtcctattgatcttttttgtcctacttttcctccatcagattgtgttcagctaagtaaggattagtagctatgcattggcaagttacaagctttcaagcaaactcatgggaatgcttgaccatatcactgaaaaggcttcatttccctcaaggataatggattgcatagatttatttaatgtaacaacatatttcattgaaagaaactaatttagtgactttaaaataaaata

SEQ ID NO: 23558 - DNA, 500 bp, Homo sapiens
gtctaccttaggtagaacatgaaacattatatgtttagatattttcagctatgcaaaggatcctattccaaaagaagaatacaacaattagaaagtcatatcccctttcttggaactaaaagcactttgaataatgtttgaaatttgtaattttcagtcatacctgaattttatttatattttttcatagttgcattctatttttgcctgtcacatccaaaataaagaaatgtttactacttctgtttgtcttattactctaagatatgtagtgttttattgactcacattcttttacatttagatttaacatctttaaatgtggatgcaaattaaaactgctggcaggctgggtgccatggctcacacccgcaatttcagcaccatgggaggccgagatggaggattgcttgagcccaagaggttaaggatgcagtgaactgtgattgtgccactgcattccagcctgggcaacaaagtgtcccccgtctaaaaaaagt

SEQ ID NO: 23559 - DNA, 1051 bp, Homo sapiens
gaacgcttcaacaagcttgtggtccggatgacgaagtctctggctgaacttcaaagggccttggctggagaagttggaatgagcaatgagttagatgatgtggccaggtctctttttatcgggcatatccctaatatctggagaaggcttgctcctgacaccttaaagtcccttggaaactggatggtctacttcctgcggcggttcagccagtacatgttgtggctcttgttggatggttcttggaaaggctgaaaccacagtctatgagagtgcttctttcctcactccgctgcaatgctgcgttcttaacattttggatcactgtctccctgataggtgaccgagagcgagcccagcgtgatgtggctctcggggctgcacatccctgagtcctacctcacggcgctggtgcaggccacctgccggaagaacggctggccactggaccgctccaccttgttcacacaagtgaccaagttccaggatgcagatgaagtgaatgagcgggcgggacaaggatgctttgtctcaggactgtacctggaaggtgctgactgggatatagaaaaaggatgtcttatcaagagcaaacccaaggtgctggttgtggacctgccgatcctgaagatcatccccattgaagcccatcgcctcaagctgcagaatactttccggacccccgtctacaccacctccatgagaaggaacgccatgggagtcggcttggtttttgaagctgatctctttaccacgaggcacatttctcactgggtgctgcaaggagtatgcctcaccctgaattctgattaacctttgggtgaagaaaactgcttaatgaattcggagcctggggttgtcagagtgatcgggtctgctgtcatttcttggggcctctcaagaggcaggagggggactgacactgatttttcatttgaaatcagccacttaaatctctttccatacaaattaacctgaatggttttgtttttaatactactttttaaaaggaatttatataatcaaaaagtaaatattggagagtatttta

SEQ ID NO: 23560 - DNA, 1469 bp, Homo sapiens
gaacgcttcaacaagcttgtggtccggatgacgaagtctctggctgaacttcaaagggccttggctggagaagttggaatgagcaatgagttagatgatgtggccaggtctctttttatcgggcatatccctaatatctggagaaggcttgctcctgacaccttaaagtcccttggaaactggatggtctacttcctgcggcggttcagccagtacatgttgtggctcttgttggatggttcttggaaaggctgaaaccacagtctatgagagtgcttctttcctcactccgctgcaatgctgcgttcttaacattttggatcactgtctccctgataggtgaccgagagcgagcccagcgtgatgtggctctcggggctgcacatccctgagtcctacctcacggcgctggtgcaggccacctgccggaagaacggctggccactggaccgctccaccttgttcacacaagtgaccaagttccaggatgcagatgaagtgaatgagcgggcgggacaaggatgctttgtctcaggactgtacctggaaggtgctgactgggatatagaaaaaggatgtcttatcaagagcaaacccaaggtgctggttgtggacctgccgatcctgaagatcatccccattgaagcccatcgcctcaagctgcagaatactttccggacccccgtctacaccacctccatgagaaggaacgccatgggagtcggcttggtttttgaagctgatctctttaccacgaggcacatttctcactgggtgctgcaaggagtatgcctcaccctgaattctgattaacctttgggtgaagaaaactgcttaatgaattcggagcctggggttgtcagagtgatcgggtctgctgtcatttcttggggcctctcaagaggcaggagggggactgacactgatttttcatttgaaatcagccacttaaatctctttccatacaaattaacctgaatggttttgtttttaatactactttttaaaaggaatttatataatcaaaaagtaaatattggagagtattttaagatgtgtggagttttcttttccttctcagagaaaacacttgattaggcaaaagtgcctggcatacatagcattggcacaagtgagaatcctaatgtaatttccaaaggtgtgttttcgatgatccaggtctgtttcagcagatgctcctttttggcaagaagggctgatgatgtcgggcacagagcagaagtgaccagtcacctggagccacttctcccccttccagaactctctggccctagcttctttggctctgacctgctacggcgactgtgaagttgttgagcttagtgtttagttcctgcatgagcttctacccccagcctgcctgggtctgtgtggggtcaggtaaggacacagaacctccaggaccagtggtcactgggcaccccttccctctgtgcaccatgaggctg

SEQ ID NO: 23561 - DNA, 400 bp, Homo sapiens
gtgggcccctaaaatgggcccaggcccatgtttgaaaagcccagcctgcctgcaaaatatttccctgtgtcctctgcactgccccatgtcttaacacctctgagggtggatacggaagtttctcttcccactttctccgttgaagacctggggtctatggcaggggagacctgaaccatgttcactctgctagctcatggcaagtgggctcctaggtcagaattagctcttgcaaaaaccatcaggtggctttcttgtaaactgacggggccaggggcatgggagccacagagcagcatggactaacttggttggaactctttgattatgccagaacttgaggtcccttagacattggttactgactgtgcaaatgagagctggaaactgctgtttcccc

SEQ ID NO: 23562 - DNA, 407 bp, Homo sapiens
ttttttttgctaatacaaataacattctggtgcacatgtatatgaatatgcataggggtatattccatgggtaaattctgacagtggaagagttggatcaaagagcttgtgcattttaaattttgatagctcttgttggatggttcttggaaaggctgaaaccacagtctatgagagtgcttctttcctcactccgctgcaatgctgcgttcttaacattttggatcactgtctccctgataggtgaaaataatatctcattgttttgcatgtctttaattatggtgagtctgagcgtattttgcatgctttacagacattttgtgtttgtttttctgtgaattgtccttttgtatctggatttcatttttagtgaggtctccatctttctcattgatgtttaagag

SEQ ID NO: 23563 - DNA, 476 bp, Homo sapiens
cgtggatgccttgctttctctgaaaagtgtcctggttttaggggaatccagcagtggtatcagccgcgatgattatattggccaagtggccaaagaaatagaaaacaagatgcccaaagtctttgacttggaccaggtgaggaagcgcctcggaacaggactctcccccacttcggtggtgctcctgcaggaactggaacgcttcaacaagcttgtggtccggatgacgaagtctctggctgaacttcaaagggtgagcctgtctctcatgtgcagattactgcctagatacgtggcacctggggttctgatagagtcctgcccgattgctcttgattctaaataggccttggctggagaagttggaatgagcaatgagttagatgatgtggccaggtctctttttatcgggcatatccctaatatctggagaaggcttgctcctgacaccttaaagtcccttggaaactggatgg

SEQ ID NO: 23564 - DNA, 937 bp, Homo sapiens
gaacgcttcaacaagcttgtggtccggatgacgaagtctctggctgaacttcaaagggccttggctggagaagttggaatgagcaatgagttagatgatgtggccaggtctctttttatcgggcatatccctaatatctggagaaggcttgctcctgacaccttaaagtcccttggaaactggatggtctacttcctgcggcggttcagccagtacatgttgtgggtgaccgagagcgagcccagcgtgatgtggctctcggggctgcacatccctgagtcctacctcacggcgctggtgcaggccacctgccggaagaacggctggccactggaccgctccaccttgttcacacaagtgaccaagttccaggatgcagatgaagtgaatgagcgggcgggacaaggatgctttgtctcaggactgtacctggaaggtgctgactgggatatagaaaaaggatgtcttatcaagagcaaacccaaggtgctggttgtggacctgccgatcctgaagatcatccccattgaagcccatcgcctcaagctgcagaatactttccggacccccgtctacaccacctccatgagaaggaacgccatgggagtcggcttggtttttgaagctgatctctttaccacgaggcacatttctcactgggtgctgcaaggagtatgcctcaccctgaattctgattaacctttgggtgaagaaaactgcttaatgaattcggagcctggggttgtcagagtgatcgggtctgctgtcatttcttggggcctctcaagaggcaggagggggactgacactgatttttcatttgaaatcagccacttaaatctctttccatacaaattaacctgaatggttttgtttttaatactactttttaaaaggaatttatataatcaaaaagtaaatattggagagtatttta

SEQ ID NO: 23565 - DNA, 1006 bp, Homo sapiens
gaacgcttcaacaagcttgtggtccggatgacgaagtctctggctgaacttcaaagggccttggctggagaagttggaatgagcaatgagttagatgatgtggccaggtctctttttatcgggcatatccctaatatctggagaaggcttgctcctgacaccttaaagtcccttggaaactggatggtctacttcctgcggcggttcagccagtacatgttgtggctcttgttggatggttcttggaaaggctgaaaccacagtctatgagagtgcttctttcctcactccgctgcaatgctgcgttcttaacattttggatcactgtctccctgataggtgaccgagagcgagcccagcgtgatgtggctctcggggctgcacatccctgagtcctacctcacggcgctggtgcaggccacctgccggaagaacggctggccactggaccgctccaccttgttcacacaagtgaccaagttccaggatgcagatgaagtgaatgagcgggcgggacaaggtaccgtcagctcgttagggatccacagcctctcacttaggatttctctccctgaaccacctccaactcaaagggacaggcatagcgtgggcccctaaaatgggcccaggcccatgtttgaaaagcccagcctgcctgcaaaatatttccctgtgtcctctgcactgccccatgtcttaacacctctgagggtggatacggaagtttctcttcccactttctccgttgaagacctggggtctatggcaggggagacctgaaccatgttcactctgctagctcatggcaagtgggctcctaggtcagaattagctcttgcaaaaaccatcaggtggctttcttgtaaactgacggggccaggggcatgggagccacagagcagcatggactaacttggttggaactctttgattatgccagaacttgaggtcccttagacattggttactgactgtgcaaatgagagctggaaactgctgtttcccc

SEQ ID NO: 23566 - DNA, 1316 bp, Homo sapiens
acggctttagaaattgatgctgtcttgctctgaacacgaacacctaaaatatcacacgtgggctttgagctcactgccttcacccactgcagtgtgagaacgctggcaacagggcttcggttccccagatgtcagcagccaggactgggtacatttctttaaatggcgcccgcaaacgaagtccagatcgcttggatgcagccccctacattggaaagcgtccttcccaggaaaggtctggcttacagccctctctggctggttggctggattccgagagcgcggcctgccccggcccggttaccagagagcggaccccgcggggcgcgtctcccgggcccggcgtcccctccctggcgggtggggagggccccacaaagccctttgttgaggctcccgtgtgacgcgaggagccccagactcggcgcccgcggcgagcgggaaggaggcgtgtgcctgcggcgcggccccgaggcgtgtgcgcggccatgtgcgcttagcgcagcgcgctcttacctcagtaccccggccgcgaccctccgagcccctggagcccgggtaaagtgaacagagttatctgtgacattccatcaggcacctatgtaacgaaatcataccgtaataactcaccatggcgtatggagtgccaagaaagaacacagtgaaaaccattttgcggggcagttgttataatgtgctggaatgttgtgcacctcctgggcttgagtgatcctcccatctcagcctcctgagtagctgggaccacaggcacacaccactgtgcccgacaggaaccttgggatattgcattgcttgcaaagacctggtacacaaacctagccaatatcaagttgcctttcttggaagaaatttcatttggtggttctgtgcagctcacaaaatgtaccaccattaaagatggactgctcccttctgcagaatctatcaaactcgaaagggagtatgaagtgaagcgtctttgtaaactgaagtgtcaagaaaatacatctaaggaaattcagcttctcctgagggaaaggccagccggtttgagaagacctcttccatctaaatgacagtcagttcatgattgaatctgtactctgtgtcttgcatccaaagggcatgaaggtctctggacctttcactatgtatagttcagggcagatatttgaatgtgcccactggtggatgggccactgcccacagctgtgggttagtacccagttctgacagatcttctgagtccctgacatactcttgttccttgtgtcacaaacgacagcactgtaagtagatgaaaatgcatttggagt

SEQ ID NO: 23567 - DNA, 1447 bp, Homo sapiens
acggctttagaaattgatgctgtcttgctctgaacacgaacacctaaaatatcacacgtgggctttgagctcactgccttcacccactgcagtgtgagaacgctggcaacagggcttcggttccccagatgtcagcagccaggactgggtacatttctttaaatggcgcccgcaaacgaagtccagatcgcttggatgcagccccctacattggaaagcgtccttcccaggaaaggtctggcttacagccctctctggctggttggctggattccgagagcgcggcctgccccggcccggttaccagagagcggaccccgcggggcgcgtctcccgggcccggcgtcccctccctggcgggtggggagggccccacaaagccctttgttgaggctcccgtgtgacgcgaggagccccagactcggcgcccgcggcgagcgggaaggaggcgtgtgcctgcggcgcggccccgaggcgtgtgcgcggccatgtgcgcttagcgcagcgcgctcttacctcagtaccccggccgcgaccctccgagcccctggagcccgggtaaccaggccgccggcgccggctcgcggggacccgccaccctggaagccccgcgcacacagcgcattcctggcgagtcggaggcagggtggggcccaggtgtgggaaggagccgaggctgaggccgttcccttctccgcgggctctgtgggcggccgaggcccccacccgtcccgggaaccagttcctcccgggccctgcgcgtccgtccggggaagggtaaagtgaacagagttatctgtgacattccatcaggcacctatgtaacgaaatcataccgtaataactcaccatggcgtatggagtgccaagaaagaacacagtgaaaaccattttgcggggcagttgttataatgtacaggaaccttgggatattgcattgcttgcaaagacctggtacacaaacctagccaatatcaagttgcctttcttggaagaaatttcatttggtggttctgtgcagctcacaaaatgtaccaccattaaagatggactgctcccttctgcagaatctatcaaactcgaaagggagtatgaagtgaagcgtctttgtaaactgaagtgtcaagaaaatacatctaaggaaattcagcttctcctgagggaaaggccagccggtttgagaagacctcttccatctaaatgacacctgaagcgcggattgtagatgaagaaactcagcagcgccggcgggaactgcttctcctgggccgcccaggacccgctcccggccccggccgtcgctgcgctgcagccatcctggcccggcccccacctcaggaagcctcccacggcccgcccagagaccgagaaaatctcttaatttcagtggaactcagtttgtttctctttttaaacattgccagttataaatgtattttattttata

SEQ ID NO: 23568 - DNA, 546 bp, Homo sapiens
ggatgcaacagccagagaactttcctaaattctgaatagtaaagatcacccatagcttcaccatacaatttcagaaagatacactgtgtatgtaaataccatgaccatccagaaattttcttctggttcattgaagaactgtctgttcttctgtgtatgtaaagattttgcaggttttgatgggctaaaggtccttgtaaactgtacaatagcttcacacaatccgacatttctaatcttttcattttttctacctcatttggatgataaaataaaatcttattttccccctctcctttgcgcagcctgaagcgcggattgtagatgaagaaactcagcagcgccggcgggaactgcttctcctgggccgcccaggacccgctcccggccccggccgtcgctgcgctgcagccatcctggcccggcccccacctcaggaagcctcccacggcccgcccagagaccgagaaaatctcttaatttcagtggaactcagtttgtttctctttttaaacattgccagttataaatgtattttattttata

SEQ ID NO: 23569 - DNA, 1327 bp, Homo sapiens
acggctttagaaattgatgctgtcttgctctgaacacgaacacctaaaatatcacacgtgggctttgagctcactgccttcacccactgcagtgtgagaacgctggcaacagggcttcggttccccagatgtcagcagccaggactgggtacatttctttaaatggcgcccgcaaacgaagtccagatcgcttggatgcagccccctacattggaaagcgtccttcccaggaaaggtctggcttacagccctctctggctggttggctggattccgagagcgcggcctgccccggcccggttaccagagagcggaccccgcggggcgcgtctcccgggcccggcgtcccctccctggcgggtggggagggccccacaaagccctttgttgaggctcccgtgtgacgcgaggagccccagactcggcgcccgcggcgagcgggaaggaggcgtgtgcctgcggcgcggccccgaggcgtgtgcgcggccatgtgcgcttagcgcagcgcgctcttacctcagtaccccggccgcgaccctccgagcccctggagcccgggtaaccaggccgccggcgccggctcgcggggacccgccaccctggaagccccgcgcacacagcgcattcctggcgagtcggaggcagggtggggcccaggtaaagtgaacagagttatctgtgacattccatcaggcacctatgtaacgaaatcataccgtaataactcaccatggcgtatggagtgccaagaaagaacacagtgaaaaccattttgcggggcagttgttataatgtacaggaaccttgggatattgcattgcttgcaaagacctggtacacaaacctagccaatatcaagttgcctttcttggaagaaatttcatttggtggttctgtgcagctcacaaaatgtaccaccattaaagatggactgctcccttctgcagaatctatcaaactcgaaagggagtatgaagtgaagcgtctttgtaaactgaagtgtcaagaaaatacatctaaggaaattcagcttctcctgagggaaaggccagccggtttgagaagacctcttccatctaaatgacacctgaagcgcggattgtagatgaagaaactcagcagcgccggcgggaactgcttctcctgggccgcccaggacccgctcccggccccggccgtcgctgcgctgcagccatcctggcccggcccccacctcaggaagcctcccacggcccgcccagagaccgagaaaatctcttaatttcagtggaactcagtttgtttctctttttaaacattgccagttataaatgtattttattttata

SEQ ID NO: 23570 - DNA, 999 bp, Homo sapiens
cctttggtcgctcagcactgccacgatcagacacattttggcgcagcggtgttggagctggtttggcaggctcaggcaagggcagagagtgcgacaccgaaactttgtctcaggatgacgaaacttacctggcattttctccttattcggtggcaaaaaatgaaaaaatgagttcatggaaaaatgaaagagaacacggttttacacttggggttccagttcaatgaacacttattaaggactttctgacattcagaatttttttctattatttggctacaaaatattcacgtgagaggcattaattaggtgcgttgccatcatttcaggtaaagtgaacagagttatctgtgacattccatcaggcacctatgtaacgaaatcataccgtaataactcaccatggcgtatggagtgccaagaaagaacacagtgaaaaccattttgcggggcagttgttataatgtacaggaaccttgggatattgcattgcttgcaaagacctggtacacaaacctagccaatatcaagttgcctttcttggaagaaatttcatttggtggttctgtgcagctcacaaaatgtaccaccattaaagatggactgctcccttctgcagaatctatcaaactcgaaagggagtatgaagtgaagcgtctttgtaaactgaagtgtcaagaaaatacatctaaggaaattcagcttctcctgagggaaaggccagccggtttgagaagacctcttccatctaaatgacacctgaagcgcggattgtagatgaagaaactcagcagcgccggcgggaactgcttctcctgggccgcccaggacccgctcccggccccggccgtcgctgcgctgcagccatcctggcccggcccccacctcaggaagcctcccacggcccgcccagagaccgagaaaatctcttaatttcagtggaactcagtttgtttctctttttaaacattgccagttataaatgtattttattttata

SEQ ID NO: 23571 - DNA, 379 bp, Homo sapiens
tatgggacctttggaatgacaggaatggaagcctgagccctctccacccagcactgccctgtcactgccccgggacgtccacgtgggctctgggaatgctcctttgctgagacaggcttgggtagtacaagttcaagccctcctctgttgaaatgtgtgtgctctgtttagccaagaggtgtctgcatccgagctatgcagagcaaagtattattagagccggcatcagtgtgtctgtaactgaacccagctctccctagcaaccgttgccaacaacacatctaacagaaggatgcgatacctttttttgaaaaaaaaaagtttgtctcaaccaagtcataaacacagcaggcctgttgtgaaaagacaacacaaaatc

SEQ ID NO: 23572 - DNA, 349 bp, Homo sapiens
accgggtgccgacctggctgtctgcttctttaacagcatttttgagatattcattcacataccttataatttatccattgaaagtacacagtgcggagcactttgggaggcagaggctgttgaatcacttgaggccaggagtttgagaccagcctgggcatcatagtgtgaccccaactctacaaaaaaatttaaaaattattcaggcctggtagtgcaagtctgtagtcccagctcctcgggaggctgaggtaggtggattgtttgagcccaagagtttgaggctgctgcagtgagccattattgtgccactgcaccccagcctggctacagagcaagaccctgtctc

SEQ ID NO: 23573 - DNA, 1111 bp, Homo sapiens
ggggcgacggcggctgaggcctttcgcaatcgttcttagatctctgcagagctgtcgccacggcctgaggggcgacgtggggactgccgctcacggaatccgggagtcgctaggagagcggcgcagggaaaagcgagcttggtgcagctcttcttgagtagtcgagctacaaggcgcctgaagaccttctgggccaactcttctttaccagtttacagagagggaaactgaggcgggggcggtgctcgggcaggattagcccgcatccgtcggcgaggcttgcactggtggggattcgtgcgcaggtttcctgcctccgggcttgggctgtccgcgcctcgccacccaccccaggctcccgtcgctcctcgccggctggcgcccagctggggggtgcaccgggagaggtggcgcggctcacttcggcgcagtccccggccccagcctccacggtgaccggctaccctgtgacatcaggcgcccagcacagggcctggacgcgggtgcaggagagggagtcagggaacggggaggagcaggggtccccactgtgtgcctggtgcgacaaaaggcgagctgcagagaggtcgggaggagccggcaaacacaaggatgcccaccaggcgcggagggcctgggctggaggagcatttaggatgcagaatcgcgggaacctggcatggagagagaggccaaggacttttggcttgggccagggctgtttggagatgctttcaacaagtggaagaagattgggcacagaaaatgtagactgaatggaacactgaggcaggagcaggtactcctccccctccctcagcagcagccatctccccaagaaggggccaggatgggaggccaggagtacagtggctcagtgggggagctgaagtcctggggaaccagccaagccccacacaccctagaaatccaggaggcccagctaggtgattctgcccgcagccgcagggttcccatgccagtccactgggatcttgtgccatgtaattgagggggcgccagatctaaggatcagtgaactaatgtgtgccatgacccagtgtgagttgagatcaataaatgtctttgctttgctattattaaaaaaaaa

SEQ ID NO: 23574 - DNA, 284 bp, Homo sapiens
agactctaggcttagtaatctgcagcgccagctggccctcgaagttatagtgaccttgtctgaaactgccactccgatgttgaaaaaacatacaaatattattgcacaggcagttcctcatatattagcaatgatggttgatctacaagatgatgaggactgggtaaatgctgatgaaatggaagaagatgattttgacagcaatgcagttgctgcggagagtgcactagacagactggcttgtgggcttggtggaaaagttgttttaccaatgaccaaggagc

SEQ ID NO: 23575 - DNA, 442 bp, Homo sapiens
attggatggtctggaatgttttttttcaatttcatgggattttctacatagccaatcatgtcatctgcagaaaaagacagttttaattcttccttcccaatctttatacctttcactttcttttcttgtcttactgcattagctaggacttctagtgcgatgttgaatagaagtagtgagagggcacttcttacctttctcttgatcgtaggggtaaagcatctaatatcctaccattaagtatgataaccatatggtttttatagatgttctgtataaaattgagatagctcctccctatttctaggttgctgagaggtttttatcatgaatgagcattggattttgtcagatgcttctaattcttttttatatgattaatgatttttagtctttagactattttgtgatggagtacattaattgatttttgaatgttaaa

SEQ ID NO: 23576 - DNA, 556 bp, Homo sapiens
ttaaattgtagcatataatctcccagtgaaacacttgtgtttctttccattttttctgctctaaacataattatcttgaagattccaactgcttccgggcagctgtacttgccggtcctgaaatcatgggaattcacactgacttttcagtgctttaaaaactacctcatttcacattcagatgctaagggcaaagagtgtggcctggaggtggactcttaaaataaagctatcaaattgatttgaacttttgttatacataaattccttactgagggcataaaagtactgtgttgtcacacttcatttaccaatttgcagtatttttttgtgtccccagtaatactatgatccatttcaaggttaggtgatttacaaaaggtgatttctgagtaggcacaacaagccctattcataaagactaatatttaataattctaacttttataagaacatctgttctattgagagccatgacttattttaaattgtcttcctggttaaccttgccatggagaaagcttatgtgtaagtaaaaacttgaggcaacagaact

SEQ ID NO: 23577 - DNA, 551 bp, Homo sapiens
gggtttaaatgactcatctcctatctaggtttctttcattaagatgccgagactcttcttttcactaaatattatttccacccactcatggagcagagagccacgttccataaaagggctctctgatatacggtagtagtcacatgcttttagcaatgcatacctgccaagaatggacagatacctcagattaggctgtactgtcctgaatttttggtctctttcccaggtgtttcccaggaaagaaattcattatcaataaggtggaaaggacttctcagtattgagccccataatttgccttcgtagtgttggagggaacaaggggaaatgggagcagaaatgagaaatgggagaggagtttgggaagtaaggcggaaaggccagcacaggtagcattgctgacgagagacaaagcttggatgaggccactctgcctttcaccaccaaggcctgtaatagactggccaggctccgaaacgctggactcaacgtttaactgcctgctctggaggatttaggacaaacagggaaaaaccttttgaaatagt

SEQ ID NO: 23578 - DNA, 465 bp, Homo sapiens
ttcagatttcactttatttgtgaaaccttctcatctgtccgctagttaaaagaggcctttctttcattctcatggttttgtctattgtaaagtactattattattggtttatgtatctttcttcaacccactgtgattttcttgagggcaggatctatttcttattcatttactatatcctcaacccctagtaaagtgcttttgcacatcctaggcattaagtaactaaatgatgagtaggatttgttttgctttaaaaatttattatattttagggaagggaacaacacacaccagggcctgttggaaggttgggggcgaggggagggagagtatcaggacaaatagctaatgcatgcagggcttaaaacctagatgatgggttgataaatgcagcaaaccaccatggcacacgtatacctatgtaacaaacctgtacgttctgccattgtatcccagaactta

SEQ ID NO: 23579 - DNA, 307 bp, Homo sapiens
tcactgctttaatttataccacagaacgtctgattgttcagttttgcaaattagcaagtgaacaaaccaatttaaagaaataaagacaatgccacataaaacacagtcctcttatttatcttgatgaggcatggttccattttaatgatttctgttaatgttttattgtacagtggttatgcccccaagtgcattttataagactaatgaagtcttagtaatccgaggcgtcttctccaatatgctcttactatgtctttgctgagaacgcttgtggggagaccaccaccactgtgtgagcaaggaa

SEQ ID NO: 23580 - DNA, 291 bp, Homo sapiens
gggagagggggagggggcctgggccagggtgcccagcggctcggtctcccattcacccccttcagagggaaggtggctcttcctctccatctgacaggaagagcagttcccagaaagaggaactgtgcacaccactgagcccagcctcagtgcgtgtcccagcggggatggttaggcccaggagtatcagaaggtagtggggcctgagggtggaggcagcagggcacacggcactcgggagctttctgttcggtgctgtctgggccactggtctggccatgggtccccaag

SEQ ID NO: 23581 - DNA, 456 bp, Homo sapiens
tctttttttgagacagagtcttgttctgtcacccaggctcccagactgaaatgtagtggcaagatcatggctcaatgtagtctgaaactcctggcctcaagcaatcctcccacctaggcctcctaagtagttggggctacaggtgcacgcaaccacgcccagctgatttttttttttctttggtagagacaccgccttgctatgttgcccaggctggtcttgaactcctggcctcaggtgattttcctgcctcggcctcccaaagcactgagattataggcgtgggccactgcacccagcctctgctgctcatttttatctgagatttgtttctctgaacttttagaaggcagtatagttcagatgaggttttccaacctcacagagttctttcttctgtttttgtgtactgttcaaacaaatggcagcttaccttctgggatttcctggctgtat

SEQ ID NO: 23582 - DNA, 346 bp, Homo sapiens
aaagggactaactagtggactccatcagtaggccctggaattcaggattgttcacatcctcttggtgccaaggacctggctgaagaccagctcttctgatccagaggttttcagcaaacagcatttgaaacaaaagcacagctgctctgtttgacaccaaactgtggctccagattccagtagaagccaaatgctttttcttttaacagctgggtgcctgtaatcccagttacttgggaggctgaggcaggagaattgcttgaacccaggaggcggaggttgcagtgagccgagcttgcaccattgcactccagcctgggcaacaagagtgagactccatctcaaa

SEQ ID NO: 23583 - DNA, 495 bp, Homo sapiens
tgcttttctttcccatcttcaggcctttgcaatgtagactcacctctgccaaagatgctgttcaaccagatatacctgtaactgttcctttctcacccttccagtctcccctcaaatatcagtacctccaaccagccatcacagccatctgcgtgaagattccctcctccctctactccttcatcctgccatttgctctttttttcacatcatcccattgctgattttcacagcatttgtcatactctgcaatgttcttgtttctgtcttcccactagcatgttagctttattatctgcttcttcacacccagtccaaagcttggagtccagcatatcacatgtactgtgtatttaatgaattagtagttcaacagcaactgccattaagatcattcatttaaccaaccaccatttttcgaattccaggctcaccaatgtctgatacagtaagttccttttcaaacgtttaatttctgactcccttgttctttgt

SEQ ID NO: 23584 - DNA, 319 bp, Homo sapiens
tcaaaaaaacaaaaaacaaaaaacggagaaacaggtgaaaatctctatgattttgaattaggaaatggtttcttagaaataagcacaagaatcaaagaaaaaataagataaatcaaactttactaaaattaaaaacattgtaggttaaaggataccaacaagatagtgaaaagacaatccacagaatggaagactatatttgcaaaatatctacctgataagggcctaacatccagaatacgcaaacaactctttttttttttttttttttgagatggaatctcgctctgtctctcaggctggagtgcaatggcgcaat

SEQ ID NO: 23585 - DNA, 157 bp, Homo sapiens
acatgcaccataatctgtgattttaccaacttctcttatttcaaaattggctttggtattaaactgttttaataataataataagcagataattaacagctgagtggatagatgaatgggatttctattcacttactagggtagtttccccctgatc

SEQ ID NO: 23586 - DNA, 283 bp, Homo sapiens
agggaggaaaaagccagagaagacttgaggactgagaatacaggctaaggccaggcccacgcctggaagagaagaactttctctttgtctccttgcccactgcctgtccctgagcctgcgggactgggagggcagaggacacttctggggtttggcccagagaatttatttcttcttttcttgttttccgctacaccacgtggcttcagaccatgacatttctgttcaatgccgtcagtgccttggtttgaggagaatgtctgtgtacccagcttccatggcc

SEQ ID NO: 23587 - DNA, 366 bp, Homo sapiens
gaagttaagttgtaattgtttttaagtgattatgtacacttctgttttagattgctctctttcactaaaccttttagcatagtgttcattcaagtctcttgctcatcctcacttcaactctaacaaattgaattctcttctctaacttcgagcattctctgttagaaaacttcagtgatgatatgttgtgtttgtgcaacagagctttaaaattcacagcacataggtacaccgtctagtgtgaaccccacaaccactctgggagatagacaaaaaggtgttattcccatttagaggtagaaacactgagacccaggaaatgctaagttacttgcctatgggactctctcatatgacagatcttgg

SEQ ID NO: 23588 - DNA, 349 bp, Homo sapiens
ggactcagagcatagcctgcaaagagtctctctggggccagtcaggtaactgacatagcatgatgtgtagttcaaagaaaccagtttatttatgtggatcaattttagtttttgcaaatgcataaaagcatgagggcagcccatcaaaatgtctcctgccattgatttgcccactgagcagcctgagcacgtggtttaaattgcttctctaatctgtgacaaaaatagaagaccaatgaagtgcaccattggccagtatctggcagtgggcaatgtctgaattggcttccaggaaccagggagatcctgaagtgttgaaccaggtactggcatcttcccatatgtcctt

SEQ ID NO: 23589 - DNA, 214 bp, Homo sapiens
atctccacctggccccacccttgacacatggggattattacaattcaaggtgggatttgggtggggatacagccaaatcatatcatgagaaaaggcaagaggggtctcactgagttggcaaagaaagagaaaacactgagtaggaacactgaagctcttagcccctgagaacaaatcgcagacagcatggagaggaagggacaattgtttctaa

SEQ ID NO: 23590 - DNA, 241 bp, Homo sapiens
ggaacactcagaactcattggcccctattttatgaataattatataaagcttgagattttatgtctcaacccatgacagatttgaagtaaaggtaaagaaacatgttagaagaaataacagccagaccgttaaaataatggggaaggagacatttttgaaaaagtaaagctcagtctataaatctcaaaatgcgtcacattctggaactgtttagtgacaggtgacaactgtttttttatt

SEQ ID NO: 23591 - DNA, 446 bp, Homo sapiens
acgacaaagggactttaaaaaaaatctaagaatttaactttatcacatacagtggtagatgttttaccctcgttaattcttgaagaaacttattttttgattgcctttactccatgcgtttcagaagtttctgttgtaggcatttgaatagaaatggcatttagataaatttaaatgtaggcctaccaacaaccattgagtggcactatctttataacaacttaaaaagctgtacttagtgaaactaatattaatcactgtcaagttttgacaagtcttgtaaaaagggagaaaaaataattaggttaaaggtgttattgctacgatttctgcttaggatgaaaagtaaaattgtggctctctggaatttacttggaagcagatcttctggatagctgagatttccatataatggagtttactacagtttactacttgtggcctga

SEQ ID NO: 23592 - DNA, 449 bp, Homo sapiens
acctgagcctggaaagttgaggctgcagtgagctgagatcatgccactgcactccagcctgggtgacagagcaaggctctgtctcaaaaataaataaaaaagaagagaaaaaaagtactattataatccaacaacaacaacaacaaaacatagttttaaaatgggcaaaggtaggctgaatgtggtggctaacacttgtaatcctggcacttttagaggttgaagcgggaggatcacttgagcccaggaatttgagaccatcctggcaacatcacaaagccccatctctacaaaaaattagctggtcatggtgccgcatgcctataatcccagctacgtgggaggctgaggtgggagaatcacttgaggtcgggaggttgaggctgcagtgagctgtgatcatgccactgcactccagtctgtacaacacagtgagatcctgtctcaaa

SEQ ID NO: 23593 - DNA, 378 bp, Homo sapiens
aaaaaaaaaaaaaaagattttaaaagccattgtaatcaagacagtgaggtattggcaaaaagacagccatagatagatcagaattgagtccagatatagacccatacatatgtggccaactgatttttgacagagatgccaagacaattcaatggggaaaggaacgttttcaacaaatgatgctggaataactggatgtccatatgtagaaaaatgaacctcaaacattaccttgtaaagcacacaacagttaatttgagaggatcatgggcttcaacagaaatgttagaaagataaagcccctagagagagcataggataatgtatctgtttgacactgaggtgatctaagatttctcagaagcactaaccatagga

SEQ ID NO: 23594 - DNA, 882 bp, Homo sapiens
ctgatcctatattctcctagcacgggtaatgtctgatttctttgttacaggtaactaacatgttgatgttgccctttgctgtcagttcagctcctctaggaagcagatgctaagatggaattaggagtacaataaatttattgggggctaatggccatgacagaagggagaggaaacaggactgggcaatgaaagtcttcacacctccatgcagattagacacctgtgaaaggaaagaaagagaggcagaattgggcaaggggagcttcagaccatggtgtggatctgcataaatctctgcctatgcaatagggagttctggaacaaagagtccccattagaagagtcccatgctgggcagacagggccacacccgagcactcccagcttgtacggtattggctgggggctacccaggaagagatgggcctcagctcaaacacatggcatatgttgaagatgctgcagctagaggcaacagtgagttctctcttaaagggagatcttcgcagcacacctccacagctgccatgcgatccaaatctcttattccatgctggctttcactatagaatagtggccagagagtttgatacctgctttcccagcctccctgacaattggaatgactatgtgacacagttctggctagtggggcttctgagaagctaactggataaaaagacaaagccttatgcgaagaaagcacgcacacacatacgtgcaccggctatttgttttctaattttgaatgccgtcttgatacctggaggggcagccatcttgcaaccaagaggccataagcaaatgtgctgaaggatatagttccttgatgacattaatgagactgctctcttcctggtaaataaacaatatgttatt

SEQ ID NO: 23595 - DNA, 631 bp, Homo sapiens
attcgcggccgcgtcgacttttttttttttgtgagacggagtctcgttctgtcgtccaggctggagtgcagtggcgctatctcggctcattgcaggctccgccccccggggttcacgccattctcctgtctcagcctcctgagtagctgggactacaggcgcccaccacctcgcctggctaattttttgtatttttagtagagatggggtttcaccgtgttagccaggatggtctcgatctcctgacctcccaaagtgctgggattacaggcgtgagccaccgcgcccggcgccatattaaaatggcaatgaaagttgactttgccagacaccagtcaaagtagttggcctgagtttcattctttcccccacagcattacatattcattaaaccagtaagaactttcatgatatcccaggcaattacagtgcaacaagaaaacgaagtgacaatcctccttcatgctttatatgacaaccattatatgacaacctatgtctttcagtctacatgggtaattaattcatatgagttcagtattttattataatacttataaataagggcatcttaatggaagagtaaaacttcttcagtagtcgacgcggccgccgaatttagtagtagtag

SEQ ID NO: 23596 - DNA, 658 bp, Homo sapiens
  misc_feature (630)..(630): n is a, c, g, or t
tcccatcttttcccccttttacacttcactccaatcacactgacttgcttactgatgcttgaacaaaagtcaagcttcatcccacttctgggcctttgcacatgtgctccctccaactgaaaagctcttccaccagacctctgcgtgtcacttcactcaggcttctgcttaaatgtcttttggaaagtctccctgggctccctatgtacaattgtctctcaaccccggattcccttgtccccagcatgctctctgaccctttgttctgctgtaattttgttcacagcacctgggtgcatttttatctgtttatttagcttactgccccccaactattagaatcttttcttttcaactgtggttttatattcagtgaaatacagagatttcaaatgtccaattcaatgcattttgataactatatatacatatttttaaccataaccccaattaaaacagaaaatgttcatcaccccagaaaagtgattcacaaagcacatttattttttggacacagggtctcatatcattgcccaggctgcagtgcagtggcacaatcatggctcactgcagcctcaacctcccaggctcaaaggctgcagcgagcagtgattgtgtcactgcattctnccctgggcaccaatgtgagaccccgtct

SEQ ID NO: 23597 - DNA, 262 bp, Homo sapiens
tacccagactgagcttaatgttctatgtattaagaataaaaataattcaattataactcgaggagaacagattacctgcaacataacaaaacagtatagcatccaaactctcctctacaacattaaattcctgagtattatgaaataatatctaagaaattttgagcataaaaacaattataacacaggacttttgtaaaaaaataagttgtcatttattaacaaaggcaaaagaataacattcttagattccaaagccaca

SEQ ID NO: 23598 - DNA, 1028 bp, Homo sapiens
gaattgagggactataacaaaagatctagtatttgtgttatcacaaaagatggggagagactgaaaagtattgaaataaataatgtctgaaaagttaccagtttggcaaaaggcagaaagctatagattcaggagcctgagcaaatcccaaactggaaaaatccaaaggaatatagaccaaaccacataatattcaagcttctgaaaatgaaagataaagaaaaaccaaacatcaatctaagaaaagtgggaatggctatattaatatcagataagatagacttccaagcaaagaaagttctcagagacacagaggggcattatattaagataaagaaagcaacaaaaaagaaacgacatgctacctgtaggggaaaaacaagttgaatggaaatgggtttctcatgagaagtgatggaggccagaagtaagtgacagaacatttttcaagtgctggaagaaaacaactgtgtttccagaatcctacatccagaaaaatatcctttaggaataaaggaatcaagacattctcagatagaaggaaacgaagagaatttgttgccagcatacctaacctaaaagaatggctaggaaaagttctctaaatagagagaaatgataagagaaaaaatccaggaatatgtagaaggaacaaagcacatgtaaagcaaaaatatgggtaagtacaataaaatttccttctccttttgagttttctaagttatgtttgtccattgaaacaaaatttatcatgctgatgtggttgtaacagaatatagaggaagtatttaagacatactataaatgggaaagggtaaagagacataaagggaggtgagatttctacgtatcacttgaactagtaaaataataccctcagtcaattgtggtaagctatatttataaaatgtaatacctagagtaacaattaaaaagctatacaaagagatatactaaaaacactataaataaataaaagtagaattctaaaatatgttcaagtaatgtacaggaagacaggaaaaaga

SEQ ID NO: 23599 - DNA, 360 bp, Homo sapiens
agtatcgcttcctgttgagttgggcatgggctggcccacaggagcttttgagtgtagaatgccagattggcggtggctgtttcactgcctgctccattatttcaataaaaaagttgtctatggtaattgtgagggaagcgatcagggatttgctgcagacactgccatggtactgtgctgttctacctcccttccctgcattgaggaatgtgaacttagagtaattactctgacaggtgaacctgacttgtaacccagacaggcaaagtagagctctgactctcacagtgtaagagttctctgctttacaaaagggtcaccttaatatttaaccctgtgtgtgtgccttttagcatctgc

SEQ ID NO: 23600 - DNA, 223 bp, Homo sapiens
cccggcccagcccctccacccccctgcccccccgatgcgaccatgggctctggcagtgactaggtggccaccctcccgccgagcctcggctcctgccggcgggagcccccgaatgctgcacccagccacccagcagagcccgttcatggttgatctccacgagcaggtgcaccagggacctgtccctctgtcctacacggtcaccacagtgacgacccaaggc

SEQ ID NO: 23601 - DNA, 407 bp, Homo sapiens
cacactcctttccagtttcgagctgtactggaaattggagagttgtgaaaggatggtttttggataatcaaagttgaatatacttgctgggctgtgttatgaccgtctttgaagccacgaatcattaaaaataagtgaatagtttacattataatattcctaggaaacttcctttgataattgtaaagcaattaaaattgtcctgagataaggtgatttattgtttttcagaatgggccataaagatattaaagaacccattcaacatttgtcaaaacccataaaatgcacaacgcaatgaatgaaccctaatgtaaaccctagactttagttcattataatgtattaacgttggcccatcaattgggacaaatgtaccacatcaatacaagatattaataataggg

SEQ ID NO: 23602 - DNA, 852 bp, Homo sapiens
agagatgaagtttcgccatattgcccagactggtctcaaactcctgggctcaagcgatcttcctgccttggcctcccaaagtgctgggattacaggcgtgagccacgatgtctggcctactgttttttaatggttcatttaaattactgtgccttctacagttggtatttacaccatgcattggataaaatggggagatgtcttaaagtagtgtagggaagcctccgacaggaaaacctgggcctgggtggatcaggacttatacttacttttgccttaggctatcttcgtgaaatggaaggtttgtgtttttaagtgggtcagaaattggaactttaaaatgttggtttcagcaattttggtttatctgttctttactttcatctacaaataatttgaaacttttatctctctgttgtttgttcatcatcccatcaatccgtcggtccattgtgtagcatccactgcaacacacctttctcttagatttaattttttgttcactggagatttgagggctcatcaccaaatccagaggtccaggtttcccagtacactcacggatttctgggaagaaactgtttttaggattgccattaatgtttccaggcccttcccatttttgtgttggattaaaatggtgacaacatgaagcctgcagtcaatgtgaagggagttgggtgcctttcttagtgagataccttaaagggaacctttgaatatggctctctaaatagtgacagatctcttataaaatatgttcgcatatatagagttcaaaggtaagctagagacatgaagaaaggagcagtgatttatatttatcacttccttaaaatgattactaatatg

SEQ ID NO: 23603 - DNA, 434 bp, Homo sapiens
gtcaggagtttgagaccagcctgaccgacatggcaaaaccctgtctctactaaaaatacaaaattagccaggtgtgatggtggccatctgtaatcccagctacttgggaggctgaggcaggagaattgcttgaacatgccaggcggaggttgcagtgagccgagatcacaccattgcactccagcctgggcaacaagggtgaaatttcatctcaaaaaaaaaaatttcaggagggagtggagataaatgaatatatagttgattcttcacattttcttcaatgtgatagctcacagccatcatattgtttcctttcttgtaattatttgttgtcttccctctcctacatatgcgctctggccacaaatgattgcatgtatacagtgcaatatttactcttgttttatttgctgtgagcagacactcttagaagt

SEQ ID NO: 23604 - DNA, 462 bp, Homo sapiens
gggctccccagtggctgagcagttcagtagtaatttgtccccaaaattcacttcagtccttttctgggatgcagcttctatcctggggctggtcactcgctcttccattgtaagcattactactcttcgctccgaaccagtggaactggtagcaatgcattcataagtgcccctgtctgaagaggctaggtttcttatatacaaagtcccatttgaaaataagaacaacttggaattggtaaactgtaatggtttcacttcagtgccatcagagaggacccagtaaacgctgggctgaggagttccttttgcagtacagggcagttttaaactttcaccccaagtgcctacaatgacttgcctcctttgctctagaataacaggtggtgctgcaatgacttgtattttaaccagcagtgaatcctggccacctgggttgctggccacacatttgtaaaagcc

SEQ ID NO: 23605 - DNA, 1338 bp, Homo sapiens
acctctgttcctttctgtgacccccacgtggtaatattgaaaaaaccaaaacaaaactccagctaaggcattgctctgactttaggcagaacattcattagtggagcgtgagatgagattgtgtgactgttgatgggatcgacctactctggtcttgggcgatggaagttttccctaagtgcaaggccggttactctggtgaatcgtaattcatacctggacacttgagtgaactctgggcacccacttagaagtctagagaatttcctcttttatggaggatttgatgtcagaccgttttggggcttagttagatttgaatatattaggaacattaactttttaaataaatgtaatttcctgtctttttgatcaatggggggagggcagctgtgcctaatttaggattgatttattctaacctctcttactaaataaatgcttgtattcagagtctgtttggaatttaacccaatgcttagaactccttaaatatacagaaatatattttaggggtaattgattcatggaactctcctactttggagcacaattgtattataattgtccggaaactggccagataatgtagaacgcacaagttgttgagaagcccttttgtttcctgatagttacatgtaattccagcagtatttggaaataatttgctaagatgttagaatgtaacatttgaagacttgttagaaaaatcaataaaattatctttggctaatgggtagtacacatcttagtctgtttaatatgcctttccaaaaaaaactgtgtctgttgagaattggtgtatataactagatgactttaataattagtgcctgagtctagaattgagatgtttagtcgtaaaaaaaaaatattgttcgataaacagcgttgacttgtcttgtaccacttaagagtttgtgagtgctttaaataaaattagttgattaagtattttttttcctatgattgacatgcttagttttgcctttttattgaaatgtgtgaaatttgattttctggcatctaacaaattaggtggtaaatgaatgacaatggattttctattatttttcagtattgtgatcagtataagtatataagagaatttagtaaccttttagaagaataaagtgcccttcccaaatagtcctacagcttttggaaaagtgtaaattgtagtttgtagttctaaataaatagagaagagtcgcagccacgtgctagggccagctgacttcattgctgacaggtatgaagccaaatggcttatgtagttatggaatatgtacatgagctattaataaatattatccatgttgtttctttcaagtgctt

SEQ ID NO: 23606 - DNA, 2932 bp, Homo sapiens
aagagaccctccccaatcccggcctgccaccacctggctcgcgcgcagccccggcccagaatgccttaacctgcgccgattgctgccgccgaggtgcccctcccctgtagggaccccgacgccgccagccccttcctcctttcccgcaggttagcctggcaaggaagataaagacatttgcaaccaagatggtaatcactagtgaaaatgatgaagacagaggaggtcaagaaaaagaaagtaaagaggagagtgtcttggcaatgctggggattatcgggaccattctgaacctgattgtgatcatatttgtctacatatacaccaccctgtgaatggcccagagcgtcctcagaggcctcagaatggccaaagacggaagtcctgcgtgtcggcgcatcactgaccagaccctgcgagaacaagcaggcttgacccgcacataccacccaatcaaatgcaccttcaaactttacaaaaggtcacacaaatagaccgatcctgctgcagggagcagacactaaagcacaatgattccaacaaaactcattcacagcactaggaactcaacgtctttggcagggggcccagaagaatgcttggaagaccagcctctgacaccatcagtgagcggatgggtgcagaaattcattattccagatcgctgacagatatcacatatttgaaaagatgaatagggcggacatggctcagatgtgtgtctcccaggacaagtgtttcatcttcacttgacgagctatttagtggaaaaaccacaggcgcagccctttgacaggcatcccattcatcaaaagtgtctaactatttgatactggggagataacttatttttcttttttcattggcttgacatgtgtatctgttcatgtcaaggtttataaatatatatttttaataaatgtgctctattttttagcatgaaccaaatacttggagaggcactcccagatccatagagctttccttagttttatctgctttgtcccctcctcccccaactacagatgttctgttgtggagccattctagtccttttgtctcatcttgagtcttttaccttgcgcttttgttctctctctctcctctctctctgcctctttggtctgaaggacattttcccatactgtcagccatggttttgggtgcatgttttaagattgtccattgagtggctttttgttgttatctcggagatataaaatgattgtgggcatgcagaccttagatgcaccctatctttactgagaattatgcatgaataagggctgagtgatagatcagcttaaaattaaaaggactacctttgaggaagaagagcgtggctatatttgcagatgaacttttgaacagaatattcagcttcttaccggcagcgttattgtttcattcttgtgaccattcgtttatcagattttgattttagcggtcatgtaccgcgagagttgggaagaacaagggggaaagctcgggattaggtgcattactccttcctttgcaagatacctgggatcctcctcaaaagcgggtggggtataaatgacacaagaactcccccaggagatctcatggtgattcaggctgtgaggacagccctgtgacaggtgacttttcagggacatgaggaggggatttaatgattgccctaaaggacttctgtatttttaaagcccctggtttacacccacatgaagctatttcctctctggcagggatggttgcataaaaacaaattagctcccttctggctccctgaaatgggcccttgcctggctacagtggcatggccttaaagagagggttagtattccttctgccattgccagctgtattagtctgttttcacactgctgaaaaagacatccccaagactgggcaatttacaaagaaagaggtttattggacttacagttccacgtggctgaggaggcctcacaattacggtggaaggtgaaaggcacgtctcacatggtggcagacaagagaagtgaacatgtgcaaggagactcccatttttaaaacagatctcgtgagactttttcactatcatgcaaacagcatgggaaacctgcccccgtgattcagttacctcccaccgggtccctcccacaacacatgggtattcaagatgagatttgggtggggttacagccaaactctatcaccagccttgcccctgggcagaagcagcagcagtctgcctggctggattcaaatgattctgaggcttctatagtctatgcctgcagatctctccctcacccatgctatagtgtctgaaattccaccattagagagtcatttcttgggctctgttaaatggaccaggctcttttataaagaaaatgcccctgagcagctggctctggcattgatttatgatatcttctcttccctgccagaaggaaggaagctaaggtgcatgtagggcgtactgtgtgcccaggcactgtgccagatgctttggatacttggagtcattgaattcttgtagtaaccctgtgagagagggagtcttttctccacattgtagaagaaggaaaaagggctcagagaggtcaagaaatgtccctgagatcacatggcttctagtggagtcaagatccaaacccaatgtgtctgattccttagcccttgggggtccggaggctgctgaacaagaaaggaggtggagaggagagaaagctgcaggcataccaccgcacacccttctccctcccctgtaaaaacaaccctgggaactccctggacactagcagaatatcatacactaaggataagggatgagaggaggctggttagaaataaagcagtgtcagggggaaggagctactcagtaggctctgtgtgattctagaaagactgtatgaaaattctgaacactgaacagaataaacaataaaggtgcaatgga

SEQ ID NO: 23607 - DNA, 3005 bp, Homo sapiens
gacatgagcagcgcgcacggggtcccgcgcccggcggccagccctatccggcggcggccagcgggtcaacgctgcccgggagaatgaggcaggagccggcggcagcctcctttttttccttctcctcgccttcctgcggctccggcgctccgggtccgggccgggctgcggctctgctgcgtgccccgcgcgcccctcaaccgcctccggatgcgcttctcggttagcctggcaaggaagataaagacatttgcaaccaagatggtaatcactagtgaaaatgatgaagacagaggaggtcaagaaaaagaaagtaaagaggagagtgtcttggcaatgctggggattatcgggaccattctgaacctgattgtgatcatatttgtctacatatacaccaccctgtgaatggcccagagcgtcctcagaggcctcagaatggccaaagacggaagtcctgcgtgtcggcgcatcactgaccagaccctgcgagaacaagcaggcttgacccgcacataccacccaatcaaatgcaccttcaaactttacaaaaggtcacacaaatagaccgatcctgctgcagggagcagacactaaagcacaatgattccaacaaaactcattcacagcactaggaactcaacgtctttggcagggggcccagaagaatgcttggaagaccagcctctgacaccatcagtgagcggatgggtgcagaaattcattattccagatcgctgacagatatcacatatttgaaaagatgaatagggcggacatggctcagatgtgtgtctcccaggacaagtgtttcatcttcacttgacgagctatttagtggaaaaaccacaggcgcagccctttgacaggcatcccattcatcaaaagtgtctaactatttgatactggggagataacttatttttcttttttcattggcttgacatgtgtatctgttcatgtcaaggtttataaatatatatttttaataaatgtgctctattttttagcatgaaccaaatacttggagaggcactcccagatccatagagctttccttagttttatctgctttgtcccctcctcccccaactacagatgttctgttgtggagccattctagtccttttgtctcatcttgagtcttttaccttgcgcttttgttctctctctctcctctctctctgcctctttggtctgaaggacattttcccatactgtcagccatggttttgggtgcatgttttaagattgtccattgagtggctttttgttgttatctcggagatataaaatgattgtgggcatgcagaccttagatgcaccctatctttactgagaattatgcatgaataagggctgagtgatagatcagcttaaaattaaaaggactacctttgaggaagaagagcgtggctatatttgcagatgaacttttgaacagaatattcagcttcttaccggcagcgttattgtttcattcttgtgaccattcgtttatcagattttgattttagcggtcatgtaccgcgagagttgggaagaacaagggggaaagctcgggattaggtgcattactccttcctttgcaagatacctgggatcctcctcaaaagcgggtggggtataaatgacacaagaactcccccaggagatctcatggtgattcaggctgtgaggacagccctgtgacaggtgacttttcagggacatgaggaggggatttaatgattgccctaaaggacttctgtatttttaaagcccctggtttacacccacatgaagctatttcctctctggcagggatggttgcataaaaacaaattagctcccttctggctccctgaaatgggcccttgcctggctacagtggcatggccttaaagagagggttagtattccttctgccattgccagctgtattagtctgttttcacactgctgaaaaagacatccccaagactgggcaatttacaaagaaagaggtttattggacttacagttccacgtggctgaggaggcctcacaattacggtggaaggtgaaaggcacgtctcacatggtggcagacaagagaagtgaacatgtgcaaggagactcccatttttaaaacagatctcgtgagactttttcactatcatgcaaacagcatgggaaacctgcccccgtgattcagttacctcccaccgggtccctcccacaacacatgggtattcaagatgagatttgggtggggttacagccaaactctatcaccagccttgcccctgggcagaagcagcagcagtctgcctggctggattcaaatgattctgaggcttctatagtctatgcctgcagatctctccctcacccatgctatagtgtctgaaattccaccattagagagtcatttcttgggctctgttaaatggaccaggctcttttataaagaaaatgcccctgagcagctggctctggcattgatttatgatatcttctcttccctgccagaaggaaggaagctaaggtgcatgtagggcgtactgtgtgcccaggcactgtgccagatgctttggatacttggagtcattgaattcttgtagtaaccctgtgagagagggagtcttttctccacattgtagaagaaggaaaaagggctcagagaggtcaagaaatgtccctgagatcacatggcttctagtggagtcaagatccaaacccaatgtgtctgattccttagcccttgggggtccggaggctgctgaacaagaaaggaggtggagaggagagaaagctgcaggcataccaccgcacacccttctccctcccctgtaaaaacaaccctgggaactccctggacactagcagaatatcatacactaaggataagggatgagaggaggctggttagaaataaagcagtgtcagggggaaggagctactcagtaggctctgtgtgattctagaaagactgtatgaaaattctgaacactgaacagaataaacaataaaggtgcaatgga

SEQ ID NO: 23608 - DNA, 662 bp, Homo sapiens
gttggggctgtcctggagaatctaaggtatctagtcatcatatatatgaaattcaacttttccattgtttgataaatgttcctgatgactcatgtgtctttagcactagtttatctgtcaaatggtcactggtaagagaaagagcgctcgctgtgaagggatgggattcctgaatggggatctggatacacagctgggtttgtgtgttcatgcatgtgcacaagcacctgcagctcagaatctacaaccaacagctcttagagtcagtgtggccttggtatactttgttttgtatcctttaggggtgtgtgtctccaactttaacgtacaagtcaatcacctggggatcttcttaaaatgcagattccaattccagggtggggtctgagattttatatttctaattagcgcttactcaggtgacatctgtgctgctggccagaggctcacactttggcaaatctctagtactgcaaaattgccgtctgagaaacatgcctccagattagctaagaaaggaagcgctaaccacaggggacttggtccccaagacccaaaaatatagagaacctaatttcaaacaagcagaaaggaacttctctggaaagagacgactcagctttcttcatttgtaataaaccaaatctgtaaacacttaaaat

SEQ ID NO: 23609 - DNA, 737 bp, Homo sapiens
cagtgctatgaatctgtccaaataaacatgggaagtagtgaaacaatgacaccacatgaaaaatatatccttattcattaaatagaatccaaaaaattctctggaatttaattgtagcaatgacgtgaggactgtctggtctattaagagaggatagtgacttccctcttcagttagtccagcacggatgagtgtgatcttaagtggctctacaattccacatgcatcgtcctaaatctagatacatgaaaatggatcatttcctatcaacccctcactcacacccgtggactctagggcatttgtggtagagttttatggtaattacaaacataagcagcttgtcagaattcaaataatcaattttaatttctgtctcaatcactaaagattactgaccactatgatgaaattaaggagtgctttctctggagattgcaaacacaagggcagagaggaagttagaagcttctattttgtggtcagttttgaaaaatacagtcaaaagcagtagccataatcaacattatagagaaccttaaattcataaagatgccaatttagctattagtgggcagttccatataaaactggtagctataatgcgtacacatgtctttgttaaggggctttgttgtaggaatggaagatgagggtatagtgattattgtgttatgatcaatgctattatttaaatatgtctttaaaaaatatcctgtacactcttgatactggag

SEQ ID NO: 23610 - DNA, 362 bp, Homo sapiens
ggttttgatcaatcactccagaatactgacctcttttccctttcccatgatgtgagggagcttatgagagtgaggcttcaaaatgcatcttagccccccgcagccacagctttgcatttgccccagctgtctcctcagacccttccaaacaatctgatacatgaaagcaccacaagatttgagtgtaggtggtagaatcctgtaagaaccaaaaattctcgataccaaggtagaattgtacagttattgataccaaggggcttctggaatggtattcctctatttgcggctggaaacttacccactcctcacctagaggcctgctgtttgacagacacctcagacctttctgtctgagcagg

SEQ ID NO: 23611 - DNA, 330 bp, Homo sapiens
gccccaaatcctctgaagtgagaaggcagggaccgttagctgaaatgctgttgattttagtggctgtgagcacacataaggatacaggtcatttcccttataattaggtcccagatcacttagtccattagagttttaaatgataaaaaaaaaaaaacaccttgacctgcacctggaaagaaagtaccaacacagtccagagtatagtacaggaacaagaagcagcctcaagtcatcctatttgtatccatgtctttaaacattgccttattccacatactatttaggaaaacttaattctgactggagatcagacatctttaggaaggt

SEQ ID NO: 23612 - DNA, 3060 bp, Homo sapiens
agcatccaccgcgcggcccaggactgtcagggtagtgggcgttgcgtgaggcgggtaaatgttcgcggaagcggcaaagacgacacggccttgtgggatggcggagtttaaggagaagcctgaggccccgactgagcagctggatgtcgcgtgcggccaggaaaacttgccggtgggcgcgtggcccccgggggccgcgccggcgcccttccagtacactcctgatcatgtagttggacctggagcagacattgatcccactcaaataacctttcccggatgcatttgtgtcaaaactccctgcctccctggcacttgctcctgtctccgccatggagagaactatgatgataactcatgccttagagatataggatctggaggaaagtatgcagagcctgtttttgaatgcaatgtcctgtgccgatgcagtgaccactgcagaaacagagtggtccagaaaggtctacagttccacttccaagtgttcaagacgcataaaaaaggctggggacttcgtaccttggaatttataccgaaaggaaggtttgtctgtgaatatgctggtgaggttttaggattctctgaagttcagagaagaattcacttacaaacaaaatccgactccaattacattatagccatcagggaacatgtttataatgggcaggtaatggaaacatttgttgaccctacttatataggaaatattggaagattccttaatcattcttgtgagccaaaccttttgatgattcctgtccgaattgactcaatggtacctaagttggcactttttgcagccaaagatattgtgccagaagaagaactctcttatgattattcaggaagatatcttaatctaacagtcagtgaagacaaagaaaggctagatcatgggaaactaaggaaaccttgttactgtggtgccaaatcatgtactgctttcctgccttttgacagttctctgtactgccccgtagaaaagtcgaacatcagttgtggaaatgagaaggaacccagcatgtgtggctcagccccttctgtgttcccctcctgcaagcgattgacccttgagactatgaaaatgatgttagacaaaaagcaaattcgagcaattttcttattcgagttcaaaatgggtcgtaaagcagcagaaacaactcgcaacatcaacaatgcatttggcccaggaactgctaacgaacgtacagtgcagtggtggttcaagaagttttgcaaaggagatgagagccttgaagatgaggagcgtagtggccggccatcagaagttgacaacgaccagttgagagcaatcatcgaagctgatccccttacaactacacgagaagttgctgaagaactcaatgtcaaccattctacggtcgttcgacatttgaagcaaattggaaaggtgaaaaagctcgataagtgggtgcctcatgagctgactgaaaatcaaaaaaatcgtcgttttgaagtgtcatcttctcttattctacgcaaccacaacgaaccatttctcgatcggattgtgacgtgtgatgaaaagtggattttatatgacaaccggcgacgatcagctcagtggttggatcaagaagaagctccaaagcacttcccaaagccaatcttgcacccaaaaaaggtcatggtcactatttggtggtctgctgctggtctgatccactacagctttctgaatcccggtgaaaccattacatctgagaagtatgctcaggaaatcgatgagatgaaccaaaaactgcaacgcctgcagctggcattggtcaacagaaagggcccaattcttctccacgacaatgcccgaccgcatgttgcacaacccacacttcaaaagttgaatgaattgggctatgaagttttgcctcatccaccgtattcacctgacctcttgccaaccaactaccacgtctttaagcatctcaacaactttttgcagggaaaacgcttccacaaccagcaggatgcagaaaatgctttccaagagttcgtcgaatcccaaagcacggatttttacgctacaggaataaaccaacttatttctcgttggcaaaaatgtgttgattgtaatggttcctattttgattaataaaaatgcgttgagcctagtaaaaatgatttaaaattcacagtccaaaaccgcagttagttttgcaccaacccaatatcttcatagattgaaatataaattaaaattgcatttgaagtagattccacggactttattaagaatgtagaaatgtggcctggcatggtggcttacaactgtaatcccagcactttgggaggcccaggcgggcagatcacttgagtccaattgttcaggaccagcctgggcaacatagtgagaccctgactctaataaaataattttttaaaaaaagattaaaacatgtaccttgaaaagcattttggcccaagaataataacgatcacacttgaagaacaaagcttttctttaaaaaaattttcctttaattttcaaattactattcacaaaatagcagtggctgttagattttgttcttggccaaatggaaaattttgccctaattaaaatgtagtcactctccagtgtgttaccattgaacaaatcactgaacctttccaagtcaaagtttccttagttgggaagattgagttaacacatgcaaaggggttagagcaatgcctgagtatatagaaagtattcaataaatgtaaattattagtcttgagaactgtctgtaggatgtgacccaaagttctcccttctattcaggtgtaattaggatataatgtccttcaaatggcagacttaaagggggaaaaagtcactaagaggtgaccagaagggttagagctgagcaagagaggttcctgccctgagccctgcattttagagtgcctaaggttacatacatacacacacacacgagttaaagaagacatggataccataaccagacacatgagttaaagaagacatggataccataaccaaagacattactaggaaagaaaactaataccaatatcccttttgaatacagaggc

SEQ ID NO: 23613 - DNA, 1725 bp, Homo sapiens
agcatccaccgcgcggcccaggactgtcagggtagtgggcgttgcgtgaggcgggtaaatgttcgcggaagcggcaaagacgacacggccttgtgggatggcggagtttaaggagaagcctgaggccccgactgagcagctggatgtcgcgtgcggccaggaaaacttgccggtgggcgcgtggcccccgggggccgcgccggcgcccttccagtacactcctgatcatgtagttggacctggagcagacattgatcccactcaaataacctttcccggatgcatttgtgtcaaaactccctgcctccctggcacttgctcctgtctccgccatggagagaactatgatgataactcatgccttagagatataggatctggaggaaagtatgcagagcctgtttttgaatgcaatgtcctgtgccgatgcagtgaccactgcagaaacagagtggtccagaaaggtctacagttccacttccaagtgttcaagacgcataaaaaaggctggggacttcgtaccttggaatttataccgaaaggaaggtttgtctgtgaatatgctggtgaggttttaggattctctgaagttcagagaagaattcacttacaaacaaaatccgactccaattacattatagccatcagggaacatgtttataatgggcaggtaatggaaacatttgttgaccctacttatataggaaatattggaagattccttaatcattcttgtgagccaaaccttttgatgattcctgtccgaattgactcaatggtacctaagttggcactttttgcagccaaagatattgtgccagaagaagaactctcttatgattattcaggaagatatcttaatctaacagtcagtgaagacaaagaaaggctagatcatgggaaactaaggaaaccttgttactgtggtgccaaatcatgtactgctttcctgccttttgacagttctctgtactgccccgtagaaaagtcgaacatcagttgtggaaatgagaaggaacccagcatgtgtggctcagccccttctgtgttcccctcctgcaagcgattgacccttgagggtgagtctgttcagtgataagcagcttgcccctccctatagtggaagacagtggttggctagctttacctctgcctagttacataagtttaactcaggaatgtggcagagactgcaagttgtccatcagtatcctttcccctttctgtaatagaattctccatttaacaaaagtacatgactacccagaatactcactttcctagttagatttgtcttagtgactgttctagttaataggatataagcaaaaatgacaagtccttaaatggagatatcctgcccttcacctcctctttcttcctgctggctggaatgtatacatgatgactggaactggagcagtcatcctagaccccaggatgaccctgggaaaggaagccattgcatagaaaaatcaacaaggttaaaaggagtctaggtgtctggtactgtagaacatcctgtcagtcgtgatctgacacctttgtactttcaggtgagaaatagtctctcccttgcttaagtcactgttattgtaagttttctagcactaacatcgaacctaataatgatccaagaaacccttgtggctgcatacctaaaccctgcttgccaaccaattttaacagtaataaagctgactttttgatttcagtctgactcct

SEQ ID NO: 23614 - DNA, 1383 bp, Homo sapiens
agcatccaccgcgcggcccaggactgtcagggtagtgggcgttgcgtgaggcgggtaaatgttcgcggaagcggcaaagacgacacggccttgtgggatggcggagtttaaggagaagcctgaggccccgactgagcagctggatgtcgcgtgcggccaggaaaacttgccggtgggcgcgtggcccccgggggccgcgccggcgcccttccaggttctctgtactgccccgtagaaaagtcgaacatcagttgtggaaatgagaaggaacccagcatgtgtggctcagccccttctgtgttcccctcctgcaagcgattgacccttgagactatgaaaatgatgttagacaaaaagcaaattcgagcaattttcttattcgagttcaaaatgggtcgtaaagcagcagaaacaactcgcaacatcaacaatgcatttggcccaggaactgctaacgaacgtacagtgcagtggtggttcaagaagttttgcaaaggagatgagagccttgaagatgaggagcgtagtggccggccatcagaagttgacaacgaccagttgagagcaatcatcgaagctgatccccttacaactacacgagaagttgctgaagaactcaatgtcaaccattctacggtcgttcgacatttgaagcaaattggaaaggtgaaaaagctcgataagtgggtgcctcatgagctgactgaaaatcaaaaaaatcgtcgttttgaagtgtcatcttctcttattctacgcaaccacaacgaaccatttctcgatcggattgtgacgtgtgatgaaaagtggattttatatgacaaccggcgacgatcagctcagtggttggatcaagaagaagctccaaagcacttcccaaagccaatcttgcacccaaaaaaggtcatggtcactatttggtggtctgctgctggtctgatccactacagctttctgaatcccggtgaaaccattacatctgagaagtatgctcaggaaatcgatgagatgaaccaaaaactgcaacgcctgcagctggcattggtcaacagaaagggcccaattcttctccacgacaatgcccgaccgcatgttgcacaacccacacttcaaaagttgaatgaattgggctatgaagttttgcctcatccaccgtattcacctgacctcttgccaaccaactaccacgtctttaagcatctcaacaactttttgcagggaaaacgcttccacaaccagcaggatgcagaaaatgctttccaagagttcgtcgaatcccaaagcacggatttttacgctacaggaataaaccaacttatttctcgttggcaaaaatgtgttgattgtaatggttcctattttgattaataaaaatgcgttgagcct

SEQ ID NO: 23615 - DNA, 2368 bp, Homo sapiens
  misc_feature (349)..(349): n is a, c, g, or t
agcatccaccgcgcggcccaggactgtcagggtagtgggcgttgcgtgaggcgggtaaatgttcgcggaagcggcaaagacgacacggccttgtgggatggcggagtttaaggagaagcctgaggccccgactgagcagctggatgtcgcgtgcggccaggaaaacttgccggtgggcgcgtggcccccgggggccgcgccggcgcccttccaggttctctgtactgccccgtagaaaagtcgaacatcagttgtggaaatgagaaggaacccagcatgtgtggctcagccccttctgtgttcccctcctgcaagcgattgacccttgagtgactatgaaaatgagtgnatgatcaaaaacacgcatagactctcgaacgcaacagtattctcttaagtcttccgatgcttccaattagactggggggctcgttagacatggccagggcaagaaagaccagaactccggcacatcgagtcgaaccaatgcatttggcccaggaactgctaacgaacgtacagtgcagtggtggttcaagaagttttgcaaaggagatgagagccttgaagatgaggagcgtagtggccggccatcagaagttgacaacgaccagttgagagcaatcatcgaagctgatccccttacaactacacgagaagttgctgaagaactcaatgtcaaccattctacggtcgttcgacatttgaagcaaattggaaaggtgaaaaagctcgataagtgggtgcctcatgagctgactgaaaatcaaaaaaatcgtcgttttgaagtgtcatcttctcttattctacgcaaccacaacgaaccatttctcgatcggattgtgacgtgtgatgaaaagtggattttatatgacaaccggcgacgatcagctcagtggttggatcaagaagaagctccaaagcacttcccaaagccaatcttgcacccaaaaaaggtcatggtcactatttggtggtctgctgctggtctgatccactacagctttctgaatcccggtgaaaccattacatctgagaagtatgctcaggaaatcgatgagatgaaccaaaaactgcaacgcctgcagctggcattggtcaacagaaagggcccaattcttctccacgacaatgcccgaccgcatgttgcacaacccacacttcaaaagttgaatgaattgggctatgaagttttgcctcatccaccgtattcacctgacctcttgccaaccaactaccacgtctttaagcatctcaacaactttttgcagggaaaacgcttccacaaccagcaggatgcagaaaatgctttccaagagttcgtcgaatcccaaagcacggatttttacgctacaggaataaaccaacttatttctcgttggcaaaaatgtgttgattgtaatggttcctattttgattaataaaaatgcgttgagcctagtaaaaatgatttaaaattcacagtccaaaaccgcagttagttttgcaccaacccaatatcttcatagattgaaatataaattaaaattgcatttgaagtagattccacggactttattaagaatgtagaaatgtggcctggcatggtggcttacaactgtaatcccagcactttgggaggcccaggcgggcagatcacttgagtccaattgttcaggaccagcctgggcaacatagtgagaccctgactctaataaaataattttttaaaaaaagattaaaacatgtaccttgaaaagcattttggcccaagaataataacgatcacacttgaagaacaaagcttttctttaaaaaaattttcctttaattttcaaattactattcacaaaatagcagtggctgttagattttgttcttggccaaatggaaaattttgccctaattaaaatgtagtcactctccagtgtgttaccattgaacaaatcactgaacctttccaagtcaaagtttccttagttgggaagattgagttaacacatgcaaaggggttagagcaatgcctgagtatatagaaagtattcaataaatgtaaattattagtcttgagaactgtctgtaggatgtgacccaaagttctcccttctattcaggtgtaattaggatataatgtccttcaaatggcagacttaaagggggaaaaagtcactaagaggtgaccagaagggttagagctgagcaagagaggttcctgccctgagccctgcattttagagtgcctaaggttacatacatacacacacacacgagttaaagaagacatggataccataaccagacacatgagttaaagaagacatggataccataaccaaagacattactaggaaagaaaactaataccaatatcccttttgaatacagaggc

SEQ ID NO: 23616 - DNA, 2361 bp, Homo sapiens
gcctcccagtcgcgaccttttgtcttctcttacagcgcacccgttggtgcgcgggaataggtgtgcatgccccggcctgggcctttttctgttgacccacggcatcaccttagcaagggtgttgtccttttcagtccattccctgaagcgcagaaccggaggccttgtgagaacctggctttttgtccagtcctgtcctcagaactcaaggaggcatcacggggggagtcatttacctccctggtctcaggtgtctctcacaggttctctgtactgccccgtagaaaagtcgaacatcagttgtggaaatgagaaggaacccagcatgtgtggctcagccccttctgtgttcccctcctgcaagcgattgacccttgagactatgaaaatgatgttagacaaaaagcaaattcgagcaattttcttattcgagttcaaaatgggtcgtaaagcagcagaaacaactcgcaacatcaacaatgcatttggcccaggaactgctaacgaacgtacagtgcagtggtggttcaagaagttttgcaaaggagatgagagccttgaagatgaggagcgtagtggccggccatcagaagttgacaacgaccagttgagagcaatcatcgaagctgatccccttacaactacacgagaagttgctgaagaactcaatgtcaaccattctacggtcgttcgacatttgaagcaaattggaaaggtgaaaaagctcgataagtgggtgcctcatgagctgactgaaaatcaaaaaaatcgtcgttttgaagtgtcatcttctcttattctacgcaaccacaacgaaccatttctcgatcggattgtgacgtgtgatgaaaagtggattttatatgacaaccggcgacgatcagctcagtggttggatcaagaagaagctccaaagcacttcccaaagccaatcttgcacccaaaaaaggtcatggtcactatttggtggtctgctgctggtctgatccactacagctttctgaatcccggtgaaaccattacatctgagaagtatgctcaggaaatcgatgagatgaaccaaaaactgcaacgcctgcagctggcattggtcaacagaaagggcccaattcttctccacgacaatgcccgaccgcatgttgcacaacccacacttcaaaagttgaatgaattgggctatgaagttttgcctcatccaccgtattcacctgacctcttgccaaccaactaccacgtctttaagcatctcaacaactttttgcagggaaaacgcttccacaaccagcaggatgcagaaaatgctttccaagagttcgtcgaatcccaaagcacggatttttacgctacaggaataaaccaacttatttctcgttggcaaaaatgtgttgattgtaatggttcctattttgattaataaaaatgcgttgagcctagtaaaaatgatttaaaattcacagtccaaaaccgcagttagttttgcaccaacccaatatcttcatagattgaaatataaattaaaattgcatttgaagtagattccacggactttattaagaatgtagaaatgtggcctggcatggtggcttacaactgtaatcccagcactttgggaggcccaggcgggcagatcacttgagtccaattgttcaggaccagcctgggcaacatagtgagaccctgactctaataaaataattttttaaaaaaagattaaaacatgtaccttgaaaagcattttggcccaagaataataacgatcacacttgaagaacaaagcttttctttaaaaaaattttcctttaattttcaaattactattcacaaaatagcagtggctgttagattttgttcttggccaaatggaaaattttgccctaattaaaatgtagtcactctccagtgtgttaccattgaacaaatcactgaacctttccaagtcaaagtttccttagttgggaagattgagttaacacatgcaaaggggttagagcaatgcctgagtatatagaaagtattcaataaatgtaaattattagtcttgagaactgtctgtaggatgtgacccaaagttctcccttctattcaggtgtaattaggatataatgtccttcaaatggcagacttaaagggggaaaaagtcactaagaggtgaccagaagggttagagctgagcaagagaggttcctgccctgagccctgcattttagagtgcctaaggttacatacatacacacacacacgagttaaagaagacatggataccataaccagacacatgagttaaagaagacatggataccataaccaaagacattactaggaaagaaaactaataccaatatcccttttgaatacagaggc

SEQ ID NO: 23617 - DNA, 2131 bp, Homo sapiens
agcatccaccgcgcggcccaggactgtcagggtagtgggcgttgcgtgaggcgggtaaatgttcgcggaagcggcaaagacgacacggccttgtgggatggcggagtttaaggagaagcctgaggccccgactgagcagctggatgtcgcgtgcggccaggaaaacttgccggtgggcgcgtggcccccgggggccgcgccggcgcccttccagtacactcctgatcatgtagttggacctggagcagacattgatcccactcaaataacctttcccggatgcatttgtgtcaaaactccctgcctccctggcacttgctcctgtctccgccatggagagaactatgatgataactcatgccttagagatataggatctggaggaaagtatgcagagcctgtttttgaatgcaatgtcctgtgccgatgcagtgaccactgcagaaacagagtggtccagaaaggtctacagttccacttccaagtgttcaagacgcataaaaaaggctggggacttcgtaccttggaatttataccgaaaggaaggtttgtctgtgaatatgctggtgaggttttaggattctctgaagttcagagaagaattcacttacaaacaaaatccgactccaattacattatagccatcagggaacatgtttataatgggcaggtaatggaaacatttgttgaccctacttatataggaaatattggaagattccttaatcattcttgtgagccaaaccttttgatgattcctgtccgaattgactcaatggtacctaagttggcactttttgcagccaaagatattgtgccagaagaagaactctcttatgattattcaggaagatatcttaatctaacagtcagtgaagacaaagaaaggctagatcatgggaaactaaggaaaccttgttactgtggtgccaaatcatgtactgctttcctgccttttgacagttctctgtactgccccgtagaaaagtcgaacatcagttgtggaaatgagaaggaacccagcatgtgtggctcagccccttctgtgttcccctcctgcaagcgattgacccttgagactatgaaaatgatgttagacaaaaagcaaattcgagcaattttcttattcgagttcaaaatgggtcgtaaagcagcagaaacaactcgcaacatcaacaatgcatttggcccaggaactgctaacgaacgtacagtgcagtggtggttcaagaagttttgcaaaggagatgagagccttgaagatgaggagcgtagtggccggccatcagaagttgacaacgaccagttgagagcaatcatcgaagctgatccccttacaactacacgagaagttgctgaagaactcaatgtcaaccattctacggtcgttcgacatttgaagcaaattggaaaggtgaaaaagctcgataagtgggtgcctcatgagctgactgaaaatcaaaaaaatcgtcgttttgaagtgtcatcttctcttattctacgcaaccacaacgaaccatttctcgatcggattgtgacgtgtgatgaaaagtggattttatatgacaaccggcgacgatcagctcagtggttggatcaagaagaagctccaaagcacttcccaaagccaatcttgcacccaaaaaaggtcatggtcactatttggtggtctgctgctggtctgatccactacagctttctgaatcccggtgaaaccattacatctgagaagtatgctcaggaaatcgatgagatgaaccaaaaactgcaacgcctgcagctggcattggtcaacagaaagggcccaattcttctccacgacaatgcccgaccgcatgttgcacaacccacacttcaaaagttgaatgaattgggctatgaagttttgcctcatccaccgtattcacctgacctcttgccaaccaactaccacgtctttaagcatctcaacaactttttgcagggaaaacgcttccacaaccagcaggatgcagaaaatgctttccaagagttcgtcgaatcccaaagcacggatttttacgctacaggaataaaccaacttatttctcgttggcaaaaatgtgttgattgtaatggttcctattttgattaataaaaatgcgttgagcct

SEQ ID NO: 23618 - DNA, 1774 bp, Homo sapiens
gcctcccagtcgcgaccttttgtcttctcttacagcgcacccgttggtgcgcgggaataggtgtgcatgccccggcctgggcctttttctgttgacccacggcatcaccttagcaagggtgttgtccttttcagtccattccctgaagcgcagaaccggaggccttgtgagaacctggctttttgtccagtcctgtcctcagaactcaaggaggcatcacggggggagtcatttacctccctggtctcaggtgtctctcacagtacactcctgatcatgtagttggacctggagcagacattgatcccactcaaataacctttcccggatgcatttgtgtcaaaactccctgcctccctggcacttgctcctgtctccgccatggagagaactatgatgataactcatgccttagagatataggatctggaggaaagtatgcagagcctgtttttgaatgcaatgtcctgtgccgatgcagtgaccactgcagaaacagagtggtccagaaaggtctacagttccacttccaagtgttcaagacgcataaaaaaggctggggacttcgtaccttggaatttataccgaaaggaaggtttgtctgtgaatatgctggtgaggttttaggattctctgaagttcagagaagaattcacttacaaacaaaatccgactccaattacattatagccatcagggaacatgtttataatgggcaggtaatggaaacatttgttgaccctacttatataggaaatattggaagattccttaatcattcttgtgagccaaaccttttgatgattcctgtccgaattgactcaatggtacctaagttggcactttttgcagccaaagatattgtgccagaagaagaactctcttatgattattcaggaagatatcttaatctaacagtcagtgaagacaaagaaaggctagatcatgggaaactaaggaaaccttgttactgtggtgccaaatcatgtactgctttcctgccttttgacagttctctgtactgccccgtagaaaagtcgaacatcagttgtggaaatgagaaggaacccagcatgtgtggctcagccccttctgtgttcccctcctgcaagcgattgacccttgagggtgagtctgttcagtgataagcagcttgcccctccctatagtggaagacagtggttggctagctttacctctgcctagttacataagtttaactcaggaatgtggcagagactgcaagttgtccatcagtatcctttcccctttctgtaatagaattctccatttaacaaaagtacatgactacccagaatactcactttcctagttagatttgtcttagtgactgttctagttaataggatataagcaaaaatgacaagtccttaaatggagatatcctgcccttcacctcctctttcttcctgctggctggaatgtatacatgatgactggaactggagcagtcatcctagaccccaggatgaccctgggaaaggaagccattgcatagaaaaatcaacaaggttaaaaggagtctaggtgtctggtactgtagaacatcctgtcagtcgtgatctgacacctttgtactttcaggtgagaaatagtctctcccttgcttaagtcactgttattgtaagttttctagcactaacatcgaacctaataatgatccaagaaacccttgtggctgcatacctaaaccctgcttgccaaccaattttaacagtaataaagctgactttttgatttcagtctgactcct

SEQ ID NO: 23619 - DNA, 2196 bp, Homo sapiens
agcatccaccgcgcggcccaggactgtcagggtagtgggcgttgcgtgaggcgggtaaatgttcgcggaagcggcaaagacgacacggccttgtgggatggcggagtttaaggagaagcctgaggccccgactgagcagctggatgtcgcgtgcggccaggaaaacttgccggtgggcgcgtggcccccgggggccgcgccggcgcccttccagactatgaaaatgatgttagacaaaaagcaaattcgagcaattttcttattcgagttcaaaatgggtcgtaaagcagcagaaacaactcgcaacatcaacaatgcatttggcccaggaactgctaacgaacgtacagtgcagtggtggttcaagaagttttgcaaaggagatgagagccttgaagatgaggagcgtagtggccggccatcagaagttgacaacgaccagttgagagcaatcatcgaagctgatccccttacaactacacgagaagttgctgaagaactcaatgtcaaccattctacggtcgttcgacatttgaagcaaattggaaaggtgaaaaagctcgataagtgggtgcctcatgagctgactgaaaatcaaaaaaatcgtcgttttgaagtgtcatcttctcttattctacgcaaccacaacgaaccatttctcgatcggattgtgacgtgtgatgaaaagtggattttatatgacaaccggcgacgatcagctcagtggttggatcaagaagaagctccaaagcacttcccaaagccaatcttgcacccaaaaaaggtcatggtcactatttggtggtctgctgctggtctgatccactacagctttctgaatcccggtgaaaccattacatctgagaagtatgctcaggaaatcgatgagatgaaccaaaaactgcaacgcctgcagctggcattggtcaacagaaagggcccaattcttctccacgacaatgcccgaccgcatgttgcacaacccacacttcaaaagttgaatgaattgggctatgaagttttgcctcatccaccgtattcacctgacctcttgccaaccaactaccacgtctttaagcatctcaacaactttttgcagggaaaacgcttccacaaccagcaggatgcagaaaatgctttccaagagttcgtcgaatcccaaagcacggatttttacgctacaggaataaaccaacttatttctcgttggcaaaaatgtgttgattgtaatggttcctattttgattaataaaaatgcgttgagcctagtaaaaatgatttaaaattcacagtccaaaaccgcagttagttttgcaccaacccaatatcttcatagattgaaatataaattaaaattgcatttgaagtagattccacggactttattaagaatgtagaaatgtggcctggcatggtggcttacaactgtaatcccagcactttgggaggcccaggcgggcagatcacttgagtccaattgttcaggaccagcctgggcaacatagtgagaccctgactctaataaaataattttttaaaaaaagattaaaacatgtaccttgaaaagcattttggcccaagaataataacgatcacacttgaagaacaaagcttttctttaaaaaaattttcctttaattttcaaattactattcacaaaatagcagtggctgttagattttgttcttggccaaatggaaaattttgccctaattaaaatgtagtcactctccagtgtgttaccattgaacaaatcactgaacctttccaagtcaaagtttccttagttgggaagattgagttaacacatgcaaaggggttagagcaatgcctgagtatatagaaagtattcaataaatgtaaattattagtcttgagaactgtctgtaggatgtgacccaaagttctcccttctattcaggtgtaattaggatataatgtccttcaaatggcagacttaaagggggaaaaagtcactaagaggtgaccagaagggttagagctgagcaagagaggttcctgccctgagccctgcattttagagtgcctaaggttacatacatacacacacacacgagttaaagaagacatggataccataaccagacacatgagttaaagaagacatggataccataaccaaagacattactaggaaagaaaactaataccaatatcccttttgaatacagaggc

SEQ ID NO: 23620 - DNA, 414 bp, Homo sapiens
gtccctgggattcggcttgagggctaccgcagtctggcccggccggccctgactgatacgggctctgaggtttccaggtctgggcaggacaaggtccctggtgacggaagcaggtgagcctcctgcaggagagcaggctgaggttgtgggatctggagttttgctggggacgtgtttgcagcagagttgggatttgcaggggagggccgggctaagctttcactgctagagtcctctgcatgtacactgtgaagccatagtaatcccaccggctgacgtgtgtctgtactcaccctgtgcagggcccttctgaacgagtctcacctgtattaactttgggtccttggggcagtatcagggaggctctgtcctcgccccattttacccaccacggaattgaggcacagtgaagcc

SEQ ID NO: 23621 - DNA, 460 bp, Homo sapiens
gacggcagggggtgctcgtctctcaccactggagctgtcccctcttcaggcctctgagggagggcaggctgtcagctgtgggctgggggaggccgtgtgcctgctgcaatattgatgggaatgcagtccgcaggggctgctcacactggccgcctccgagctggcctcagaagaggtggtgaaatccatcatcttccccatgacagcacagcctgtatctgcccccaggggactcgtgcattccaagagcagcagcagcttggggagcaatgctggacaggagtgctgagacctgccctgtgggaggtgccccctcggtacctcctttgtgttgggtctgtggggcccgcccagctcgggctctgctcagggtgctagggaaggccagccctgaccctccctgggccttggggcccctctccacgcaatgagggatgcggtcttgaaggccaggggctgc

SEQ ID NO: 23622 - DNA, 448 bp, Homo sapiens
cattgcctaagtatgtgtctgctctttggattctcatttgaaccaattggaacatcttatttgttccctaattagagttatagatagaggtgttgattttatatttgcatgagagacacagtgccacctttttgtttgtttctttcagttatcctttaacagcttgaactccaaatttagcctgagtttgaatcccatttactgttgcgatttgggtcacggaattttattttttaacctaagcgtgtgttacttcctataaaaaggaatttatagtattattttctttgcatggttagtgtgaggattaaaagagatgttgtaagttacacacttctcatagtacctcgtataacataagaattctttttaaaaaactctttattagaagactgtgggcaactaattttgccttcctgagacttcatttcatattgttaaaaaaaaa

SEQ ID NO: 23623 - DNA, 732 bp, Homo sapiens
ctgaggcctgcagaccctccctaggatgatttttaaagtaatattcactcagtgtattcattagttcctccaaaagcccttttgcataaacagctcgtgcattcctgagaattcagtgcaaacagagggagtattatcaacccagttttacaggtgagcaagctgaagaggcagtgaatgttccatgagctgcaagcagtggctgcctggtctctgctccggggttctaaccctttcttgtcttttaagctaagggagctgtgagactgagtttagacaggctgggggtcaatatgctgggtatttatataagcacatactcttaagtttagatctgtgctacaaaccacgacctagaagtacacaacactgtcctgtggaggcagcctggaggggtggaaataataataataataacaacagctacaataattggatgcctcctccatgccccatactattctaagcatttttcagatcttaactcatttaatcttcactataaccctgtaagatggatgctattattacccccattttacagctgaggaaactaaagcacagagaggttgaataacatgccaagaacacacagccagtgaacagccgagcttggacagtgactccaagcttctgacccagtttacagctgaggaaacatctaatgtgtgacaaagctgctgtcaaacctcattaggatgagttcatgctcttaaagttacagaaaaaaaa

SEQ ID NO: 23624 - DNA, 731 bp, Homo sapiens
agtagacgctgcaccggtctccttttggtcccggtgtctgtgtcacacacggcgggtcctgccgaaatgcacttctaggaaagggaatgacctgcccgtgtgataatgcctcgtcagtgttcttgggcttttgtgagtctcccctaaatgcaagctgtcaaattattttctggtatttgttcactcctgttccaatagtgacagatgatatccgaacatagaaaatgacttggcttctaagtttgaaatctagacagttttattaaccaaaggaatttactaatcacgcgttaatcgtttcaattaagtaattttcccattctgacaagttctgttttataccaaaaaaaaggaaaaacacaaaaaaatcacaagcaatgtaatatctctgacaaataaacacctggcgtcctgacagtaaatttacaggttgtaggctgcggatggccagccagccaatggaatgaaatagctctgggggtgtgtactggtcctggctagccctgaatttgagcttcaggaaaaatatagtacgtgaagaaaggggtcagataatgtttggtagtcactgggttatcctgtggtttaaatcatttaatgtctgtagatttggcctctgtagtcagattgctttcttcgagcaaataagagcttttttccccccaatacattgcatcatacctctttagtaacataaaatggaaaggacaaaccacttttgtctactgtaa

SEQ ID NO: 23625 - DNA, 982 bp, Homo sapiens
aaaaaaacacaaagatcagaagccttcagatagagggtggtattctggtaaagaagaaagagataagggacgctaccttgcttttctggcacaggaagcacatgataaagcatgctcagatgagctggaacagatatagctacctggttcgtgtaaataagaataatcaaggccccagagtgtgtatgcttccaggtggaggagaaaggggaatctcccaaaatttaaaaacaaattggaagaataaccaggacagccaagtgaagcagccacagggacccaagcagtcgaggtctttaatgtgcctggagatgactctctgctattcatgaatcttgctattgcacaaaccctatcaagagctgctgcttcccttccagccagaaaagtggtaagcggagcaagtgccaagcagaacagaccttatcatctgggtaacagacttctcagtgttggtgctgtgtctgttagagccttagagcaagttaagcacttccttggtgtgggtaaagaataaaggggaaagaaactactttagagcctctttttctcccaactcatatttttgataggaaaaacagaaaacccatccagttcttcagaaattgctttctaggcattaatactactttactatctatactgtttagttattcctttctttacccacctaaactatccatctaatccaggattccctcactctttttttttagttactaatcattttatgaaaataatgtatttataagtattttcttaaggtttgtgaagagtatttgcattgtgtcttcattttaatgtgtttgcaatcgctccgctccaggaagaacggaaatgctgtcttgtgagcatgaagtgaacgggctgttttgctccagccacttttcttgtacaaccacatggatggattagatgtcctcaggtcttttccatcttcagtttctatgactgtggaataaatgttcagatagaaacttca

SEQ ID NO: 23626 - DNA, 595 bp, Homo sapiens
  misc_feature (591)..(591): n is a, c, g, or t
gttcggtggaaataagcattctgttatttttttcttagcacattttttgtcttctcttccattcagttatgttgaaagctacgtgttggatctgttttttagttatgacattagatcttcatctgagattatctaaactacgttggttttcttttgattacaatctctttttttttttaatctgctaacacaagctcatgtttatctagaaaatgcgctttctcctcaaagtcatgaatcagcatgaatttcctttgagttagttcaaatcatccagaaattaacaaatttcaaaaaagaaaaaatatactaaaatgtagtcaaagctttataagaatactttatgtgctatatctcagctagtcactgagtagctgtcataaacctatgacataaacctactgtcatataccgatgacagtagagtattgaaaaaccaggtgcaccaggttcttgttttcattcttgataggttctaagttcattaaaccagtctcgcagttactcagagaatcacaaaaccaagtgttcctcttattatcttgcttagctcattttgggtaaaatgcatcaaacggcagaatgaaaaanaaaa

SEQ ID NO: 23627 - DNA, 574 bp, Homo sapiens
ctcctccctatgctgtctcactctcccagtccactctgcactgcagagttctaatacaaatcacgctgtgtcacttgcctgcctaatgggctccttgatggtcaccaggagaaagccaaactctgctgcctggcacatctgccagcttgcagcctgatgccattctagcctcgcctcctgccatgtctcacttagttccagccaaatggaacttgtgtgattggttccacaccatggtgccttcacttatgctattactgatcccagaagcccaacctttcttctcatcctgttccttcaggaagccttccctgacaccaccagtctcctctggatgtccttcttcatgttccgtcaaactctttttttttgagacagagtctcgctctgttgcccaggctggggtgcagtggcgcgatctcggctcactgccatctctgcctcccgggttcaagcgattctcctgcctcagcctccaagtagctggaactacaggtgcacaccacgccaccacacccagctaatttttgtaattttagtagagacagggtttcaccatattggtcaggctggt

SEQ ID NO: 23628 - DNA, 448 bp, Homo sapiens
ccgtaatacaatactcaattttttattttactttaatttttttggtagagatgaggttttgctgtgttgcccaggctggtctcgaactcctgtccttggcctcccaaagtgctgggattacagatgtgagccaccgtgcccagcaagtcaaattcttataattcatgttagaatggagaagatagagataccttaggaagccaactgagagaaagtatcatgtggttaccagatttcatatataatctggacctttagtagctttatagacagttgaatccatttttctgatgagagagagagctttgtagtgatggaggtatggtgctacaggccaggttaccttctttgggctactgagatgcacaggaggccagtatagtacttggagggtttgctggtaagtatggaaagcctgttgaactatcctagtgcttaggctagggta

SEQ ID NO: 23629 - DNA, 265 bp, Homo sapiens
caaagttatcccagttttagcactaaaagtcctgtgtcccagggtacctcttagtcctggacaatccagaatagcctcaccctaaaacactataaataatcccctctttctcccaaatatttgacctctctcttcccaatgaattctttgtatgtaattgtgtcaagtctctcccattaaaacaaaacaacaaaaaaaacaaaaaccctccttcgcttccacaattctccatcaaccttggctctttctgccccctgacaagcaa

SEQ ID NO: 23630 - DNA, 262 bp, Homo sapiens
aacaaaactccatctgaaaaaaaaaaaagaaagtgaacaaggctttaaggtggagcacactagaaacatcttgctatttccacgtgtctctttgtcactacactccttaaatacacttaaatagctcatattaacaacagacacaaccaatgtgaaacctcttggggctttataagaagtttcctaaagttaatgctgtagattcctcatgatcatttcaaaactaatgtgatttctttagggtacctttaattacacttat

SEQ ID NO: 23631 - DNA, 288 bp, Homo sapiens
acagctctgtgaggagtcactgggcagccttgacatctgcctgcaatgcttccctctccacccctccctgggtgcacggccagtcagagaccttctggtggcctggcctctcaggagccatgtccagttgatctgcatccgataaaaaattggccctagactcctctaagcatcaaaaacattgtagtactactcctaccatccccactattgccaaccccagacaaccaacactgaactgtgacgctgaaattaaaataatcactttgtagatttgatgattgtaag

SEQ ID NO: 23632 - DNA, 353 bp, Homo sapiens
ggaaggctgaggcatgagaatttcttgaacccgggaggttgcagtgagcggagatcacaccactgtactgtggcctgggcaacagagcaagactccatctcaaaaaaaaataataataataataaatactagctttgggatagtggtcgtggttgcttctgagaaaggtagaaaagagatggaatgaggagagggaatacgaagggtatttcacctgtatctggaatattttgcttcgttaaaattttttgaagcaaatacggcacaatactaagatttgctaaagtcgagcagtgggtacacaggtgtttgttatattctgtgtaattttgtttgttttaaatgtgtcacaa

SEQ ID NO: 23633 - DNA, 414 bp, Homo sapiens
tggacacaggggctgccgttggaggaggttgtaatgtcattgtcctcctgtggaagttaactgtggagaattaactagagaccagcgctgagagagaattaattggataaaagttctatctaggacagtccttgagcgtaattttgtgaagcaaacacaagacaacaacaaaacgagtaaaacctaaacacacatccacacactcactgaaagattcagagattgcacagaacacaaagacttttctggtaataaaatctccctatcctaattttctagaaaaaaagctgttgaagccaccgcgcagttcttacaagacataacacaaatcttccacacaaaggcagaaatacagtatcaacctttgtgaggagtacagcaaataaatgatgtttctttagggtcctaggcaac

SEQ ID NO: 23634 - DNA, 374 bp, Homo sapiens
ccccttccccactccccgacccctctactcatgctcttgccatgtgatgtcctgctcctccttcaccttctgccatgattggaagcttcctgaggcctcaccaaaacagatgctgatgccatgctttctatacactctgcagaaccgtgtgccaattaaacttcttttattaattacccagcctcagatattcctttagagtaatgcaagaatggactaacacagcaggtgtgatcattggatgaggaaggctctcggaatcattccaggtgcctgctctagactcttggtgttgctcttctttccttcatgaccttgaactctctgactccagcagtcccctctgcacatgcctgaactgcttcagggcaccc

SEQ ID NO: 23635 - DNA, 1818 bp, Homo sapiens
atttgcaacaagtcctttgacttttggagccacagataaaagtcggtgcgctggtcctgcctcattaatccagggcttgcagtgctttgaagcccagtcgttgttggcctttgtgatgaaaatacctgtgaagatgagtggccggggaccaaaaggaagaattggaagcgcgatggttggatggaacaaaaagatgttagctcacccacagatctcatagtgattaaaatgaaagaacgttcaccccaaatccttatgatgtggtttaaaaataaagagttatagataagaccctattttcgaaaacaaagtgttaaatccccccacccccacccccgggccccgtgttaccttttgaaaggttgagcgaaagtgagaatgcaaggttttcctgaacgacgttgcttagaggtaacgcggggctgtgatgtctgttaatgggcatccttgcaaaagatgtcgtttgttgctagtgacgtttaaggtttgaacctgctgttcgtatctactgcattttatgtagtaacacatttaaaacaattaaattgtgcttaactgcaatgttcctaaaagccttatttttttgtatttcccaggtccctatgagaagtttaatgaaatattactggctaatgtggttttcccacctccattaaccatcatattcgtgactagttgctcaggctttttaaaaaacaaggaaactcaagagatctttactgttttatttttcaggaatgactttgtgcctctggtttaaatattagaaaacagaaaaataccagttggctttaaatgtttgctattcagttaaagactggatttgtttaaatgtaatacattgtaatcaaaggttaagtttttaaatctttgtgtttttaaaattgtgcttatgttttaaataataatacttgagttgtgtccattacaaatcagatacattcctcgagtgcaacacaggttctaacgcttataagacctctaggaaatttttttccttttatttatcaaatgaatataactgcgtttaaaagagggctgtaactgcaaggaacaacgattgagtgttcaagactgcctttattagctttacttacaagataatacattggttcacctttctatgcacaataaaagaagaattgggtctcaattttagaagttaagcttttttcagtacctcttaatgaaatatttttaggcttttgcatacttaatttgagagggacatctcccttatccggatagctgggtggattcttatccctgtgcagtagcaagtgctgactgggcaggaggtaaaaagagattagttttgtggacccaatgagggactccttttaaatgtaagttttcaatgatttgtataaggtacctactgcattacgtctaacacagttgtataattttaccagtaaaatctttatatgtttgaatagattaatggcgaggataaatagaggcattgtttttgctactttgcatatcattggccaatcaatgattgattgatttgtatatccttttacattaccgcttcttgctgtggtagtttctgtaccaaaaaaaaaaaaaaggtcacaaaaggatagttggttattttcagagcttatcttgtttttaaaaatatgttactgtcattgaaatatttttccaaaatcttaccagaattagagtgatttaatctttactagctggcgaccttatttctactagttgctatagtagactagaactcttgttttattgtcgttgagtaaaatactaaatagtagccagttttgacttactttggcttcaaagctgttgtaaacatta

SEQ ID NO: 23636 - DNA, 736 bp, Homo sapiens
tactaaattcgcggccgcgtcgaccattggttcacctttctatgcacaataaaagaagaattgggtctcaattttagaagttaagcttttttcagtacctcttaatgaaatatttttaggcttttgcatacttaatttgagagggacatctcccttatccggatagctgggtggattcttatccctgtgcagtagcaagtgctgactgggcaggaggtaaaaagagattagttttgtggacccaatgagggactccttttaaatgtaagttttcaatgatttgtataaggtacctactgcattacgtctaacacagttgtataattttaccagtaaaatctttatatgtttgaatagattaatggcgaggataaatagaggcattgtttttgctactttgcatatcattggccaatcaatgattgattgatttgtatatccttttacattaccgcttcttgctgtggtagtttctgtaccaaaaaaaaaaaaaaggtcacaaaaggatagttggttattttcagagcttatcttgtttttaaaaatatgttactgtcattgaaatatttttccaaaatcttaccagaattagagtgatttaatctttactagctggcgaccttatttctactagttgctatagtagactagaactcttgttttattgtcgttgagtaaaatactaaatagtagccagttttgacttactttggcttcaaagctgttgtaaacatta

SEQ ID NO: 23637 - DNA, 324 bp, Homo sapiens
tatatccttttacattaccgcttcttgctgtggtagtttctgtaccaaaaaaaaaaaaaaggtcacaaaaggatagttggttattttcagagcttatcttgtttttaaaaatatgttactgtcattgaaatatttttccaaaatcttaccagaattagaggcaaccacaaaataatttacaactgatttaatctttactagctggcgaccttatttctactagttgctatagtagactagaactcttgttttattgtcgttgagtaaaatactaaatagtagccagttttgacttactttggcttcaaagctgttgtaaacatt

SEQ ID NO: 23638 - DNA, 1761 bp, Homo sapiens
atttgcaacaagtcctttgacttttggagccacagataaaagtcggtgcgctggtcctgcctcattaatccagggcttgcagtgctttgaagcccagtcgttgttggcctttgtgatgaaaatacctgtgaagatgagtggccggggaccaaaaggaagaattggaagcgcgatggttggatggaacaaaaagatgttagctcacccacagatctcatagtgattaaaatgaaagaacgttcaccccaaatccttatgatgtggtttaaaaataaagagttatagataagaccctattttcgaaaacaaagtgttaaatccccccacccccacccccgggccccgtgttaccttttgaaaggttgagcgaaagtgagaatgcaaggttttcctgaacgacgttgcttagaggtaacgcggggctgtgatgtctgttaatgggcatccttgcaaaagatgtcgtttgttgctagtgacgtttaaggtttgaacctgctgttcgtatctactgcattttatgtagtaacacatttaaaacaattaaattgtgcttaactgcaatgttcctaaaagccttatttttttgtatttcccaggtccctatgagaagtttaatgaaatattactggctaatgtggttttcccacctccattaaccatcatattcgtgactagttgctcaggctttttaaaaaacaaggaaactcaagagatctttactgttttatttttcaggaatgactttgtgcctctggtttaaatattagaaaacagaaaaataccagttggctttaaatgtttgctattcagttaaagactggatttgtttaaatgtaatacattgtaatcaaaggttaagtttttaaatctttgtgtttttaaaattgtgcttatgttttaaataataatacttgagttgtgtccattacaaatcagatacattcctcgagtgcaacacaggttctaacgcttataagacctctaggaaatttttttccttttatttatcaaatgaatataactgcgtttaaaagagggctgtaactgcaaggaacaacgattgagtgttcaagactgcctttattagctttacttacaagataatacattggttcacctttctatgcacaataaatatttttaggcttttgcatacttaatttgagagggacatctcccttatccggatagctgggtggattcttatccctgtgcagtagcaagtgctgactgggcaggaggtaaaaagagattagttttgtggacccaatgagggactccttttaaatgtaagttttcaatgatttgtataaggtacctactgcattacgtctaacacagttgtataattttaccagtaaaatctttatatgtttgaatagattaatggcgaggataaatagaggcattgtttttgctactttgcatatcattggccaatcaatgattgattgatttgtatatccttttacattaccgcttcttgctgtggtagtttctgtaccaaaaaaaaaaaaaaggtcacaaaaggatagttggttattttcagagcttatcttgtttttaaaaatatgttactgtcattgaaatatttttccaaaatcttaccagaattagagtgatttaatctttactagctggcgaccttatttctactagttgctatagtagactagaactcttgttttattgtcgttgagtaaaatactaaatagtagccagttttgacttactttggcttcaaagctgttgtaaacatta

SEQ ID NO: 23639 - DNA, 319 bp, Homo sapiens
gagatggagtctcgctctgttgccaagactatctcaaaaaaagaaagaaagaaagaaaagaaaattatatgagattatcatacagaaatttaaaattatcagtacgaacagtttataaattatatgggacattgcttatgacaaaacattaagtaaaaaagggaagatgaaacacataaaaaatggaaagaaatgtctgaaaaattaatctctggggtgggatcatgagtgcctttctctatcgctgcttctttattctgaattatacttttccagttgttgacaaggaatacacagtggcgttattaatataaatgca

SEQ ID NO: 23640 - DNA, 509 bp, Homo sapiens
gcaagaactataggaggatgtgtagctgcaaaaatttctcatcaataactcaatcttcagaacgttatgacatacagaaaatcaaagatgctgtgtcttagcattgagcaatatgggtggtgctatgtctgtagtctggtcaaattcagtaactgtgttcaaaacaaaatttcctctggaatactattgagaaaatctggcatttgcaaaaagggcagagtttaaatatgagccagtctttccaatcaacaatacctcttttaagaaaaccaactaacagctgtttgcatgccgttgaatccttgtgagcagttaggccacagtctaggacagaaagatgacacggggaaggactgagggccatctgagaacaaaagttgttgctacttctcagaggcattgagacacactgcatgctgtagactgctttgtgtaactgttatcacatcttgcttgagatgtcattggcagaatgttcttaaaaataaattatagataaatagccatca

SEQ ID NO: 23641 - DNA, 434 bp, Homo sapiens
gtggagccaagtgaggggtggagtgaggtggcaggacccaacacaagttgggagaaggtgaatgatgtaacccaaggacaaataaagaaggtgcatgtcctgcctatttttcttcctagtaaagcagtatctccctatatagattactgctgagtctgaggtagacagggaatggtgttatattttatcttaaatcttaattccataaatagttatagtatctgaaaaaggttgtagtgacttttctgtgctaagagggatcctttaatgtagtgggctcagacaacgaaggttttttgttttgtttattttttaagaaacaggggtctcacttgtcacccaggctggagtacagtggtgtgatcatagctcactgtagcctcgaactctgaactcctgggctcaagtgatcctcctgcctcggcctcctgagt

SEQ ID NO: 23642 - DNA, 349 bp, Homo sapiens
tctcagaccccttcagtacatagcatcatcagtctcaatacccaagccaaatcttaggtggacgtcaaacaagttctagtggaggccaggtacatggctcatgcctgtaatcctagcactttgggaagctgaggtgggtgggtcatttgagcccaagagttggagaccagctgggcaacactgtgaccaaaaaacaccccaaaattagctgggtgtggtggtgtgcgcctgtagtcacagctattcatgaggctaaagtgggaggatcacttgagccggggaggttgaggctgcagtgagccctaactgtgccactgcactccagcctgtgcaacaaagaccctgtctc

SEQ ID NO: 23643 - DNA, 1194 bp, Homo sapiens
tcacatgtgcctgtcccagaggaattccttaactctcccttcctggaaccgaaatgcttccaaagacagagagctcctatatatatttctctgttttccccagaggaccgtgcatgaaaggcgcctttcctggcgcgtgtgtctctgaccctgtggatcttctggacaattcccggaatttcttgcagggcagcacttccccttaagtcgtctctttctcgtttggatagtcagtatttatatagtcactattctcttttggttagccatctaattttatactgctagtcaagctctactcccttccccctagagtttgaatttatttttcttcaaacgctacacaaacccaaataaactcaaccaaagcggactttacctaccttcctacctacctaccaagaaaatatcccacaaaggagagaacggagaagcttgcaatacaggaagaaaaaaaaagaattacagaatggaagggatgtgtgcgctaaaaatgcaggtacttaaaggaaattgggctgatttgtactggacaccgaatttgaggaatacaggatctcaacctttctttgactggattacttttttattccattttggtgtggacgcgtctgaaactgatagtgctgctgctacctaccataatgtgtttgttgcaagatccacaagaacgtggatgccaagaatccacaaaaaaaaaacagatgcaaccgttgatgaggccataagcagaaacagtaagtggttcccacgtttcctctgctttaactactgatgatgaaatgcaagtcataaggcaaatagaagggctgtactgatacagacaaaatgttattattatgggaagggataactcccttgtaaaaccttgaaatgtttttcttctttgagaaaaatctatcacctattttcaccctgctcttgatatagcaaatattgtaagttgtcttatggaggatgactcagggaagacggtgaatgggttcactcaatccagaaaaggaagaggaaaataaaaagacataacgaccaatctgtgaaaacgctcagtggcttaaaagacactattaagagatgaaactatttgattctttatttaactcctttccaaggaaatgtttttgaaaatccatacggtttacatattaaagaggatcaatctgataataggtgatttttttgaaaaaatgaaaa

SEQ ID NO: 23644 - DNA, 1144 bp, Homo sapiens
tgtctactattatagaacctcaagcatttctctaaagaaaactcttacacatcttggtgttgtggtttcatgtccaccctaatgagaaaagttcttccttagtagggtcatgtttcctgaggaacccctaccctagatttatcccatagtaggtcttataaataatatccacatactaaaattatttggcttctaatgttaagttttacactaatattgtaaaagtaactctacagtcaaaaattgtaatatttaaataagaataatctgccatccgagccattagcctttagcatctgtgttatattttaaaatgcctgcaaaaattgtctatgcgtaaacaagttgtttttagttatactgtggcttatttggttggcatgaaaattagattgctttgcatatctggggtagcataaccagttttatcagtggctagattatatcagatgacaaaaataacatgagacttcagaagtctgataaataaagtgatgatacctattagaagtgggtgcaatctatagccatcaaaatgtgatgcattcatattcaggcatggtcctttagcattcgagtgataggcacttttatttgagtctttgaatgaaagataggcttttaaagtggattaaaggatagcagtttttacttgataagttgggacccatggtaacagcaagcatcccacttataactggtgtccattcagggaaaaacagatgtaaccattatgtgactcaatacaaagaagaagattacactggtaaaaaatactaagtgaaaaaaagaaaaactagtaaaaaatactaagaggattacattagtgaagattcagggtgtgaaggtgtgaagtaaaaggagagaagattaacagaataggtttacctttatttgatctccttacagggatctatcttccatggtgactaattctcctattttggtgaaacttttcaggttgatggatttaaaagaatagtataaacccaaaattttccattttaaggtcatgattttattttttactctgtggttcttaaatacaatttacttcattttatataacacctgccaagaacaacctaataaaattaaacaagatctggtttaggtttaataaaattaaaatgtgtttaacaaa

SEQ ID NO: 23645 - DNA, 407 bp, Homo sapiens
gaaacaccgtctgccgcaatatgattgatgagcttcttgggtccatgatgaccacttgaacactgatcattgttttcagtctctgagctggtgtgtcaaacctttaaaaagtaatttactggccgagtgtggtgcctcacgcttgtaatcccagcagtttgagaggccgaggcaggcggatcatgaggtcaggagatcaagaccatcctggccaacatggtgaaatcctgtctctactaacacaaaaaaaattagtcgggcttggtggtgcacgcctgcagtcccagctactccagaggctgaggcaggggaattgcttgaacccagtcggcagaggttgcagtgagccgagatcgcgccactgccctccagcctggagacagagcaagactccgtctcaaaaaaaa

SEQ ID NO: 23646 - DNA, 660 bp, Homo sapiens
ttttaaggttaacataaaataatagacaagaatggccaagaaaactcaggaaaaaaatctcagagcaagtcttcctttacttggacctggagcaggcatcttttttgttcattgccccactcaagggccatgaaaaccagaaactgattaccaaaggaccctgaagggccaactcaacacactaaaacatctgggttattgttttaactatatcatctcttacagacactttgtattctagttaaacagcaatattctataaaaagccagcatcttccctacagggacttaatgcatgatgctgttttctgcgagcctcatcttgtgccgccaccctcttttctcttagtttagctacaatggccttctttcagtttcctctgtgctaactcaggaccttcatacctgctgtttcttctgtatgaactactcttctccaatctcagaaccattacaactgagattctctgcctgccattctctccagtaatctagccgccattctctccagtaatctatccacccttcaccttcagatcatgatcgctctacagaccaggtcaggtgtctctgttaaacactccactcgcaccgtactccttttcctatataccacttaatccagtttgaaattatatattgatttgtgctttcttcatt

SEQ ID NO: 23647 - DNA, 208 bp, Homo sapiens
aaagagtatgtaaaagcatggtacacactgcttttgaagattacgtgtgtctattctagatgtgtcttatttcttgcagatatattgcctacaaagattttgatatatatatatacagtagactatactatataattaatatttataccagatattaaatatataagcattctactagaactaaagttaagaatttgaaatagtctca

SEQ ID NO: 23648 - DNA, 3405 bp, Homo sapiens
gcggcggcgcggcgcccaggatgccccgcagccccgggacgcgcctcaaacccgccaagtacatcccggtggccacggccgccgcgctgctggtcggctccagcaccctcttcttcgtgttcacgtgcccgtggttgacacgagctgtgtccccagctgttcccgtctacaatggcatcatcttcctctttgtcctggccaacttcagcatggccactttcatggaccctggtgttttcccccgagcggatgaggatgaggacaaggaggacgacttccgggctccgctgtacaagaacgtggatgtgcgaggtatccaggtccgcatgaagtggtgtgccacgtgccacttctaccgcccgccgcgctgctcccactgcagcgtctgtgacaactgtgtagaggtgactgggaagttccgcgggggtgtgaaccctttcacccgaggctgctgtgggaatgtggagcacgtgctgtgtagccccctggcgccccggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaagtccaagggcagcctggaccggctggatgagaagccactggacttggggccaccactgccccccaagatagaggctggcacgttcagcagtgacctgcagaccccgcgcccaggcagtgctgagagtgccctgtcggtgcagaggaccagccccccgacacctgccatgtacaagtttaggccggctttccccacgggtcccaaggtgcccttctgtggaccaggcgagcaggttccaggccctgattccctgaccctgggggacgacagcatccgtagcctggactttgtgtccgagccgagcctggacctccctgactatgggccagggggcctgcatgcagcctacccgccatccccaccgctcagcgcctctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctgggcccccgcccccgggagccctcgcctgtgcgctacgacaacctgtccaggaccatcatggcatccatccaggagcgcaaggacagggaggagcgtgagcgcctgctgcgctcccaggccgactcactcttcggcgactcaggcgtctatgacgctcccagctcctacagcctgcagcaggccagtgtgctgtccgagggcccccgaggtcccgcgctgcgctatggctccagagacgaccttgtggctgggcccggcttcggtggcgcccgcaaccctgccctgcagacgtcactgtcctcgctgtccagctccgtgagccgtgcaccgcggacgtcgtcctcctccctgcaggctgatcaggccagcagcaatgccccggggccccggcccagcagtggctcacacaggtcacctgcacgccagggcctgccctccccgcccggcactccccactcaccatcctacgcgggccccaaagctgtcgccttcatccacacggacctcccagagccaccgccctcgctgaccgtgcagagggaccaccctcagctgaagactcccccaagtaagcttaatgggcagtccccgggcctggcccggctgggacctgccaccggccccccagggccctctgccagccctacacggcacacgctggttaagaaggtgtccggcgtgggtgggaccacctacgagatctcggtgtgaggactgactgccacacatccgccatggtgccacggggaccaggaccccgcagcgcaccccccctccccaccaacttctctgccccagggacccgaggccaccccagcctggtgtggacccatcggcgggagagagtgccacgcctccacagcttgccccaagcgctctgcctgcccgtccactcatctgcccatggggaagtcggctcactgggacaagggccactgggctggtctgtgtctgggcctgtcccatggctggggcagtgagggggcccagtcagcctctttggggcaccctctctcagccaggcttggcccactgccatcacccagcaccccagatcaccgccaggccagcccccaatggtccccttacggacaggtcccagagatggacagaggcacccagggcccccaccgtccttctgacacagcctgtgggctcccggaccgagtgtcccccgccaggctactcctaactaacgcgttgcctttcacggaccccgctggaagcttgtagcttggcaaggctgatgcttctgccctggcctgctctgggtggtggtggataggtggacagacggccagccagccagctgtggccgggggcccggctccatgtgtcccgtgtctgtgtgctgtgctgccgcgccgtgtctgatgtgtcagtgctccggccgccgctgtccctttcatcaaagccttaacctttgctttatgctcttgtgggaggcgacgggggggcaggcgggagcaggcacgggggtgatgctgccacagggggctggtgacacccagagccccctccccagccctcaggccctccctgccaaactggagaaccccaccccaaggcatgccacgtccgcagccccggcctggctgcggtgctcgcgccgtgggaaagcacactggggaggggtcagtgcttcccttggtgtcagggacctgagagtaagcacatgacagcgtctgcttgcgttgtgtctgttttatgtttttatatctacatctatatatctataattttattaaaaaaaagaaaaagaaaaccgaaatagtctctctctctgaccagcaccatgggggtgtggcaagaaccaagcgccttaacaaagagggtggcacaaagggacgcccagaagcaacggggtggcaccccttttcctaacaacagatgggtctggactgtgaacaaggccctgctaatgttccacattacgaaatctgtggaaaaacgctcttcccgagaccccggaacaaattgtttgaagggctccagggacggtctgaaagacttcgtctgttgccaagtaaatgctttaaaatcagggtacggaatgtcggaaaaggcgaaatcg

SEQ ID NO: 23649 - DNA, 3681 bp, Homo sapiens
gcggcggcgcggcgcccaggatgccccgcagccccgggacgcgcctcaaacccgccaagtacatcccggtggccacggccgccgcgctgctggtcggctccagcaccctcttcttcgtgttcacgtgcccgtggttgacacgagctgtgtccccagctgttcccgtctacaatggcatcatcttcctctttgtcctggccaacttcagcatggccactttcatggaccctggtgttttcccccgagcggatgaggatgaggacaaggaggacgacttccgggctccgctgtacaagaacgtggatgtgcgaggtatccaggtccgcatgaagtggtgtgccacgtgccacttctaccgcccgccgcgctgctcccactgcagcgtctgtgacaactgtgtagaggactttgaccaccactgcccctgggtcaacaactgcatcgggcgtcgaaactatcgctacttcttcctgttcctgctgtcactcagtgcacacatggtgggcgtcgtggccttcggcctggtctacgtgctgaaccacgctgaggggctgggagccgcgcacaccaccatcaccatggctgtcatgtgtgtggccggcctcttcttcatccctgtcattggcctcactggcttccatgtggtgctggtcactcgggggcgcaccaccaacgagcaggtgactgggaagttccgcgggggtgtgaaccctttcacccgaggctgctgtgggaatgtggagcacgtgctgtgtagccccctggcgccccggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaagtccaagggcagcctggaccggctggatgagaagccactggacttggggccaccactgccccccaagatagaggctggcacgttcagcagtgacctgcagaccccgcgcccaggcagtgctgagagtgccctgtcggtgcagaggaccagccccccgacacctgccatgtacaagtttaggccggctttccccacgggtcccaaggtgcccttctgtggaccaggcgagcaggttccaggccctgattccctgaccctgggggacgacagcatccgtagcctggactttgtgtccgagccgagcctggacctccctgactatgggccagggggcctgcatgcagcctacccgccatccccaccgctcagcgcctctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctgggcccccgcccccgggagccctcgcctgtgcgctacgacaacctgtccaggaccatcatggcatccatccaggagcgcaaggacagggaggagcgtgagcgcctgctgcgctcccaggccgactcactcttcggcgactcaggcgtctatgacgctcccagctcctacagcctgcagcaggccagtgtgctgtccgagggcccccgaggtcccgcgctgcgctatggctccagagacgaccttgtggctgggcccggcttcggtggcgcccgcaaccctgccctgcagacgtcactgtcctcgctgtccagctccgtgagccgtgcaccgcggacgtcgtcctcctccctgcaggctgatcaggccagcagcaatgccccggggccccggcccagcagtggctcacacaggtcacctgcacgccagggcctgccctccccgcccggcactccccactcaccatcctacgcgggccccaaagctgtcgccttcatccacacggacctcccagagccaccgccctcgctgaccgtgcagagggaccaccctcagctgaagactcccccaagtaagcttaatgggcagtccccgggcctggcccggctgggacctgccaccggccccccagggccctctgccagccctacacggcacacgctggttaagaaggtgtccggcgtgggtgggaccacctacgagatctcggtgtgaggactgactgccacacatccgccatggtgccacggggaccaggaccccgcagcgcaccccccctccccaccaacttctctgccccagggacccgaggccaccccagcctggtgtggacccatcggcgggagagagtgccacgcctccacagcttgccccaagcgctctgcctgcccgtccactcatctgcccatggggaagtcggctcactgggacaagggccactgggctggtctgtgtctgggcctgtcccatggctggggcagtgagggggcccagtcagcctctttggggcaccctctctcagccaggcttggcccactgccatcacccagcaccccagatcaccgccaggccagcccccaatggtccccttacggacaggtcccagagatggacagaggcacccagggcccccaccgtccttctgacacagcctgtgggctcccggaccgagtgtcccccgccaggctactcctaactaacgcgttgcctttcacggaccccgctggaagcttgtagcttggcaaggctgatgcttctgccctggcctgctctgggtggtggtggataggtggacagacggccagccagccagctgtggccgggggcccggctccatgtgtcccgtgtctgtgtgctgtgctgccgcgccgtgtctgatgtgtcagtgctccggccgccgctgtccctttcatcaaagccttaacctttgctttatgctcttgtgggaggcgacgggggggcaggcgggagcaggcacgggggtgatgctgccacagggggctggtgacacccagagccccctccccagccctcaggccctccctgccaaactggagaaccccaccccaaggcatgccacgtccgcagccccggcctggctgcggtgctcgcgccgtgggaaagcacactggggaggggtcagtgcttcccttggtgtcagggacctgagagtaagcacatgacagcgtctgcttgcgttgtgtctgttttatgtttttatatctacatctatatatctataattttattaaaaaaaagaaaaagaaaaccgaaatagtctctctctctgaccagcaccatgggggtgtggcaagaaccaagcgccttaacaaagagggtggcacaaagggacgcccagaagcaacggggtggcaccccttttcctaacaacagatgggtctggactgtgaacaaggccctgctaatgttccacattacgaaatctgtggaaaaacgctcttcccgagaccccggaacaaattgtttgaagggctccagggacggtctgaaagacttcgtctgttgccaagtaaatgctttaaaatcagggtacggaatgtcggaaaaggcgaaatcg

SEQ ID NO: 23650 - DNA, 3519 bp, Homo sapiens
gcggcggcgcggcgcccaggatgccccgcagccccgggacgcgcctcaaacccgccaagtacatcccggtggccacggccgccgcgctgctggtcggctccagcaccctcttcttcgtgttcacgtgcccgtggttgacacgagctgtgtccccagctgttcccgtctacaatggcatcatcttcctctttgtcctggccaacttcagcatggccactttcatggaccctggtgttttcccccgagcggatgaggatgaggacaaggaggacgacttccgggctccgctgtacaagaacgtggatgtgcgaggtatccaggtccgcatgaagtggtgtgccacgtgccacttctaccgcccgccgcgctgctcccactgcagcgtctgtgacaactgtgtagaggactttgaccaccactgcccctgggtcaacaactgcatcgggcgtcgaaactatcgctacttcttcctgttcctgctgtcactcagtgcacacatggtgggcgtcgtggccttcggcctggtctacgtgctgaaccacgctgaggggctgggagccgcgcacaccaccatcaccatggctgtcatgtgtgtggccggcctcttcttcatccctgtcattggcctcactggcttccatgtggtgctggtcactcgggggcgcaccaccaacgagcaggtgactgggaagttccgcgggggtgtgaaccctttcacccgaggctgctgtgggaatgtggagcacgtgctgtgtagccccctggcgccccggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaagtccaagggcagcctggaccggctggatgagaagccactggacttggggccaccactgccccccaagatagaggctggcacgttcagcagtgacctgcagaccccgcgcccaggcagtgctgagagtgccctgtcggtgcagaggaccagccccccgacacctgccatgtacaagtttaggccggctttccccacgggtcccaaggtgcccttctgtggaccaggcgagcaggttccaggccctgattccctgaccctgggggacgacagcatccgtagcctggactttgtgtccgagccgagcctggacctccctgactatgggccagggggcctgcatgcagcctacccgccatccccaccgctcagcgcctctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctgggcccccgcccccgggagccctcgcctgtgcgctacgacaacctgtccaggaccatcatggcatccatccaggagcgcaaggacagggaggagcgtgagcgcctgctgcgctcccaggccgactcactcttcggcgactcaggcgtctatgacgctcccagctcctacagcctgcagcaggccagtgtgctgtccgagggcccccgaggtcccgcgctgcgctatggctccagagacgaccttgtggctgggcccggcttcggtggcgcccgcaaccctgccctgcagacgtcactgtcctcgctgtccagctccgtgagccgtgcaccgcggacgtcgtcctcctccctgcaggctgatcaggccagcagcaatgccccggggccccggcccagcagtggctcacacaggtcacctgcacgccagggcctgccctccccgcccggcactccccactcaccaccagggccctctgccagccctacacggcacacgctggttaagaaggtgtccggcgtgggtgggaccacctacgagatctcggtgtgaggactgactgccacacatccgccatggtgccacggggaccaggaccccgcagcgcaccccccctccccaccaacttctctgccccagggacccgaggccaccccagcctggtgtggacccatcggcgggagagagtgccacgcctccacagcttgccccaagcgctctgcctgcccgtccactcatctgcccatggggaagtcggctcactgggacaagggccactgggctggtctgtgtctgggcctgtcccatggctggggcagtgagggggcccagtcagcctctttggggcaccctctctcagccaggcttggcccactgccatcacccagcaccccagatcaccgccaggccagcccccaatggtccccttacggacaggtcccagagatggacagaggcacccagggcccccaccgtccttctgacacagcctgtgggctcccggaccgagtgtcccccgccaggctactcctaactaacgcgttgcctttcacggaccccgctggaagcttgtagcttggcaaggctgatgcttctgccctggcctgctctgggtggtggtggataggtggacagacggccagccagccagctgtggccgggggcccggctccatgtgtcccgtgtctgtgtgctgtgctgccgcgccgtgtctgatgtgtcagtgctccggccgccgctgtccctttcatcaaagccttaacctttgctttatgctcttgtgggaggcgacgggggggcaggcgggagcaggcacgggggtgatgctgccacagggggctggtgacacccagagccccctccccagccctcaggccctccctgccaaactggagaaccccaccccaaggcatgccacgtccgcagccccggcctggctgcggtgctcgcgccgtgggaaagcacactggggaggggtcagtgcttcccttggtgtcagggacctgagagtaagcacatgacagcgtctgcttgcgttgtgtctgttttatgtttttatatctacatctatatatctataattttattaaaaaaaagaaaaagaaaaccgaaatagtctctctctctgaccagcaccatgggggtgtggcaagaaccaagcgccttaacaaagagggtggcacaaagggacgcccagaagcaacggggtggcaccccttttcctaacaacagatgggtctggactgtgaacaaggccctgctaatgttccacattacgaaatctgtggaaaaacgctcttcccgagaccccggaacaaattgtttgaagggctccagggacggtctgaaagacttcgtctgttgccaagtaaatgctttaaaatcagggtacggaatgtcggaaaaggcgaaatcg

SEQ ID NO: 23651 - DNA, 1392 bp, Homo sapiens
  misc_feature (1389)..(1390): n is a, c, g, or t
gcggcggcgcggcgcccaggatgccccgcagccccgggacgcgcctcaaacccgccaagtacatcccggtggccacggccgccgcgctgctggtcggctccagcaccctcttcttcgtgttcacgtgcccgtggttgacacgagctgtgtccccagctgttcccgtctacaatggcatcatcttcctctttgtcctggccaacttcagcatggccactttcatggaccctggtgttttcccccgagcggatgaggatgaggacaaggaggacgacttccgggctccgctgtacaagaacgtggatgtgcgaggtatccaggtccgcatgaagtggtgtgccacgtgccacttctaccgcccgccgcgctgctcccactgcagcgtctgtgacaactgtgtagaggactttgaccaccactgcccctgggtcaacaactgcatcgggcgtcgaaactatcgctacttcttcctgttcctgctgtcactcagtgcacacatggtgggcgtcgtggccttcggcctggtctacgtgctgaaccacgctgaggggctgggagccgcgcacaccaccatcaccatggctgtcatgtgtgtggccggcctcttcttcatccctgtcattggcctcactggcttccatgtggtgctggtcactcgggggcgcaccaccaacgagcaggtgactgggaagttccgcgggggtgtgaaccctttcacccgaggctgctgtgggaatgtggagcacgtgctgtgtagccccctggcgccccggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaagtccaagggcagcctggaccggctggatgagaagccactggacttggggccaccactgccccccaagatagaggctggcacgttcagcagtgacctgcagaccccgcgcccaggcagtgctgagagtgccctgtcggtgcagaggaccagccccccgacacctgccatgtacaagtttaggccggctttccccacgggtcccaaggtgcccttctgtggaccaggcgagcaggtccaggcctgatcctgacctgggggacgacagatcgtagcctggattgtgtcgagcgggctggactcctgatatggcagggctgatgagctaccgcatccacgtcaggctgtgctctcgggtggcccgactagctaaccgggggattggcctcccgcttagggccccccaattgccctttccggcttttatgttcgctggccgccccggggaactcggggcggccagcccaaccaggcgcggnncg

SEQ ID NO: 23652 - DNA, 3484 bp, Homo sapiens
gcggcggcgcggcgcccaggatgccccgcagccccgggacgcgcctcaaacccgccaagtacatcccggtggccacggccgccgcgctgctggtcggctccagcaccctcttcttcgtgttcacgtgcccgtggttgacacgagctgtgtccccagctgttcccgtctacaatggcatcatcttcctctttgtcctggccaacttcagcatggccactttcatggaccctggtgttttcccccgagcggatgaggatgaggacaaggaggacgacttccgggctccgctgtacaagaacgtggatgtgcgaggtatccaggtccgcatgaagtggtgtgccacgtgccacttctaccgcccgccgcgctgctcccactgcagcgtctgtgacaactgtgtagaggactttgaccaccactgcccctgggtcaacaactgcatcgggcgtcgaaactatcgctacttcttcctgttcctgctgtcactcagtgcacacatggtgggcgtcgtggccttcggcctggtctacgtgctgaaccacgctgaggggctgggagccgcgcacaccaccatcaccatggctgtcatgtgtgtggccggcctcttcttcatccctgtcattggcctcactggcttccatgtggtgctggtcactcgggggcgcaccaccaacgagcaggtgactgggaagttccgcgggggtgtgaaccctttcacccgaggctgctgtgggaatgtggagcacgtgctgtgtagccccctggcgccccggtacgtggtggagccaccccggctgccgctcgcggtgagtttgaagccgcctttccttaggcctgaactcctggaccgagctgcaccgctcaaggtcaagcttagtgacaacgggctgaaggctggcctgggccgtagcaagtccaagggcagcctggaccggctggatgagaagccactggacttggggccaccactgccccccaagatagaggctggcacgttcagcagtgacctgcagaccccgcgcccaggcagtgctgagagtgccctgtcggtgcagaggaccagccccccgacacctgccatgtacaagtttaggccggctttccccacgggtcccaaggtgcccttctgtggaccaggcgagcaggttccaggccctgattccctgaccctgggggacgacagcatccgtagcctggactttgtgtccgagccgagcctggacctccctgactatgggccagggggcctgcatgcagcctacccgccatccccaccgctcagcgcctctgatgccttctcgggcgctttgcgctccctgagcctcaaggcctcgagccggcggggcggggatcatgtggccctgcagcccctgcgctctgagggggggccccccacgccccaccgtagcatttttgccccccatgcactgcccaaccgcaacggcagcctgtcctatgacagcctgctcaatcctggctcgcctggtggccacgcctgccctgcccacccagcagttggcgtggccggataccactcaccctacctgcatcctggggcaacgggcgacccgccacggcccctaccccgcagcttcagccccgtgctggggcccccgaggtcccgcgctgcgctatggctccagagacgaccttgtggctgggcccggcttcggtggcgcccgcaaccctgccctgcagacgtcactgtcctcgctgtccagctccgtgagccgtgcaccgcggacgtcgtcctcctccctgcaggctgatcaggccagcagcaatgccccggggccccggcccagcagtggctcacacaggtcacctgcacgccagggcctgccctccccgcccggcactccccactcaccatcctacgcgggccccaaagctgtcgccttcatccacacggacctcccagagccaccgccctcgctgaccgtgcagagggaccaccctcagctgaagactcccccaagtaagcttaatgggcagtccccgggcctggcccggctgggacctgccaccggccccccagggccctctgccagccctacacggcacacgctggttaagaaggtgtccggcgtgggtgggaccacctacgagatctcggtgtgaggactgactgccacacatccgccatggtgccacggggaccaggaccccgcagcgcaccccccctccccaccaacttctctgccccagggacccgaggccaccccagcctggtgtggacccatcggcgggagagagtgccacgcctccacagcttgccccaagcgctctgcctgcccgtccactcatctgcccatggggaagtcggctcactgggacaagggccactgggctggtctgtgtctgggcctgtcccatggctggggcagtgagggggcccagtcagcctctttggggcaccctctctcagccaggcttggcccactgccatcacccagcaccccagatcaccgccaggccagcccccaatggtccccttacggacaggtcccagagatggacagaggcacccagggcccccaccgtccttctgacacagcctgtgggctcccggaccgagtgtcccccgccaggctactcctaactaacgcgttgcctttcacggaccccgctggaagcttgtagcttggcaaggctgatgcttctgccctggcctgctctgggtggtggtggataggtggacagacggccagccagccagctgtggccgggggcccggctccatgtgtcccgtgtctgtgtgctgtgctgccgcgccgtgtctgatgtgtcagtgctccggccgccgctgtccctttcatcaaagccttaacctttgctttatgctcttgtgggaggcgacgggggggcaggcgggagcaggcacgggggtgatgctgccacagggggctggtgacacccagagccccctccccagccctcaggccctccctgccaaactggagaaccccaccccaaggcatgccacgtccgcagccccggcctggctgcggtgctcgcgccgtgggaaagcacactggggaggggtcagtgcttcccttggtgtcagggacctgagagtaagcacatgacagcgtctgcttgcgttgtgtctgttttatgtttttatatctacatctatatatctataattttattaaaaaaaagaaaaagaaaaccgaaatagtctctctctctgaccagcaccatgggggtgtggcaagaaccaagcgccttaacaaagagggtggcacaaagggacgcccagaagcaacggggtggcaccccttttcctaacaacagatgggtctggactgtgaacaaggccctgctaatgttccacattacgaaatctgtggaaaaacgctcttcccgagaccccggaacaaattgtttgaagggctccagggacggtctgaaagacttcgtctgttgccaagtaaatgctttaaaatcagggtacggaatgtcggaaaaggcgaaatcg

SEQ ID NO: 23653 - DNA, 2271 bp, Homo sapiens
ggttcagctttgtggagttggggcagatgcagccccagagggagagcccagcccagcccagcccaggccacttggccacaaaggggctgagggcacagcagtccagccctgagcgggtctcctctaccccacagggtgggacctgttcagctttgtggagttggggaggaggctgccactgggagtgatgagtggggagcccgagacctagaagtgggcagcattgcagccaggcagggatcgcagcccggggacaaagggctctcgcctcaagaaggtttaagtagcaaagatacagctgctgttggtcagcgctggtgggcaggagggcagcccctcgttttcctgagagagagcaggaatgaggccaggcagagtggctgggctcccagtgcagggcacggcaggggctccattcagtgcccacctggctgccccatgctctctgtggccagtgctggctaggagggacccagggactcgggagggtggtggcagttctgacaacatctgtctgtcctgtgacagcacagctgctccccaggcaggctctgcatccctcacctgctttccaggtgaaccctccaagcccagagggcagggactgcacggggccccacaacacggctgcactagtccacgtccgcgtcgtctctgtcttgctgctcctccgtcctctgtccccgtgttcgtgtgttcaccgtgtgcatgtgtgtatgtgcttgttttgatgcagggaccaccctcagctgaagactcccccaagtaagcttaatgggcagtccccgggcctggcccggctgggacctgccaccggccccccagggccctctgccagccctacacggcacacgctggttaagaaggtgtccggcgtgggtgggaccacctacgagatctcggtgtgaggactgactgccacacatccgccatggtgccacggggaccaggaccccgcagcgcaccccccctccccaccaacttctctgccccagggacccgaggccaccccagcctggtgtggacccatcggcgggagagagtgccacgcctccacagcttgccccaagcgctctgcctgcccgtccactcatctgcccatggggaagtcggctcactgggacaagggccactgggctggtctgtgtctgggcctgtcccatggctggggcagtgagggggcccagtcagcctctttggggcaccctctctcagccaggcttggcccactgccatcacccagcaccccagatcaccgccaggccagcccccaatggtccccttacggacaggtcccagagatggacagaggcacccagggcccccaccgtccttctgacacagcctgtgggctcccggaccgagtgtcccccgccaggctactcctaactaacgcgttgcctttcacggaccccgctggaagcttgtagcttggcaaggctgatgcttctgccctggcctgctctgggtggtggtggataggtggacagacggccagccagccagctgtggccgggggcccggctccatgtgtcccgtgtctgtgtgctgtgctgccgcgccgtgtctgatgtgtcagtgctccggccgccgctgtccctttcatcaaagccttaacctttgctttatgctcttgtgggaggcgacgggggggcaggcgggagcaggcacgggggtgatgctgccacagggggctggtgacacccagagccccctccccagccctcaggccctccctgccaaactggagaaccccaccccaaggcatgccacgtccgcagccccggcctggctgcggtgctcgcgccgtgggaaagcacactggggaggggtcagtgcttcccttggtgtcagggacctgagagtaagcacatgacagcgtctgcttgcgttgtgtctgttttatgtttttatatctacatctatatatctataattttattaaaaaaaagaaaaagaaaaccgaaatagtctctctctctgaccagcaccatgggggtgtggcaagaaccaagcgccttaacaaagagggtggcacaaagggacgcccagaagcaacggggtggcaccccttttcctaacaacagatgggtctggactgtgaacaaggccctgctaatgttccacattacgaaatctgtggaaaaacgctcttcccgagaccccggaacaaattgtttgaagggctccagggacggtctgaaagacttcgtctgttgccaagtaaatgctttaaaatcagggtacggaatgtcggaaaaggcgaaatcg

SEQ ID NO: 23654 - DNA, 1324 bp, Homo sapiens
aaaagaaaacaacataaaagaaaaagaaaaaaaaaatagctagtacagacccggttataggacgagcacccactgttgaccatcggcgggagagagtgccacgcctccacagcttgccccaagcgctctgcctgcccgtccactcatctgcccatggggaagtcggctcactgggacaagggccactgggctggtctgtgtctgggcctgtcccatggctggggcagtgagggggcccagtcagcctctttggggcaccctctctcagccaggcttggcccactgccatcacccagcaccccagatcaccgccaggccagcccccaatggtccccttacggacaggtcccagagatggacagaggcacccagggcccccaccgtccttctgacacagcctgtgggctcccggaccgagtgtcccccgccaggctactcctaactaacgcgttgcctttcacggaccccgctggaagcttgtagcttggcaaggctgatgcttctgccctggcctgctctgggtggtggtggataggtggacagacggccagccagccagctgtggccgggggcccggctccatgtgtcccgtgtctgtgtgctgtgctgccgcgccgtgtctgatgtgtcagtgctccggccgccgctgtccctttcatcaaagccttaacctttgctttatgctcttgtgggaggcgacgggggggcaggcgggagcaggcacgggggtgatgctgccacagggggctggtgacacccagagccccctccccagccctcaggccctccctgccaaactggagaaccccaccccaaggcatgccacgtccgcagccccggcctggctgcggtgctcgcgccgtgggaaagcacactggggaggggtcagtgcttcccttggtgtcagggacctgagagtaagcacatgacagcgtctgcttgcgttgtgtctgttttatgtttttatatctacatctatatatctataattttattaaaaaaaagaaaaagaaaaccgaaatagtctctctctctgaccagcaccatgggggtgtggcaagaaccaagcgccttaacaaagagggtggcacaaagggacgcccagaagcaacggggtggcaccccttttcctaacaacagatgggtctggactgtgaacaaggccctgctaatgttccacattacgaaatctgtggaaaaacgctcttcccgagaccccggaacaaattgtttgaagggctccagggacggtctgaaagacttcgtctgttgccaagtaaatgctttaaaatcagggtacggaatgtcggaaaaggcgaaatcg

SEQ ID NO: 23655 - DNA, 340 bp, Homo sapiens
gaaccagactcctttggataaatcactaattccacctgtaagaaagaaatgtacaagaagaacctaggaaacattgttttgtaccagatcagaaagattcaggaggcaccttagaagttaccactggccaaggctgagataactttagcatcagcaaggataatatctgcaagagattgaaactcatagtattgtatttaactctgtgagttaatgatggtagtggacagaattatagttacctttgggatacgcttttaaagaaattccaggtaataagagaaatgatagaattaggatatcaccattttacccccccaacaatttatggatctagaca

SEQ ID NO: 23656 - DNA, 362 bp, Homo sapiens
ggaacttgaatgccattcttcccactcccatttgccacgtcattgttgggtggaattttatcttttttctccctactgtccatactgatttaattttaccaaatgtagacaaatttctttgcccaccattggtttgcccaccattggttcttccatccattttttttctggggtgagttttgatcttagtgaagcctagtccagtttatggttcttactgtgtgatctgctgaccagagtatcagtatcgcctgagagcttgttggtgcaagttttcaggtcctaccccagacctactgaatcagcacctctgggggtgggacaccagtctttgttttctgctctcccagggattccagtgc

SEQ ID NO: 23657 - DNA, 420 bp, Homo sapiens
tgggagaggtgtgcttgtctgttgaagtcttccctaatgttatagcttctgatttcattgattcacattgaagcctggaataaacacagtatttcctttcagctaggtgtagaaacatggcaaagttctggcccattaaaagtgaagtgtggcaacttctttaaaagataagtggtgtgtatcttttgctgctatttattctttcctgcttcttgtggactccagtgtcaatgtgaaggctggcagcaaaacacctttcttggaccatgagctgatcttgggaatgtgaaccatgaatagtagaacaacacgatagaagaaacttgggttgctgaggatttctcagataaagtaatgttaccacagagctgccatatgattcctagactgttttcacttaaggaataaaatgtttaaata

SEQ ID NO: 23658 - DNA, 133 bp, Homo sapiens
gccaagagcactcctagcaattagatgtgcccttgtaatatcattaaccattaaagggaacgatgactccttggataaatggctgattccatgtcttgcatacaaaatatacaaaatgagacttgtgaagaag

SEQ ID NO: 23659 - DNA, 1490 bp, Homo sapiens
ctcccgagccccgagagctccgcgcacctgggcgccatccgccctggctccgctgcacgagctccacgcccgtaccccggcgtcacgctcagcccgcggtgctcgcacagcctgagactcatctcgcttcgaccccgccgccgccgccgcccggcatcctgagcacggagacagtctccagctgccgttcatgcttcctccccagccttccgcagcccaccagggaaggggcggtaggagtggccttttaccaaagggaccggcgatgctctgcaggctgtgctggctggtctcgtacagcttggctgtgctgttgctcggctgcctgctcttcctgaggaaggcggccaagcccgcaggagaccccacggcccaccagcctttctgggctcccccaacaccccgtcacagccggtgtccacccaaccacacagtgtctagcgcctctctgtccctgcctagccgtcaccgtctcttcttgacctatcgtcactgccgaaatttctctatcttgctggagccttcaggctgttccaaggataccttcttgctcctggccatcaagtcacagcctggtcacgtggagcgacgtgcggctatccgcagcacgtggggcagggtggggggatgggctaggggccggcagctgaagctggtgttcctcctaggggtggcaggatccgctcccccagcccagctgctggcctatgagagtagggagtttgatgacatcctccagtgggacttcactgaggacttcttcaacctgacgctcaaggagctgcacctgcagcgctgggtggtggctgcctgcccccaggcccatttcatgctaaagggagatgacgatgtctttgtccacgtccccaacgtgttagagttcctggatggctgggacccagcccaggacctcctggtgggagatgtcatccgccaagccctgcccaacaggaacactaaggtcaaatacttcatcccaccctcaatgtacagggccacccactacccaccctatgctggtgggggaggatatgtcatgtccagagccacagtgcggcgcctccaggctatcatggaagatgctgaactcttccccattgatgatgtctttgtgggtatgtgcctgaggaggctggggctgagccctatgcaccatgctggcttcaagacatttggaatccggcggcccctggaccccttagacccctgcctgtatagggggctcctgctggttcaccgcctcagccccctcgagatgtggaccatgtgggcactggtgacagatgaggggctcaagtgtgcagctggccccataccccagcgctgaagggtgggttgggcaacagcctgagagtggactcagtgttgattctctatcgtgatgcgaaattgatgcctgctgctctacagaaaatgccaacttggttttttaactcctctcaccctgttagctctgattaaaaacactgcaacccagctaacttgtccag

SEQ ID NO: 23660 - DNA, 631 bp, Homo sapiens
cagtctccagctgccgttcatgcttcctccccagccttccgcagcccaccagggaaggggcggtaggagtggccttttaccaaaggtcagattctttcaccgcctctgccagacccccttgtcccccacccccgcatagatctccagggggctcagaaaactctggccggtggctcacgcctgtagtcccaacgctttgggaggccaaggcgggaggatcgcttgaggccaggagttccagaccagcccaggcaacaaaagataccacatctctacaaaaaataaattagccgggccctgcacgcctgtagtcccagctactggggaggccgaggccggaggatcgcttgaacccaggagttccaggctgcagtgagctataattgtgccactgcactagagtctgggtgacagagacactgtctcaaaaaaaaccaacaaaacccttagctctttcactagccgggctggcctcttcctactgtaaacctgctgggcccccgtctcccttctttctcccctctctcctgccctggagctgcctgactctgcccacggcctgcagagaccccaggtcttcacgcaaggtgccattcctcactcagttcttgctcaaacgtccctccatcaa

SEQ ID NO: 23661 - DNA, 398 bp, Homo sapiens
tctgtctcaaaaataaaaatttaaaaaaaaaagaaaataattttcaatcatcttttgaagctccttgctttatagctgctcctttaacttcctttagccagatacactaccaccctcaagccagtgattcattcagtacaaattcccgggtgcccactatgtgcctggtaacctatgagggacaaaggatgatgaattttgcagagcatcacagaccaagggaccgagcaccgaggactgacagaatggtggtcacctcacacgctccatttccactttggcatcttatttccatcccacagatgaggcaggttttattataccactttccagcgtatcttatactttttctcagcctctctctgggccaatctcatttagcccctttgcaaattaaa

SEQ ID NO: 23662 - DNA, 440 bp, Homo sapiens
aagtaagtaaaattcatttgttaggtatggcagctcttggctgattacatctaaattggctttggttaccttaagcacacacacaaaaatatattagaacactattgagtaggtcccagaatcaatgggaggtctagagaacaaggcttgcaaatggatagggatcaaagctaggtatgagaaccatggccagaggaatggcactcatgctgtcccagcactactgccttcagcactggtgacaaaatgcattctaaattgcccccattgtatcagtcagagtcttaacaagaaataggtggcagactcaggaggatctaaagatctatttacaaagaagtgggtgtaggtgagccaccagggatagtgtggtaacctgctgctagtagtagtaaccaggtaaccaggccccagggacttagtggtcaccattcctaggc

SEQ ID NO: 23663 - DNA, 2303 bp, Homo sapiens
gaggcccagaggcaggctccccccttggtccagctggagcagccctttcagggagccccgccctcccaaaaagccgtgcaaatccagctacccccccagcaggcccaggcatcgggtccgcaagcggaggtgcccacactgccgctccagccttcctggcaggcaccgcctgcagtcttgcaggcccagcccggacccccggtagcagcggcaaattttcccctgggctccgctaaatcattgatgactccatcaggagaatgcagggcctcttctatagaccgcagggctcctctaaagagcgcaggacctcctcgaaggagcgcagggccccttcaaaagaccgcatgatctttgctgccaccttctgtgctcccaaggcagtgtcagctgcgcgagcacacctgccagctgcctggaaaaacctgcctgccacaccggagacctttgctccctcctcaagtgtcttcccagctacctcccagtttcagcctgcctctctgaatgcctttaaaggcccctctgctgcctcagagaccccaaagtcactgccatatgctctgcaggatccctttgcctgtgtagaggccctgcctgcagttccatgggtcccacagcccaatatgaatgcctcaaaggcatcgcaggcagtgcccaccttcctgatggctacagcagctgccccccaggcaactgccaccactcaagaggcctccaagacctccgtcgagccgccacgccgctccggcaaggccacccggaagaagaagcatctggaagcccaagaggacagccgtggccacacgctagcctttcatgactggcagggcccaaggccctgggagaatctaaatctgagtgactgggaggtccaaagccctatccaggtctcgggtgactgggagcacccaaacaccccccgtggcctgagtggttgggagggccctagcacctccaggatcctgagtggctgggaagggcccagcgcatcctgggccctgagtgcctgggagggcccgagcacctccagggccctgggtctctctgaaagcccagggagctctctgcccgtagttgtgtctgaggtcgcaagtgtctctccgggatccagtgccacccaggataattccaaggtggaggcacagcccttgtctcccttggatgagagggcaaatgcgttggtgcagttcctcttagtcaaggaccaagccaaggtgcctgtccagcgctcggagatggtgaaagtcatcctccgagagtataaagatgagtgcttagatatcatcaaccgtgccaacaataagctggagtgtgcctttggttatcaattgaaagaaattgataccaaaaaccacgcctatattatcatcaacaagctgggctaccatacagggaatttggtggcatcctatttagacaggcccaagtttggccttctgatggtggtcttgagcctcatctttatgaaaggcaactgtgtcagggaggatctgatctttaattttctgttcaagttagggttggatgtccgggagacaaacggtctctttggaaatactaagaagctcatcaccgaagtgtttgtcaggcagaagtacctagagtacaggcgaatcccttacactgagcccgcagagtatgagttcctctggggccctcgagcattcctggaaaccagcaagatgcttgtcctgaggtttttggccaagctccataagaaagatccacagagctggccattccattaccttgaagcgctcgcagagtgtgagtgggaagacacagatgaggatgaacctgacaccggtgacagtgcccacggccccaccagcaggccccctccccgctaataggtgtagcagagatctcgctcctgtgtttccctggccagaggccactgacagggtggggggacatttttgttcctggtgtttgtgttccagttccacgagtgtaagtttggattttcaacttggtttcgtatctgccaaagctttgtacattttttatgtggtgttgatttcaatcggctactgttctgttctgtattttggcatctgtgtttttaagtgagatctgtggttctctgttttgtgttataattgttatgttttggtatcagctttgtgctggctttgtgaaatgaattgagaagctatccatctcatttctggtatagttcatgtagcattgtaatcggttgttctttgaacgttcaaatgactcatcagtaaaaactgtctacagagaagtaaatatctatatctatatatataaatatactttcagcataaaaaaagtgt

SEQ ID NO: 23664 - DNA, 1967 bp, Homo sapiens
gaggcccagaggcaggctccccccttggtccagctggagcagccctttcagggagccccgccctcccaaaaagccgtgcaaatccagctacccccccagcaggcccaggcatcgggtccgcaagcggaggtgcccacactgccgctccagccttcctggcaggcaccgcctgcagtcttgcaggcccagcccggacccccggtagcagcggcaaattttcccctgggctccgctaaatcattgatgactccatcaggagaatgcagggcctcttctatagaccgcagggctcctctaaagagcgcaggacctcctcgaaggagcgcagggccccttcaaaagaccgcatgatctttgctgccaccttctgtgctcccaaggcagtgtcagctgcgcgagcacacctgccagctgcctggaaaaacctgcctgccacaccggagacctttgctccctcctcaagtgtcttcccagctacctcccagtttcagcctgcctctctgaatgcctttaaaggcccctctgctgcctcagagaccccaaagtcactgccatatgctctgcaggatccctttgcctgtgtagaggccctgcctgcagttccatgggtcccacagcccaatatgaatgcctcaaaggcatcgcaggcagtgcccaccttcctgatggctacagcagctgccccccaggcaactgccaccactcaagaggcctccaagacctccgtcgagccgccacgccgctccggcaaggccacccggaagaagaagcatctggaagcccaagaggacagccgtggccacacgctagcctttcatgactggcagggcccaaggccctgggagaatctaaatctgagtgactgggaggtccaaagccctatccaggtctcgggtgactgggagcacccaaacaccccccgtggcctgagtggttgggagggccctagcacctccaggatcctgagtggctgggaagggcccagcgcatcctgggccctgagtgcctgggagggcccgagcacctccagggccctgggtctctctgaaagcccagggagctctctgcccgtagttgtgtctgaggtcgcaagtgtctctccgggatccagtgccacccaggataattccaaggtggaggcacagcccttgtctcccttggatgagagggcaaatgcgttggtgcagttcctcttagtcaaggaccaagccaaggtgcctgtccagcgctcggagatggtgaaagtcatcctccgagagtataaagatgagtgcttagatatcatcaaccgtgccaacaataagctggagtgtgcctttggttatcaattgaaagaaattgataccaaaaaccacgcctatattatcatcaacaagctgggctaccatacagggaatttggtggcatcctatttagacaggcccaagtttggccttctgatggtggtcttgagcctcatctttatgaaaggcaactgtgtcagggaggatctgatctttaattttctgttcaagttagggttggatgtccgggagacaaacggtctctttggaaatactaagaagctcatcaccgaagtgtttgtcaggcagaagtacctagagtacaggcgaatcccttacactgagcccgcagagtatgagttcctctggggccctcgagcattcctggaaaccagcaagatgcttgtcctgaggtttttggccaagctccataagaaagatccacagagctggccattccattaccttgaagcgctcgcagagtgtgagtgggaagacacagatgagatatccgatacgctgatatgccgcggccaccaaaggcccctccggtaatgggttcagacttgtcgtgtatctgtcagcagcacgacagggggggaaaaatactaggaaataaaacataagtagtgaataagcagaatattgggtagccagcgctgacgtactatacttttttgttgt

SEQ ID NO: 23665 - DNA, 672 bp, Homo sapiens
tgagacagaccacatgtttcctatcttggaaaatggtaccacttccttgtgcaagcctacccctgttccctcacccctcgttcagtccaacagcaaatctgtccagtcttctaactgtatctcaggttcattagccccgcttcctcgtccctgctcgtcttctgccggaccagtccgccatcttgtgaccggactcgggaatagcgtcctacttcccggcggcctccactcttgacccaaatgcaatgtgcagccatggcaatcttttataaacagaaatccgatcaagttactcctctgccgaaatccctctggtcagtggtttaactgtcgaggtgctcctggcagcactctgccctccccacatcattgctggtggacttgtctcccctactagactgtgccctgtgagggtggagactttgtgcagggttgtatccccagcatctgatgcagtgattcaataaacatctgtccaattaataggaaagacagttccttttctcattcccctattgctggtcccctgccctcaagcaggatgttatgccccagagtggctgtgggtgcgaacattctgcccctctggctggtctggcactgatttccaccctgagctggtgttgcctctctccttcctcttggccaacctctcttccaccaatataagcc

SEQ ID NO: 23666 - DNA, 1804 bp, Homo sapiens
tgaaaacgtttctatagattttggatttccttctgatagctaaaatttgtttctgtataacagagtagtgccctataagccagttcagtgcacattaaatggctgttcttagaattatgaatctgaggcttatgcagtgaggctctagctctctggagtcagttggtcaagtgggattcctgaggactgagcaaacacacacagagcaggattttgtcctaagttttcttagggatcctatccaaaaacaccattacttgaatttcccagcttccttttacagggagacttccttgctatgtgtactcccacctcggtatgtcaaatcattttctcagaggaagtacagcataaaataataaccagcatttgtagagcacttcttgtgggccttcttgggcaaatagacattctcatggaatgctctaaaattgttaagttcttgcacttgctctcaagtcatttataatctaattgctggtcttcctggtatgaacaaagatgtttgcttgttaataaattcctaccacatacccagacttgtggtttatttctatctaactagggaaagcactaaagagttttccaataaggaagaatgatctgagtgtctacctgctttggaaaagatgtctgccatggataggaaatgattttgtatcccaaaatcctagtactaatttggagtgttgtaaaggtcagggcagcaaatgctagagagtgggattaatgaaaagttatagtgttctgcatgcctttgaataattaatttttactccatttttactcgcttgcaataaagtaggttaagtgctgtactttaaggaagtccatgtacaagccagtgccttaacaatggtcaaatggttgctcactaaccaatggaaataaatgactgttgtttccacaaaattgctttacagattctaaatgctatctctgggacactggattgtgtgctctttaagataaattccataatcaagggcctggccctgaatagattggagcccaaaaatctcactgaagcaaagagataataggccagtaaagagtgggagacaaacactcctggaataggaagccactactcacctttattttaaattgatatatagaaattaatattacaaaatgcacacatcttaagtgtgaagtttgatgttttgacagttgtatacgtctgtgtaataactaccaaaagaagacataatatgttacaattaacccagaaaattctcaagtacttttaaatcacccctgagcacctccccactccagtgatcacttcttgatttttatcactaaagatttgttgtacctgcttttggattacatataagtggaatcatataataatgtactcttttgcatctggcttctttcactgataatgctttaaagacacgcatactgtatgtattaggacattgttctttattgctgagtagtatttcattctataaatataccacaatttgtttattcattctcctattgaaggacctttaggttgtttccagtttggggcaattatgaataaggatgctatcgatattcttacacagccttttgtttttgttttttgtggatatacatcttcacttgtcttggataaataagagtagaaaattactgggtcatatggtaagtgcatgtttataagaaactgccctcttattctccaaagtggttttaccattttgtactcctatcagtgatgtatgagagttacagttgcttcacatgtctgtcaacatttacactgtcactgttttttatattagccattttagcatatatg

SEQ ID NO: 23667 - DNA, 1096 bp, Homo sapiens
cactcaatggacagctcttgtgacagggagttcatgcatcctgggacaacccactccagttttgatagtaccagctgataggaaattcttcttgatcttgagcaaaattctgttttctttgagacttccactcattcatcctaggtctattcccccaaggccaaaccatgcaagtaagatggcccttccaaaagatggccattcagaaacttgaaggcagtgatcatgcccctaggaatcctctagtctccagattgtagcctcagttctgtcaactcttctttgaatttcaagtcccttcatcattcaggacaagttgaacttgttctaagctagtccagtatcattttgtttacgaaacaaaattttagatagaacttccaaaaatgttttaagcgatacagggacttatttgaaaggataaaactcctttgcatatatgagctatatgatacgtttgttttataaaaagtcttattcctttataatcactttgaagtacagaattcaaaattaggatatttgggtgttgccctagaagagcttacaatttagtttatgttctttgcacaatgattcataataaaatgactctccttgaagaaatgttgttcttagcttatttctgtgaagaagccaaactccaataacaaccaaaaagttctaaacatctcacaaatcttccagttatttttcagtttaaatgttggtggacagataatatgttaaaactgcacatctgtaagtcatgcactgctcactgaccctctgaacttaactgcctcaggctcccgagtagctgggactaccggacatgcacacactcagctaaattagtttcagagaaccgggcttccacctgtggccagaggacgcacccggccctgcgatagccgactggcccccaaggcggaaaaagggaaccaccagccaaccactttacctgcaaaatacacagaaagctacagaacaaacacacggaccaacccggaacacgcgccgagcaaaacagggggcgggaccaccacgaggaacacaaacgcgcacgaacacacgtcaaaaaagaccaggcccaccgaagcacgcacgacaagat

SEQ ID NO: 23668 - DNA, 1194 bp, Homo sapiens
cactcaatggacagctcttgtgacagggagttcatgcatcctgggacaacccactccagttttgatagtaccagctgataggaaattcttcttgatcttgagcaaaattctgttttctttgagacttccactcattcatcctaggtctattcccccaaggccaaaccatgcaagtaagatggcccttccaaaagatggccattcagaaacttgaaggcagtgatcatgcccctaggaatcctctagtctccagattgtagcctcagttctgtcaactcttctttgaatttcaagtcccttcatcattcaggacaagttgaacttgttctaagctagtccagtatcattttgtttacggtcccataactgactggccatcatgagtatggtctaaccaggtggaatagtgtgaagtggacctagtaccttttcggtgctgacacctgcctcacatgaaacaaaattttagatagaacttccaaaaatgttttaagcgatacagggacttatttgaaaggataaaactcctttgcatatatgagctatatgatacgtttgttttataaaaagtcttattcctttataatcactttgaagtacagaattcaaaattaggatatttgggtgttgccctagaagagcttacaatttagtttatgttctttgcacaatgattcataataaaatgactctccttgaagaaatgttgttcttagcttatttctgtgaagaagccaaactccaataacaaccaaaaagttctaaacatctcacaaatcttccagttatttttcagtttaaatgttggtggacagataatatgttaaaactgcacatctgtaagtcatgcactgctcactgaccctctgaacttaactgcctcaggctcccgagtagctgggactaccggacatgcacacactcagctaaattagtttcagagaaccgggcttccacctgtggccagaggacgcacccggccctgcgatagccgactggcccccaaggcggaaaaagggaaccaccagccaaccactttacctgcaaaatacacagaaagctacagaacaaacacacggaccaacccggaacacgcgccgagcaaaacagggggcgggaccaccacgaggaacacaaacgcgcacgaacacacgtcaaaaaagaccaggcccaccgaagcacgcacgacaagat

SEQ ID NO: 23669 - DNA, 822 bp, Homo sapiens
actttgaagtacagaattcaaaattaggatatttgggtgttgccctagaagagcttacaatttagtttatgttctttgcacaatgattcataataaaatgactctccttgaagaaatgttgttcttagcttatttctgtgaagaagccaaactccaataacaaccaaaaagttctaaacatctcacaaatcttccagttatttttcagtttaaatgttggtggacagataatatgttaaaactgcacatctgtaagtcatgcactgctcactgaccctctgaacttaactgcctcaaaaaagggactgttggccaggcaccgtggctcatgcctgcaatctcagcactttgggagggtgaggcaggtgggtaacttcagcccagcagttcgacaccagcatgggccatacggtgaaaccccaactcaacaaaaaattagctgggcatggtagcgcccacctgtggtcccagctacttgggaagctgaggtagggggatcaattgagcctggagtaagctgattgtgccactgccctccagcctgggcagcagagcaaggccctgtcttggacggggtgggggcgctgtcaccctgctgcaggtaagactaataaacttttaattattattattgttgttttttttttttttttttagagacagggtctcactgtgttgcatcacccaggctgaagtgcagtggtgtgaccacagttctctgcagcctctaactcttgggttcaagtagtcctccagccctccagactttgtgtgtgtatgaaacagagtctcgctctgtcaccaggctggactacagtggtg

SEQ ID NO: 23670 - DNA, 508 bp, Homo sapiens
gagccaccgtgctgggattacgggcgtgagccactgtgctgggattacgggcgcgagccaccgtgctgggattacaggtgtgagccaccgtgctgggattatgggtgcgagccgccgtgctgggattacaggtgtgaaccactgctcctggcctttatttcagcattctgtttcagtgtttcacattggccacttagctagatccgtttgtcttctgcagtactgtgctgatccagagtatatgctaagacagaaagtgctttggaggtaaagtttaaaaaatacaagggcttcaaaatagtactagtaatttgatccattcacaaaaggacaaaggctggacagagacgtgaagaaatgaatcatttacgcaatgattggggtgttccaattatgtgtgattttgtgttttctgccgtttcattttgtattgctataatcattttgacaatgaatacaaatcaaatagcacccaaaattgtgaaggatacggaacctcattgatgag

SEQ ID NO: 23671 - DNA, 388 bp, Homo sapiens
cagaaaatggaaaaaaaataaaagaaagaaaaggcactcagattggaaaggagtgagtaaaactatctctatttgcagatgatatgatcttgtatatagaaaatcctggctgggcatggtggctcacacctgtaatccctgtactttgggaggctaaggtggacggattactcgaggtcaggagtttgtgaccagcctgaccaacatggtgaaaccctgtcactactaaaaatacaaaattagccgggcatagtggtgagcacctgtaatcccagttactcaggaggccgaggcagaagaatcacttgaacctgggaggcggaggttgcagtgagccaaaattgcaccactgcactgcagcctgggtgacagagtgagactccatcta

SEQ ID NO: 23672 - DNA, 435 bp, Homo sapiens
ctttattgaaacttaggttttatgtattgcatgtaaagtcatatgttcctatgtagatcattctaacttgatattttaaaatgcctcttgataataatagtcatatgttgaatttgaagttttgtgtttagaaaaattatagctttaggctggttgtggtggctcatgcctgtaatcccagcactttgggaggcggaggtggacagattgcttgagttcaggaattcgagactagcctggacaacatggcgagatcccatctctactaaaaatacaaaaaaatagctgggcattgtggtgcatacctgtggtcccagctactcaggaagctgagatgggaagattgcttcagctgggggtggaggttgcagtgagatgagattgtgccactgcactccagcctatgtgacagagtgagaccttgtctcaaaaaaa

SEQ ID NO: 23673 - DNA, 371 bp, Homo sapiens
ttctttttttcagagacagggttttgctctgttgcccaggctggagtgcagtgctgagatgatagttactgcagcctctaactcttgggctcaagcagtcctccccgctcagcctcctgggtaaccaggactgcaggcacatgccatcacgcctggctaattttaatttttttttgtagagacagaaaaatgagaagttattttgctcagactggtcttgaattcctggcctgaagcaatcctcccatctcaacctcccaagtagctaggactacagacacgtgccactgcgcctggccttccaaatacttttatatttaaaagggaattctagggccgggcacggtgacagaatgagactctgtctcaaa

SEQ ID NO: 23674 - DNA, 1194 bp, Homo sapiens
caaaagttaaatactgatggaatcaagtattttgtatgaagttctcatttgttatctctaacgctattttgtgttttgcatatagtattatagtatgtgtatatcactttttgtatagagtaagcaattgaataatttgttagtaaaaataataccacattgactgatactgctatagacatagcttgagttttatgtctcctttttgctcattttctaagacttaggagaaagaataaatctaaaatgaccattaaaacattctccatttcagcttgctgtgtaacttaggaagtataaaactatacttctctttatctgcatgtaagtttgctgttaaaatgtgaatttctaaatgtgtatttggaattatttccgtagtttatttctgcaaactatgtaaatttgttatatgtgtgagtatgtgtacatatgtatattttagagtaatataaaattaaagggaacaatcttgcatagctctttcaccagttttaaattattgatacgttatttttaaggactcttgacaaactaggggcaattttcttatagtggagacccagtgattatcagcagatgaggaaataggttaaaaattgctatatggcaatttgtatataaagtaataggatgtgagaaaaatactgaatcttaagaatgacatggaattctgtggcagaaacaaaagaaaaagttgatgtagtatataccttcaactgtgttttgagttgacttttttttttttctttaagctttgggtaaaaatgtatgaggagggagagggcccaatataaatatttacatcttcttacctttttggaaatggaagaagataaatcttgagtttttctgcctatattaatcaggaattgccctttgaaaaaagtgctaaataaatattttgattttttttttcaagggaagttaggtgaaagaaggaaaaacatcacaggaaagactgttaacattctgtttgttgtctgagaggtgaggaaccaaagggaggcaactaaagcgggaaaccatcttgctttttctaatcagttcttggaacagaaatgtggaagctacctttaggaacatggagaatttccaaaccaacaggcaaaggaaaactaacgcacaaaaatgacattctgaagatgcaggtttcagccaggcgcggtggctcaagcctgtaatcctagcact

SEQ ID NO: 23675 - DNA, 645 bp, Homo sapiens
caaaagttaaatactgatggaatcaagtattttgtatgaagttctcatttgttatctctaacgctattttgtgttttgcatatagtattatagtatgtgtatatcactttttgtatagagtaagcaattgaataatttgttagtaaaaataataccacattgactgatactgctatagacatagcttgagttttatgtctcctttttgctcattttctaagacttaggagaaagaataaatctaaaatgaccattaaaacattctccatttcagcttgctgtgtaacttaggaagtataaaactatacttctctttatctgcatgtaagtttgctgttaaaatgtgaatttctaaatgtgtatttggaattatttccgtagtttatttctgcaaactatgtaaatttgttatatgtgtgagtatgtgtacatatgtatattttagagtaatataaaattaaagggaacaatcttgcatagctctttcaccagttttaaattattgatacgttatttttaaggactcttgacaaactaggggcaattttcttatagtggagacccagtgattatcagcagatgaggaaataggttaaaaattgctatatggcaatttgtatataaagtaataggatgtgagaaaaa

SEQ ID NO: 23676 - DNA, 685 bp, Homo sapiens
caaaagttaaatactgatggaatcaagtattttgtatgaagttctcatttgttatctctaacgctattttgtgttttgcatatagtattatagtatgtgtatatcactttttgtatagagtaagcaattgaataatttgttagtaaaaataataccacattgactgatactgctatagacatagcttgagttttatgtctcctttttgctcattttctaagacttaggagaaagaataaatctaaaatgaccattaaaacattctccatttcagcttgctgtgtaacttaggaagtataaaactatacttctctttatctgcatgtaagtttgctgttaaaatgtgaatttctaaatgtgtatttggaattatttccgtagtttatttctgcaaactatgtaaatttgttatatgtgtgagtatgtgtacatatgtatattttagagtatatctgagggaaaaataaatgaaaattttctttatgtacttatgtatgtgtgatgcatgttcaaagtcttatcgaccataactctgtgcacttggttatcggacattttgggagtttttttctctgggaaaaatcgatagtgttttcttcaatgctgctgctgtgtgaagccatactttttcagggttcttcccctaatcggctcttaggtttccctgctctgtttcatttatttc

SEQ ID NO: 23677 - DNA, 1327 bp, Homo sapiens
tggaagttgctggagctcggtacaggtccacccagctgaagtgggttctttttcccactaccactggggcaagggagtgagcctaggtatggtcacctcagcagccacagtcttaaaagcaagtcgctagattttttgaaagtcccaagagaagtggtggtcttcccttctgtcatcccagtatatatagttatacatgtaaatatctaaataccccatgtaatgggaaggctatgtacagggcagccttcccaaacgctgtgagggcacagagctgctgtggctgctccaccagggtgtgctggtggctcagctttggggttggactcccacgttcacctccccctcctggtccaggcagaggcaccagaacccatcctgccttttctccagtgtgagcatttcagggagccaccatcagccttgggttcatgagaggaagaaacccccaaagaccaatgcctggagcccacttctccagcgacaccttccctcgccagagcaggctcctaggagtgcatggcaggggtgccgggtccctgtgcacgggtttgctttctgaacattgcccatcaacaccgccttcagggagtcccagagtaacctactacctcccccatcgctcctctgcccccctcaccctgtgggcaccaacacctcccgcacacagatgaaaaccatctacagagcccttcccgggtccctcgacccaagtggtgtagccgttaccaatgtttacaaccaggggccgcccctccttagatgtgtttactcgcattcacaggccacctgttggtttgagtttcatgtgtctccttccctggcctaggttgacttgagcacacaactcgatctttcttcccctccatcaaggcagtgtgtgaggactgtgtgggaatgacatttcttgtacatacttagcacagcacctagagtatgaacttgtactattgttctgtaaagagggtgaaatagagcttattgtaaagtgtcgggagaagtatagtattgtatttgtaacaatatcgttctttgtatacacaaaactcaatgatctatatataaatataaataaatatataaataaaatatatctacacgtgagcctggaatgtggacaccgcacacccactgaatgtacttccttgacagtctggtcactggtccctccctccctccctcctccgtcccgtggccacagtcatccagtttggggttgtgatgtatttactgtgctatctatcttcctttatttaactgaacgctaatgtctgtataagagttgctgcaacaataaacaagaacttcacctcttggcctggccaag

SEQ ID NO: 23678 - DNA, 1251 bp, Homo sapiens
tggaagttgctggagctcggtacaggtccacccagctgaagtgggttctttttcccactaccactggggcaagggagtgagcctaggtatggtcacctcagcagccacagtcttaaaagcaagtcgctagattttttgaaagtcccaagagaagtggtggtcttcccttctgtcatcccagtatatatagttatacatgtaaatatctaaataccccatggtgtgctggtggctcagctttggggttggactcccacgttcacctccccctcctggtccaggcagaggcaccagaacccatcctgccttttctccagtgtgagcatttcagggagccaccatcagccttgggttcatgagaggaagaaacccccaaagaccaatgcctggagcccacttctccagcgacaccttccctcgccagagcaggctcctaggagtgcatggcaggggtgccgggtccctgtgcacgggtttgctttctgaacattgcccatcaacaccgccttcagggagtcccagagtaacctactacctcccccatcgctcctctgcccccctcaccctgtgggcaccaacacctcccgcacacagatgaaaaccatctacagagcccttcccgggtccctcgacccaagtggtgtagccgttaccaatgtttacaaccaggggccgcccctccttagatgtgtttactcgcattcacaggccacctgttggtttgagtttcatgtgtctccttccctggcctaggttgacttgagcacacaactcgatctttcttcccctccatcaaggcagtgtgtgaggactgtgtgggaatgacatttcttgtacatacttagcacagcacctagagtatgaacttgtactattgttctgtaaagagggtgaaatagagcttattgtaaagtgtcgggagaagtatagtattgtatttgtaacaatatcgttctttgtatacacaaaactcaatgatctatatataaatataaataaatatataaataaaatatatctacacgtgagcctggaatgtggacaccgcacacccactgaatgtacttccttgacagtctggtcactggtccctccctccctccctcctccgtcccgtggccacagtcatccagtttggggttgtgatgtatttactgtgctatctatcttcctttatttaactgaacgctaatgtctgtataagagttgctgcaacaataaacaagaacttcacctcttggcctggccaag

SEQ ID NO: 23679 - DNA, 421 bp, Homo sapiens
gaacttttattagttcatttttgcttgtttgtttgtttatctaaacagtgttacatttttatcaggttaaaatagtgggtactgagacagtatttgcaagtccatgtgggaatctcaagtcaaaatacataaaatggatacaaaaaaaatagaaagcaagaaactaaactgtatcaacagagaaaatcaccttcactagaaggaagacaggaaggaaagaagaccacaaaacaaccagaaaacaaatgagaaaatggaaggagtaagtccttacttatcaataataacattgaatgtaaatggaataaaccatccaatcaaaacacagagtggctgaatggaggaaaaagcaagatctattgaccgttgcctgcaagaaacacacttcacctatagagacacacatagactgaatgtaaaa

SEQ ID NO: 23680 - DNA, 475 bp, Homo sapiens
tgaaatgtattttttgcatgcttgcaaatatatatatgtattacagatacatatgtgtatttgcaccttgcaactggtgctgagatctgtccttttaggtaagtgtatttgtcttttcccctagagagctctttattgtgtcacctttatttaaactgattttccaaagttgtagtagaatctcagcattgaacagtccattacaacagtgtctgatccagccagtcatgtttcctatgagttcaggagtaactaaaccctacagctgctgaaagattgcatctgaaagaagattctgtgttaattcactcaacaattttttattgagtggctgtatgggccagatgctatcttgtgtgccgagatacagcagtgtacaaaatagacacaggccttggattagatggtctgaaatctaattatattactcttcactcttgcaaattttctgttccgtgtgtgcacactaacccat

SEQ ID NO: 23681 - DNA, 1251 bp, Homo sapiens
cagcggcgggttgcggaacttgacgtggtagtcggtccaccaggcgatgccggagcggtcgagcggcacctcgacgtagggcccgccgggctggcgctggtgccaaagcgagaaggagtcgttgaagaggctgttggcgatggcgccgcagggcgcgatgggcaggccggccgcgctgcgctggtagggggcgcactcgttgacagggtggcgcagcgcgctggggagtccgctcagctgcgcgtcgtcgcgggacacgccgtagcgccggttgttctggtagaagttggtcagctcgtagtagaggtacactgggccctggaagagctcgggcagcgagaagtaccaggcgcacgagcaggggggcggcagcgcccggccctggccagccgcggcgcacaccgagcagttgccggtgcccgggtcgcctgtatagtcgtactccagctccttgatgccgttggaggagtagtagaggcccaggcccaggccgatgaaggccaggcccgcgcagaagaagagcggcagcgcgatgctggccgacagcagcggctgccaggcggggaggcgctgctgagtgaaggcggtgttgtcgggctggtgggcgccccgggccgtggcgctccaggtcatggcggccgcgcggggaccgacgcgcgggctgaccgagtgggggccccgccgcggggcgcctccctctccgcgccgcgcaagcccggggactgctcgcgggtcgggtttcccgccagctcaggtgggtttttgcccgggcccctcctctgcctccgtcacagcggtgaatccctctgggtctgcagcaacctcaattcttgcctcctcagaagaaagaatttgaccaaggggcataaagcagaaagatagtgcaaggttttcaactctactttcatctcccatgagacctttttttgagacaagcaaagcctctcagttcagcttatatatttttgaatacaccctcccaacctaaaatcaaactagagctctgcaattagaacatagctacagaagttaacaaactgtattgttatttgatataagaaaatgtgatcataaacctatgcattattataaaacctattttaaaataaacatttcaaaggacaaataacatttttcatcagtttgaatactgtctcaccttttgggaagtaattccattgcaaagatcctttccccatatgtaagtttttctttctcttataatccaaagcctgtgagtgtatgtccaaa

SEQ ID NO: 23682 - DNA, 1131 bp, Homo sapiens
cagcggcgggttgcggaacttgacgtggtagtcggtccaccaggcgatgccggagcggtcgagcggcacctcgacgtagggcccgccgggctggcgctggtgccaaagcgagaaggagtcgttgaagaggctgttggcgatggcgccgcagggcgcgatgggcaggccggccgcgctgcgctggtagggggcgcactcgttgacagggtggcgcagcgcgctggggagtccgctcagctgcgcgtcgtcgcgggacacgccgtagcgccggttgttctggtagaagttggtcagctcgtagtagaggtacactgggccctggaagagctcgggcagcgagaagtaccaggcgcacgagcaggggggcggcagcgcccggccctggccagccgcggcgcacaccgagcagttgccggtgcccgggtcgcctgtatagtcgtactccagctccttgatgccgttggaggagtagtagaggcccaggcccaggccgatgaaggccaggcccgcgcagaagaagagcggcagcgcgatgctggccgacagcagcggctgccaggcggggaggcgctgctgagtgaaggcggtgttgtcgggctggtgggcgccccgggccgtggcgctccaggtcatggcggccgcgcggggaccgacgcgcgggctgaccgagtgggggccccgccgcggggcgcctccctctccgcgccgcgcaagcccggggactgctcgcgggtcgggtttcccgccagctcaggtgggtttttgcccgggcccctcctctgcctccgtcacaggtgagtttagttccaggccctacgagcagtgcccacaccctcccagttccgcctccgcccaggtgcgctgcacccccgcgggtcaccgggagccgcacctcgcccgccccttccgaggtgagcaggtgggtgttttttacctcacctggtagactcagtctcgcgtttcctctcagtccaggtcatcggactccacctcctctcctaggtgagtggcggccccgggctgcctctgagtggctcctacctggctcaggtaccaccttctcttccgccttccaagtgactagagttcctgggccagtctcccgaaatcaaaaggcgctccggcctccag

SEQ ID NO: 23683 - DNA, 418 bp, Homo sapiens
ctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattataggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactca

SEQ ID NO: 23684 - DNA, 1633 bp, Homo sapiens
ctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttgtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactcatagctgttgtctttgctgtgcttctattttgtgaatttttaatctattacttagcgatctttcagtgtaattggcctgaagtgaaaaccacagcctctgatggtgaacagaccacacgtgagcctgtgctcaaagccatgtttttggctgacacccatttgcttggggaattcctaggccactggctggacaaattacgaagggaatggcagatggagagagcgttccagacagctctgtggttgctgcagccggaagtcgtcttcatcctgggggatatctttgatgaagggaagtggagcacccctgaggcctgggcggatgatgtggagcggtttcagaaaatgttcagacacccaagtcatgtacagctgaaggtagttgctggaaaccatgacattggcttccattatgagatgaacacatacaaagtagaacgctttgagaaagtgttcagctctgaaagactgttttcttggaaaggcattaactttgtgatggtcaacagcgtggcgctgaacggggatggctgtggcatctgctctgaaacagaagcagagctcattgaagtttctcacagactgaactgctcccgagagctgctgtggtggctccagccgcgcctggttctcagtggccacacgcacagcgcctgcgaggtgcaccacgggggccgagtccccgagctcagcgtcccatctttcagttggaggaacagaaacaaccccagtttcatcatgggtagcatcacgcccacagactacaccctctccaagtgctacctcccacgtgaggatgtggttttgatcatctactgtggagtggtgggcttccttgtggtcctcacactcactcactttgggcttctagcctcaccttttctttctggtttgaacttgctcggaaagcgtaagacaagatgaagagcaggcgccattataaatatcaaagcccaagaaatggaactttgggcagagatcatgttagaatcaagtggatgatgagaccaattacaggccgtctctctgcacagcacagaaattctcaatcactgaaatgagtaactgcaaaataaatagttgattgtactgttctcatgctataaaagtggacaggtactctacaacaaatctgttttctcatttttatcaaatatatgtatcatcaaaggttgcatctgtacagtatgtaaatgctattaatgtcgtcactcacatgcacgacagtccttgttcccccaggaagggcctggtggccccagcacacacttgggattatgtgtatacataaataaatattgggctgtttccctcttcctgtga

SEQ ID NO: 23685 - DNA, 513 bp, Homo sapiens
ctgggtgcgcgccggctccggctgcagttcccgggtccctcggccaccgaagccaccctgccctggtgaaagggctcccgcaccgcccggtgctccccatctgcctggcgttgtgcgcagagctggaaagcatggctgttataaatgaattctgattttggggagcagatgccaacttagagcctcgtaccaatctctctgtctttaaaagatgaggtgacttggtgattttcctggaaaattatagaatattaatgaaactttatcatcttggtgagaaaagcattctaatagctttattctgacatacggaggtatggagagcttgaaggagtcagagaggtgcccagctaagacctgaatgccatcaccctccccagggctctgcagttttctcgtggtgaacccttgatggatttgttgttgcttgagaaatggcgatgatcgaattggggtttggaagacagaattttcatccattaaagaggaagagttcattgctgttgaaactca
